United States Patent 7,745,391 (HUMAN THROMBOSPONDIN POLYPEPTIDE) - sequence listing, part 53

SEQ ID NO: 156861 - DNA, 590 bp, Homo sapiens
ttcacagatggaagacaaatagctgcacctgaagattcttcaaaagttactgctggtagggaaagtgttacttctgttccagggacaactggcttttcaggttgcagtgagaccattgtcactgtgtttggtacagatgtcacaagtggttttcgaagtctgaagcaaaacagactacacaactctatagaaatttatagtcaaaatagtaacaacaggttatgagataggccttagacttagaaagtctggactgactggattctcaaatgacaagtcacacatttggggcaagttcatcttaccatctgtgaaatgtccctaaataaacgaagtattagtacagggtcttgcatatggaaagtgctcagcatttagcagtgatgggattcaggacctgctaccccaaaatatggcactttggcatttgaggaagcagtagaagcagaaaagttactcgttgaccttctcccctgaagtaagccaaaacacaattctttgaccttcctgtgaaataagtaattaaggctctcatggagaggtgcccaccctatatatggaggaaaggaatgttcttatctccaaaggca

SEQ ID NO: 156862 - DNA, 236 bp, Homo sapiens
cagggctgagtatatgacctgaaactctggctgtattcagtattacacaattattaggcccctccttgagaccctccagctctgggctgggagttgcggagaatggcaaagaagtatccacactcgtccctgggtttggatgttctgtggatacactgaggcaagaatgtggttataggattcaaccggaggaagactaaaaaaatgtctgtgcagggctgggacccaatgagatg

SEQ ID NO: 156863 - DNA, 348 bp, Homo sapiens
ggcccagagccacggacagggtgtccaatcattggaactggacaaagtgaaggacctgtgccagacagagcctgtcagtgagggtgcaaacaccttctgagacagcagaccccaaggagaagacacaaagggccaggacccacggtgagtctaagcagacctacaggtaaaccagccccccaagtccatggctgttggggccttcagactataaatgaggtttcccataggacatacccactctgcactgcagcagagccggtgaagcacgtggtaggccgggtctgctgaaggccgggaggaggagggttgaacaaacagagaaaaacaaaaaacagcacaggcctg

SEQ ID NO: 156864 - DNA, 711 bp, Homo sapiens
gtaatgccacagcgcacgtggtcttgggaaaactgaagacactgggatattcagaaggccacggcgatccagcttatcctgttgggcaaggtgctgggagtgaaggaggaaaagggcaggagagcccagagaggagacaaaagggtggggtcactgcatatagtggccaagagctgctaggactagtgcacaggacacagcagcctcttccagaaatccccttcaacaagggctctccagctgagcttccttggagaccagggaaggaagagcccacagttgcccccacccctccaggccagcccatcccctagagactgctgacagctgggagaagggtgcaggctgcaggccacccgaggtgcccgccccgaccctggctttcatttttaatgagccattttccaagtgcttcacaagcaggcaggcaggcattgtttgcagccagcaggggagtcctgagccggctgttaatgggtttccctcagctccccctcctgggggtctgcacagccccttcggatgaaaggagccctctgcagagggcatggtgaccatgggcatggcagcttctgtcctctgttcgggctgtcaaagcctaccccaatctgcctggggaatgccttcatgagtgccaattagagttgggacaaaatgtgtgtgatttcagaagccaggggagttgagacactcggaacacagcaacttctg

SEQ ID NO: 156865 - DNA, 398 bp, Homo sapiens
  misc_feature (295)..(295): n is a, c, g, or t
ccttatcacttaatctgtcccagaactctaccactgatgaccatgtatagtgtctactctttatttttaatttctttatttcaatgtgcagcacacagtgaatacatctattctttgcattaccctcttgaaaggcaggataacatttgcctcatcttccttatacctctccatgatttttctcagaataatatatggctctatagttatatctgctaaaactatttttttgataataaaagaaactgttagagcctagagattaaggatagagagattaaggatagagagattnaggatagagagattaaggctagagagcattaaggatagagagattaaggatagagagattaaggatagagtgattaaggatagagagattaaggatagagaga

SEQ ID NO: 156866 - DNA, 525 bp, Homo sapiens
ccttatcacttaatctgtcccagaactctaccactgatgaccatgtatagtgtctactctttatttttaatttctttatttcaatgtgcagcacacagtgaatacatctattctttgcattaccctcttgaaaggcaggataacatttgcctcatcttccttatacctctccatgatttttctcagaataatatatggctctatagttatatctgctaaaactatttttttgataataaaagaaactgttagagcctagagacctgaacttatttacagagactatctgctctgtcttctctcacctaccattaattatctctttctgctgttatttctatcttttgcagtttgaaaatcattttccttcctagaaaaggcagaagtgaaatatgagctaagcagtgtgcctttctaacacctgctagccttacaatattttctctaagcactgagtgttatccttcttacgccgaaagaagcaaatgatctcttagttgtccccctacatgtctttttcttttt

SEQ ID NO: 156867 - DNA, 595 bp, Homo sapiens
  misc_feature (505)..(505): n is a, c, g, or t
caggagttcacggaaaagtcttatctttgccagcctcaaaaataaggtcaagaagaaacagtctctcggtttacagttggacagttgtagcctcaagaacaaatgaggtattaatattagctaggaatctctgacaaggaccagaacttgcatcctcagatatcttcagtgttgtgggtcttcagcacagccttgaagataattcctaaaaaggctcagtccacaaaaatatcaccaacttcaaaacaaattcacatcacatcattattgctcaggaacaaatgcttcagataaaagtagaaaagccagataactcaaactacagaggaagaaatgagacctcaaacttttgctgccacttgggaacaacatttttttttttagatagggtctcactctgtcacccaggctggagtgcagtagagcagtctcggctcactgcagccttgacctcccaggcctaggtaacactcccacctcagctactcgggaaactgaggcaggngaatggcgtgaacccgagaggcggagcttgcagtgagccgagatcgctccactgcattccagcctgggccagagtatgagactccgtctc

SEQ ID NO: 156868 - DNA, 133 bp, Homo sapiens
aaccccaactctttcaatagtctaaatctcctgccaagatgctcagaggcattgggaattttatcaagttctttctgaagatgtctctcccgggacccactcccagctgggctggctgctggcctctctggag

SEQ ID NO: 156869 - DNA, 556 bp, Homo sapiens
caggtgatcatgtggcctcagaagccagagctagatgtgctcctgatcttgtagcccctcgtcctatgcctcatcaaaaccaggggtcattggaatggactgaagaaggagaaaactagaaaggatctgagggaagtggtctggctgaaagcttgacgtggacagagtcctggctctcaggcagacacttaaattctcctggtgctgcagacatcacagctgaatccatttaaaagaggatggcaaatatataaatcatgacctcaaaattccttcaatctctcacaggacaccagggaaatattttattatccctcaataacaaccagggtcaggaataaatttggaattctttaatttaggctccagttcatttgctaaattaaatgcttgaaataatttcctgctatgaaaatatgagactcttactattcagataaatagacttttcaaatcaaaggcttgaaatcttaagaattatctcaaaatgccttttgaaaaaccttttctgttttggatcataaaatgtcaaaggcacactatcatgaaccacagt

SEQ ID NO: 156870 - DNA, 528 bp, Homo sapiens
gcccaaggttcccagatttggcatagcctgtatcttatagaccagaagccagaggcccaggaagactaagggccagatactggtctaggcactggagaaaccaccatgaacacaacacccaggttccttctctcttagaggttaaagtcacttctttcctttcctcatgagaaaaggggaaatttcagtattggtattgaattcctaaaaatagggagatgttatgattccttggttttaaaaacaggcaggcagaaaactgttttcctgatgtaagtgtgtatattcaagaaggggaggggcatgtggtaggtgggaggcagtccagtaaacaatatttcgagagcaaacatagcctagtgaataaaactatctagcctaggtgaggtggcctgtaatcccagcactttgggaggcccaggtgggggggatcacctgaggtcaggagttcgagaccagccagggaaacatggtgaaagctcatctctactacaaaattacaaattaggcagcgatggaatccccggt

SEQ ID NO: 156871 - DNA, 661 bp, Homo sapiens
ggattccagcctccagtgtcttgagggcttgtgtggcctccccctttgccctacctctgacagctttccagtcatgttcgtatttgtgccttctggttcagtcatttctatttttcacacacacaacagaagaagttgaacagatcctgagctgagctcacctaaactaacccagtctcccaagaaaggccagctccttgttggaaacagtgagttcctcttcaaaggtcccgcttgtcctctattttcaaagcttaacttccttgcctccttgcccctagttacaataaacaactttccagccactcccaatctgtaacccacatccattcccaatctgtaacccacatcagttcccaatctgtaacaacccacatctgttccttatttgaggcccttagttccaaaactgctcttcccaccgctagagcccctgatccatttgaagtagccagtcgggatcagcttagattgtgctgtccaaccccagccaatggggaccggacacagtagtagggactgactgcattagggataaaaaccccttccctcctttgttgggtgtgctctcgcagtgaccagaagaatgagcagcagccttctgcggaagtaaatttgcctcgctgagaaatcctttatttgagtgctcgttttctttgtg

SEQ ID NO: 156872 - DNA, 136 bp, Homo sapiens
aggctaaagggacacagagtgattgggggctattttaagtagaatgataaggaagagcctgtctagagagctatttgaacaatgacctgactgaagggacaacagaaagcagtgctgacattacaggtagcaggat

SEQ ID NO: 156873 - DNA, 489 bp, Homo sapiens
agctactcagacaacaggggaatgcagccgaggcatggcgtagtcattgtgcttcccggacacgtaagttcttgaaggacagtggtggtaattctaggctaaggaaccagcatgcaaaggcatagtgtaacttaggttctgcattatacagtcaagagccacaaaaagttttagaatagagaaagaggccaagcgtgatggctcacacttgtaatctacagcattacgggaggctgaagcagggaggatagcttgcggccaggagtatgagaccagcctgggctacatagcgagacaccgtctgcacaaaaagtgaaaaaataagccagagtacccctgtggtcccagctacttgggaggctgacgcaggagaatcacttgagcctgggaggcagaggttgcagtgagccaagatcacaacacgccactgcactccatcctgggcaatagagtgagaccctgtctcaaaaaaaaagtttctctgaaaga

SEQ ID NO: 156874 - DNA, 242 bp, Homo sapiens
ccaaaatttatgctgcccaataaaatataaattaattaaaagtaactgaaattcaaaatgtattcctcatttacaccagactcattcaagtgctccatacccacatgcagctatcggctactgtcttggacagcagggattataggtttctatcatctcagaaaggtgtattgggcagcgccagtctaaggaaattaaacttgtttttcttgactgttacatactatttcatagtctgggtg

SEQ ID NO: 156875 - DNA, 367 bp, Homo sapiens
caacctgtcccagggcagcactcgagagggagggaggccctcggagtagccagagcccctggagagggctgatagatgccccacagggctggaggtttctgtatggagtcctgctgtaggtcactcatattaggcatgatgtgaatgtgctccactcagctactgtgatctgattgaaataaccttttaagaaaagagcttgcaactgtggaaagaccactgttttggatcaggttgacatggagtctgggctttgatgggactgtatgaaccgccttaacccctgtgtttacctgtctttaaagtggtctaataagccatgacagtgtcctctgcacaaatcctttgtgaaagaacaatttgtaat

SEQ ID NO: 156876 - DNA, 465 bp, Homo sapiens
tgattttgatcagatatctaggaaggtgcaggtttagaaatttggtgtctcgatatcaaaggacatttcagtaagaatagaatttctcatatgacaagagaggcgcttaaagactgggacggaaatgaaaaataaggttaaaaaaaccctaaaacacttatgctgaagaaatgaagtgttgaaggagtaatgtcacttatttactctcgcaacccaggtgttttttttttggagatggagtctcactctgtcgcccaggctggagggcaatgtgccaatctcggctcactgcaacctccgcctcccgggttcaagcgattctcctgcctcagcctcctgagtagctgggattataggcggctgccgccatgcctggctaatttttgtatttttagtagaggcggagtttcaccatgttggccaggctggtctcgaactcctgacctcaaatgatccaccagcctc

SEQ ID NO: 156877 - DNA, 713 bp, Homo sapiens
tctgatgccaggggactgaatagccagcattttttggatattgtgtttttgcacctcatgtttatgaagtgcccgttttccactttgtgatattttcacttgacggttgatgaggtgaagcgctgttgtgggttgagcatctgtgcacatgcatacacctgctgtgcacacgcatacacctgctgtgcacacacatacacctgctgtgcacacgcgtacacctgctgtgcacacgggtacacctgctgtgtacatggaggagccactgaaactgctctcagcgttttcagtgctttggttttaatctgcaaaatgtgttgatgacaaatctttctcctcttcctgtagatttttttaatagtgaagtttatttggaattaagtttagtgaattcattaataacctagttggtaatggtcttttggcaaaaatgagccatagttataaagtagtaacatgttactgtgtggtttagaactagattttgagagcagttccaaagcagattgtttcagaatttatttttactccctggattaagagaactatatttttaaaataattctgttatgtttacaagtatgtgttgtgtaatatagtaatgcccttctccgtaaaacttgtcttcctaaaactggtctttctgtctatagcgggaatattggtcaaacctgtcaaataatcatggatacctactagttgctcagctttga

SEQ ID NO: 156878 - DNA, 290 bp, Homo sapiens
gcagttatttattatgaattgtctatgtcagacactgtgcagggctctttatattctacataagcctcgtgcatgcatgctagatgttcatatcaccattttacaggggaggagatggaagcttaaaatgcagtatctcactgaaaacacaagccgatggatctctctggcgtcaaaacctgtgcttttcatttggagtgtgctttcagtatatagttataaaaataagtgctttgatgctcacaggagccttaggaaatagaaattgggagaaagataccccaagtgta

SEQ ID NO: 156879 - DNA, 204 bp, Homo sapiens
acaagaatgcatgggaggaatggaaagagaggaaatactgcttccaaggcgaaatgctttgaagaagtagagttatagggatggagagagacccttgtaggaagaggaaacatttcttgatcatagtggaaaaggacacaaacatgctaatccctgagccctcaaatgaaaaataaggttatgattggggtcccagcccagagt

SEQ ID NO: 156880 - DNA, 311 bp, Homo sapiens
gaggctgaggtaggagaatcgtgtgaatctgggaggcggaggttgcagtgagccgagatcacgccactgcactccagcctgggcaacaagagttgtctcaaaaaacaaaaaagaaagaaagaaaaaaacaaccacagtttcatcagcacagcaaaaaggtttttgtttttgctcttggattttgtcgtttggtttttgcttaatatcaaatatccagtcagtgtaaactcgtttataatttggtcctttgatttcaaggagctatgatgcagttcgttgtggggatgtgttgtctccatgtcatacatgtg

SEQ ID NO: 156881 - DNA, 286 bp, Homo sapiens
taagggattggtaggggccaagacctcctcccagcccagccgcaggttgggggagccagtatgggtgctggaagggtagaaggtgggcagcccaaggtcaccgtgcccctccccccggttccaggcactgttctctaatcctggccagctctaaggtaacagttctgcctctcctaggccttcgccctagcccccaacccgggtcaatgggagccattcctgtgccgcatctcccgttcctactctatgacacagccctttccaccgtccagaagggagaggcatc

SEQ ID NO: 156882 - DNA, 308 bp, Homo sapiens
cactggcactcaatcccttgctggaaacaagttacaatattattttgtcttttcttcaaaatattaatttgctaaatcagagttgtggtaaagcttggcacagtccagctaataggaattgttgccagactttggacaaacacatatgcatgtgctcgaattcagacaaccccctctgcctgggccacagggagggagggctgtgtccattcgtcttgttcttgcagttagggctctgggtcaggacgttcagcaaattgcccattcccctgtatgtgcactcagtaaatattaattgatgatgatga

SEQ ID NO: 156883 - DNA, 447 bp, Homo sapiens
  misc_feature (293)..(293): n is a, c, g, or t
gaggaaaggcagacagtgggagtatggttgaagggtttgtgccttttgtaatcagtttacttttggttttaccaagagatgatatcttgaattcattcaaactagtgtctattgcagtacactaggaacatttgaattacaaaaggagaggaggagcctccacttcccacagttgctagtttacctgcaatcctttgagggcagtggtaatctccatgtgagctttctggtaaattccacactaggaccacattcagaacttacctgtttcttggccgtttacctgctatggncaatataatggcatcggccatgcggttatcatgtaaacaaaggtcaacagcactctcaaaattgcccgtcagcaaagcctgagtaattaaaccatcaatgtgcccactgacagagatattaaatgttcctccagataagggtagaaattcagat

SEQ ID NO: 156884 - DNA, 464 bp, Homo sapiens
ggaattgaattagagaacacgcaggtggtgtctgctggagaactgattgtcaaaatgttgtgttgggtggtttgtgagaacaggaggaaacccttttttcccctttagccattaacctaataaacatgttgtccctacattgtcttctgacaggttctcctccagattggcatgatgatcacatgtcaccgatggcttggaaatgttgagtgacttgcccaaggtctcatagagccctgactctagaatcagagctgggattaatcatgggcatggcagatgctgaagctcatgtcgcggctgcctggccctggctgctcccagctacaggccctggggcctcttcttttagtctcagtgcactgatttgtgggctccactccttggggacctggaagagctgttcagtttctcctcacttgctttggacctttggcagggctgctaaggtccccccataactt

SEQ ID NO: 156885 - DNA, 376 bp, Homo sapiens
cacacggccgctgagctgagtgaggggtgtcccagaaagaaactcttgatgctgtcccttcctgtgatcatttcagcttaaaacagcaaagagcaaaacacaactcctccccagaggctctccaagcccagcaaccccttcctggcctccacaagctcagtcattccccagaacagacctcgagactcaaaggtctcaagcccgaccacctggctgggcacctgcctgaagaaacgctgcctggggccaggggcagccttgcagtgacacgggtcaaaagccagcatgagggatcagaaaacccccgtcgcggaccctccactgggaagcgcgcagagcttcccaaccaagcgaccctcaacccacagcccactga

SEQ ID NO: 156886 - DNA, 566 bp, Homo sapiens
aacaatatgttgggatgtcacaaatggacttagcctacagagatttatattcaacttttgaccagagagttccattttaatgtgacactgagagtaaaaaactatcttttcctccttacctatttctcttcctacattctcggccaggaggaaggcactgctacatacccagtcttccccagcagagcctgagcagctctgttttccttctacttcccctcttctttcacatctcatgaccaagcacttcctattctgtctcccaaatgatcacagattttttcctccacttttgtcactgccactgcccttagcattactctgcctttagagaaagtctcttaattggtttggttgcttccttcagtctttattatacagaccactacacgcacatctgacagagacttttcacctttttatggttgaatgactgaaattcccagaataaaattaaaaccaccccagcatcaaatttgaggtcaaacagaggtgggtttgtatcccaggttcatatactgtccagcagtatggtctcagaaaactgacctccttaggagcctttg

SEQ ID NO: 156887 - DNA, 209 bp, Homo sapiens
ttcacagctggggatactttccattgcataaggcacctacccctaaagctttcattgtttcactcttaggcagttatgtcattatttcacttacctcattggggaaatcattgtttaacaaccaaatataaatggggaaatagtcttctactttatcttctctaggataacagcttccctcccccacttccctccacagaaggattagt

SEQ ID NO: 156888 - DNA, 153 bp, Homo sapiens
actaaccatttttctatgcatacagagccacttagggtcattagaggcagtctcttggtgactctaaaacaatcagatgaagctcaattacacagttgtatttacaacggtaaagataaatttaaggatattacctagctccagaatgtctaa

SEQ ID NO: 156889 - DNA, 660 bp, Homo sapiens
atgagtcattcagacaaaatttttgatccatctgttggaacatcacaccagatcatgtgaactgtgtgaaatgaacagtgcaaagacaagacaggatccctgctctctgctcttggacagcttaaaaagacaaatataaaaagggaaggaataaaacttttaaacacgcacaactccaacctaataaagtctgcatggaatccaggatcgaggttttgttataatcttacacaaaggttatgtagtagacaaaatctcagggactaatctcacacttgtttctcctgtatttattcagtctgggttttgacattaagatgtaagatttacattgccctacattgttttttttctaaaatgtagatttcattctggtctttgcatgtgagattaagaggaatcaggaatataagtccatgaaaaactgggggaaaggtaaacaaaatgtaagggaaatttaagaatttttaagtggacagatgtaggtcattatgggatttcaaagaaagagacacacatacattgagaatagcatgtgaaagttgcccctcctacaaaaaataatgggggaaatacactttcaactaagtaatcaagctgagtgcaacttgcaaatccttcttaaattctgaaacacacacgcacatacacacacactta

SEQ ID NO: 156890 - DNA, 1119 bp, Homo sapiens
ctcagccagaggggagtttatcttccaggagacatttagcaatatctggagacacttttggttgtcacaactcctggaagggggtgctttttgcttctaatggtagaggtcggggtgctgctgaacataccaccatgcacagaacagcttctcacaataaagacttacttggcctaaaatgtcaatagtgctgaggttgagaaactctgtcttaagggtgcactctgttcatatgtgttctggggttttggaatcttatgtggtgaggcagggccacaggctgctgactgaactcagtaagtttaggggctcatactcacttgtgggactaatggggagaaatgttggttcttgaggtaggtacatagggtctcctctttgcctaggtgaccagcaggattcacagtaacccaggtgcccagtattataagagtacttgatttgactgcagaagggtggtgtttctgccttgggtgttgtcagcccatttagctttgtgggctttgacctcgggatcctccctcttgtgtaggcttatacacatcaatggaaagtatttgctttgaagatttcaacatggaagtagttcattgctgacacagcggcatcaaagcccagcgcctgctcacagctgagactccattccccctgagtttgtttggcaagggtgacagtgagcaggaggaagagaaggagggagactgggaaggatgagactggagggaagaagaaacactgtatgatccctgagtatccattgtttccatgctttcctgctctcttggacccaggcctggtcagagttctcagtagaaaagatacgctcctcattttggctagttgctatggacagacaactttcttgttctgagagtgatacggggctagggaggactgggtcttgatcatagttgtttcaagactccaaccctatatatagttcgaatgctttcataatgggactaaatgtatttgtgtaattaaaaacaaagacactggccaggctcagtggctcatgcctgtaatctcagcagtttgggaggccaaggcaggaggatcacttgagcccaggagttcatgaccagcctgggcaacatagcaagaactcgtctcttaaaa

SEQ ID NO: 156891 - DNA, 386 bp, Homo sapiens
gtttcatcacttacaggaaaaccacccgcttatctgaaatctgacctacttcgggctggagccagacagggctcctgcatcccacagggacactcaggctgtagttgtccagatccatgcatccagccaagacttcagcaaggagcttcaaccctaccatgctcccagtattcacagaggcagtgggggtcagggctgagatctgcccctctggggcgtcacaggtggtgaggtgtgctcagcagggcctaaaatcttaggttccaatgagtccagtgcttcctttcttatatccaatatgctacagatgcagcccggcccatacgagtcgccacactcctgggattcagtaattcaactttctcattttaggggctgtgtcatgt

SEQ ID NO: 156892 - DNA, 494 bp, Homo sapiens
ggaggtggaggttgcaatgagctgagatcacgccactgcaccccagtcagggggacagagcaaagtttcttttaagaagtttctagagccaggcatggtggctcatgcctgtaatcccagcactttgagaggctgaggaaggcggatcacttgaggccaggagttcgagaccagcctggccagcatggtgaaactccatctctactaaaaacacaaaaattagccgagcatggtggcacacgcctggagtcccagctgctctggaggctgaggcacaagaattgcttgaaccagggagacggtggttgcagtgagccaagatcctgccactgcactccagcctgggcaacagagcaagactctgtcttaaaaaataacaataaaaagtttctagaggaaaaaatattttaggtgaaactaaattactattctttattcaatgattttcacgttcttattttaggtgaatagttaaataagctaaaacactttcc

SEQ ID NO: 156893 - DNA, 460 bp, Homo sapiens
tcactgactcctactcatattttaagactcaacttagatactgctctttcccagaagcctttcctgacttccaaatctggattagctgtgccccttggtgccctgagcttcctcccttgtggtattgtcttatggtgcattgaagttgctggcttacatttcttctctgagttctagctttcagatggcgagattgtgtctgagtttcaccttacacccccagaatctggtacagagcctggaatccatgtcccttaatatttgatgaataataaatatactgggtgtgaggaacgaatgggaccttcctgagatatgtatctggaagtcattaatggggaaaagtgctctcaagagtggtctaaagattttagaattgttttcacagaaatagtgtttgaagtcattggaacgagacactatgggagaaagaagaaaaaaatgtcgacgcggccgcgaa

SEQ ID NO: 156894 - DNA, 434 bp, Homo sapiens
gtgaaaaaaattctggttggtgagattgcatgtcactggataagagcatgagctagacagacccagtaaagaccaaaatccacatagttaatttggagacatgcataacataattatttgaatcaatcaaaactgaattaggaaaaggggaattccagattaatgtgggtaaagaaacagctgtgttattgtggctttttaggcttttcatttgaaatacccatgagccccctagatatcataaagttagatttaataaattatgaatgatttataaacttagcttatgataagatcaaaccttatctctgactgagcaaggctactgaaactgcttaatttgtgctcctccatatcatgctttgaagaatgtgtaacccgttcctctaaaccttagttttaaacttgtagctaagaagaatactttaatttca

SEQ ID NO: 156895 - DNA, 332 bp, Homo sapiens
gtgatgggccaagtgaaagagatcatgaaaactgaacaaaaagcacagggagaaaaaaatttactttacatttgagtttctagataatatttcattttatttttacaactaataataaaaaatattttcaatcttggtacttgcataatcactggtagaaaagaaacagaaagagcggcaaatcttttttaaatggaagctcttcctacacagtttatgctgttatgtggccagtcaccacttacacgcaggtacccagctgaactgagtcagtcatgaccttttttttgtttttgtttgtttgttttttgtttttgagatggagtctcgct

SEQ ID NO: 156896 - DNA, 669 bp, Homo sapiens
atttgacttagacaatattatgttcatccatggttttaactatgatgaagtgataacatgaaattctggatttccagcccagacctctgataggaaatccaaaaccatatgccccacttgatagcccataattaaagttttccaaaacagaattatcattcctcttcctgatgccctctatacatatagactcctccactcttcaacatttcctaagccagaaatttgagtgtcctgctcctttctccttctttaaatcctattccacattgattctgtcttccaagtatactgatcccagcactttaggaggtcgaggcaggcagatcgcttgagtccaggagttcgagaccagcctgggcaacatggcaaaaccctgtctctactaaaaatacaaaaaaaaaaaaaaaaaataacaaacaaacaccttgtgcggccccgccggggccccgagaaaaaagcttctcaagaacactgtcctctggcgggccgcggcgccccagcatggtctaaagtcgaaactgtggccacacgctgcccagaggaacagcggcgccggactaagtgtgggcctccccaccataaaaaagccgcgggggaccacacgtctggaaacatccgaggcgtcggacgccacggcgcttacaacaggctcaggaccgataaatc

SEQ ID NO: 156897 - DNA, 403 bp, Homo sapiens
  misc_feature (54)..(54): n is a, c, g, or t
tgatcatagttcattgcagtctcaaactcataggctcaggcagcagcttctcanctctgcctcccaagtaactaggactacaggcatgcaccaacacacctggacacagtccccacctctcagccatcttcagagccccacctccacctcctcaggctacaatggacagaatgaagtagagaaatcagaaatgcgctttgagataaatagtgaatgaaaccagacaacaagtgggatcacgtccaccacaaaaccaagcatgactttgcctacactttcagggatatttttacagggtgctgcagtactagatccaaggacgcaagagctttgcaagaaccaaagaaaaatatcaaatcctggcttaccaaaacaaatttaaaaatagacagaggctgatgca

SEQ ID NO: 156898 - DNA, 629 bp, Homo sapiens
atcccagcactttgggaggccgaggcagatggatcacctgaggtcaggagctcgagaccagcctgacaaacatggtgaaaccccatctctactgaaaatacaaaaattagccagacatggcggctaacgcctgtaatacaaactacttgggaggctgaggcaggagaattgcttgaacccgggaggtggaggttgcagtgagccaagatcgtgccaccgcactccagcctaagcaacaagagcgaaaccctgtctcaaaaaataaataaataaaaaataaaaaaggtattctaatgttagctacccttacattcctgaaataaacttaatgtgaacataatgtattatctttttaatacattgctatattcagtttgctaatcctttgttaggatttctacatctatattcacttgcattattatgaaacataccggtaaaaccagctggcccagtgttttctttgtggattttgtttattaatgtctttaagtggactcttcagactctacttctgcttgagtcagttttggtaaattatgtttttctaggaatctgttccattttttctaaaaaatcatatttactgccataaaattgttggcagtattcaattcacgctttctttg

SEQ ID NO: 156899 - DNA, 127 bp, Homo sapiens
ccaagtctttgctattgtgaaaaatattcttctattaattgacttgaggatttcacagtctctcttgaaaatctatctacagggctaccaaggtttccattaccttgaacgctgacgttcacgcctt

SEQ ID NO: 156900 - DNA, 345 bp, Homo sapiens
agcctcagtttactcatctgtaaaatcatggcatcatccttgccctgcctgtatgctacagctgctgtggggatcaagggaggtaactcttaggaggccagaaagtttgcaccaatgggactgatgattataataaaactctgtaactttgaagcacctactggtgccacagcctgtctgaggagcttgcacagtggtggcaaaggctgacttggcatcagcctggccaggatttgggagaagaccttgaaatcattgttttcttcctagtcagcaaggctctgtttgctccagtcctcctgggcacccagtgaggccacagacatcagcagcagggcagaaaaa

SEQ ID NO: 156901 - DNA, 492 bp, Homo sapiens
caccacgcaggacgttgggccccaccaaggggatatgtaggatagggacagaggacacggggcgggatccacgggaaagggttagcacagcagggccctgggcgggcacggggcctgccctgtggctgcaggtatattaatagttcctgggccccaggcaggcagtgcccacatgcttccaagcccgtgtggcctgtaggaaggcagcctagcgtccacagggagagaaggcctccgagttcctgctgaaccactcaacagcttaaaatacaaccagcccctctccctgtccagccagctgctagtgggaggggtgaaatcgtaccctgctccccccaacctgggcaccaaaccagggcccaagagggagagtacggccatcggggtcccggctagctgctgggagaggacgccgggctgcggcaggagggggtagcgagagaggggccacgctcacagctgcagcagtggtgcccaggccagcctgaggcc

SEQ ID NO: 156902 - DNA, 567 bp, Homo sapiens
tcattcccactctaaagcctttgtatgtgttgttctctgcctagaatgttcttcctctttatcagcatcaccaccccaaagagggcatctctgaacttccaatctgaagtagccagccagtcaccagcacatcaccaacttgccattatcactgacctcttatttgtttgtttctcccagcaaaatctaagctctgtcaggacagggattttctctctcttgtccattaccatatccttagagctcagaaggggtgtctggcccaggtgctcaatgactgtttgttcaatgaaagaatgaacaaatgaatcacacaaaaggagagaggaaaatactatttcccattaaaatgaagaaagagtttttattagaagggaaggccacagcagccctctactaccctcttttgactaaacttccaggaaattcattactaagttttgggcttcagtaagtcagagtcaatttctgttacacacacccaaaaaactccgacagccaactaagaaaggaggaaaaggaaggaaaaacaaaccaataggagattcctttcattcttgtctgaag

SEQ ID NO: 156903 - DNA, 328 bp, Homo sapiens
ctccacccgacggggtgggtttcaatttaatcaaagatataaagctttttagtgttctgtctttttgagacattacaaaggcaagaacttgaggctgtaaaagaacaccccgcccagtgttttagaattggtctttaaatcctttatcgaagtataattcacagacaataaagtctatgtatttatacaacttggtgagcttttacagatgtaaaacctgtgaagccatcaccaccatcaagacgcagcatgtgtctgtcaccggaaagcacagttctctcacaagaccaatcattcaaactgccctcttacagccacacccacctct

SEQ ID NO: 156904 - DNA, 337 bp, Homo sapiens
ccagcgagagccaggtggaacttacatcccttttataacctagcctcagaagccatccagtgccatttccaccacattctatttgttgaggcaatcacatgagcaccacccaggctcaaggggaggggaaagtgacctcacctctagacaggaggcagcaagaggttgaaagagcacctgggaccaggaatatttggaaaattcaatgcctgccgcagacaataagtaagtgctggactcctctgggcactggggtacagagagaattggacatagtcccagccttaagcatctcatattccaaagggtaagatggatatacagctgggctacatgg

SEQ ID NO: 156905 - DNA, 449 bp, Homo sapiens
ctccaagctgaacagtagtcacactgagcaggtcctaaacataagtccgctcacccacaagaaccacaaaaaatacaaactgtattcactttgttggttggaccattattttcttcaagccttcagagacaattatcctaactaccattaaggatttcacctgtcacccacagtcttgttatactgagacattttcacacctggatatgatacaaggggcttaatggaatttttatggctaaaaattaaagttcatttgactcaacagaatagtcaaataaaacaaaggagaaaacccaaaggaacaggttgaaagtagaggcttttgacttcctgatgagccaattttgcccagaaattcaaaccatgggatgctatatagctcatatgtcttgagagtgcccaaatgtcaacttatcgccagagtatcagccagtgcaggcttacag

SEQ ID NO: 156906 - DNA, 576 bp, Homo sapiens
gacacgactctggattagttacaatgctggtacaatttaaacagcatgtaaatagttatactgtcatgttcagggcataatgacaaggcaaaacgtctgtatgtgtttaagcaacagcacaagaattttttgccaacatattgtcagtctcatcagttggttgaatccacagcatgcagaaccaaaagacatggagggccaatgatactttcaattctttcaaatacaattaaagcttgtttagtgggccagaataccatccatcttggtgaatactcccagatgaacttgaaaacatacacacagggccaggtgtggtggctcatagctgtaatcccagcattttgggaggccgaggtgggcagatcacctgaggtcaggaattcaagaccagcctagccaacatggtgaaaccctcatctctactaaaaatacaaaagttagctgagtgtggtggcatgcgcctgtaatcccagctacttggggggctgaggcaggagaatgtcttgatcccaagaggcggaggctgcagtgagccaagattgctccactgcactccagcctgggtgacagagc

SEQ ID NO: 156907 - DNA, 253 bp, Homo sapiens
tctcatacataacaaataattcagttctgtgccttacacatttggccttttttcattgtaaaaatacaagccaaataccatggcttctgtccaccatctatgcacattatttccctcttaagaaaaagtttgagtttttcgtccgtgaaaataatacacatatataaatacggaaaatacagagaggcaaaattagagaggaaaattcattcataatcctaccatcatccaaagacaaccactgttaaatctt

SEQ ID NO: 156908 - DNA, 592 bp, Homo sapiens
aagtttgggccaggacctatgattttgaaatatgctttaaaatgataaattgtaaggaattataaagcccaaattctgtccaataggtgaggattaatttctaatgattcaatgaagctgaaaatggtagagtggatagttttgaagaactgattgttagaatcactttagaccatatccttcaactattattaatttttctgggtttaaaagaaggtactttttaataatgaaaatgttaagacaaagctcataagcattagattcttatagaggagagggcatagttgatattttgttaggagaattgaaatatttacatacattctaggcccaccagaaaaccagttgcccctgcattgtagccatctgcaagagacactgaagggaaagccaaagtttttgtcttgattttttaaataatgaattaaaatctattgagtaaaacagaatatgagtccctgctcatataaaataaatgactaaattaaaagtttcataagaaatgcaaaatttaagtgctttcaaaactcctcctcatggaataccactttgtaccaattatgatggccaaaattaaaacttataatac

SEQ ID NO: 156909 - DNA, 450 bp, Homo sapiens
gtctaagtacagaaataattcttcatgtagaaaagctaaattttgggtggttggtttggagacagagtctgcttccagtgtccaggctagagtgcagtggcacgatctcagctcactgcaacctctgcctcctgttctcaagtgatccttctgcctcagcctcccagagtgctgggattacaggtgtgagtcactgcactccacccagaaatactcttaaaagtctaaaaaaggagttaagtgctattaagaaatacacaaagggagaaaggtatactatagcatatgaaatgtcacagctcagtcacgatcactaaaacatagattgaggtgtgaaggtaagttaaagcaagactgaacactgacatagaaggaggtagagaagtgtttcggaaaccagatttaggattgtcagaagctaggaaagcaaaagcaaggcatgagtgagca

SEQ ID NO: 156910 - DNA, 354 bp, Homo sapiens
tcccttcttcctcgttgccatttaatccatctccaggcaatgacattcagcatgattatctatcttttaatgcttttcataatcctatgcattaacttaatttctgatttcacattcactttcatacttcttcatgctctgatttgagttattgaagatgtgggttaaatggtgaatattcctctgtagtcacaagtagggatgtccaggacaacagcaccagataacatcacataagcaactagactctcaatttgaaatgcctagcttacatgtgagaacaaaagtgtaagaaatagcagtaaaccctggaacattcaggtgaatatacaatgtccttatttttataactcg

SEQ ID NO: 156911 - DNA, 477 bp, Homo sapiens
aagagcatagcaccactatttgttgagggccttcgtttttcatcttcccatggcagaaggtgaaagggcaagagagcacaaaagcaagagggagccaaacttgcttttataacaaggccattcttgtgatagctagcccactcctatggtaatgacataaatccattcaggaaggtagcaccctcataatttattaggtcccacctcccaatactgctgcattggaaattaggtttccaatgcatgaacttcaggaaacacattcagactatagcagggtgttcatagaaatatgattaaagtgttttgtgctcaaataagtttggaaaaggctcctcaaatgtgtaccagttgttgtattgtaggactgctcagagtctctcatatgcaaatgtatattgttgtttccagtagagggaagcagaaatggcaacatttgaacaaaatattagcaaacaaattaccatgctcttccta

SEQ ID NO: 156912 - DNA, 412 bp, Homo sapiens
gaagaaccctgacatgtacgtataatttatatattacggaattggaataaattaagcacgctgtggcccccttaggatgacttccccaagcttcacaaatgcaaggcaacctttctcattagcactttcttcaaatctccaaatgagaagaccctcagacaggagaaacacttgagaatctcccccaacccccatctgcagaggaatgaggtgacaaggtcctgctgcccaggtctctcttttttttttttttaagacaaggtctaactcccattgcccaggctgtagtgcagtggtgcaatcacaactcactgcagcctcgacctcccaaactcaagtgatcctcctgcctcagcctccagagtagctgggatcacaggcatgcaccatcacatccagctaatttttctgt

SEQ ID NO: 156913 - DNA, 597 bp, Homo sapiens
agtttctgccaggttcatgaaaagcgcctgtttagaaacacgccttatttttgataggaagcctaggagatacgggtaactggatttgccttctctcctaccttacacagttgtgctccgtgttctgctcccaggcctgtaactagatttctggtggattggaggcgcttttctcctttctgagctctccaactctcaaagagagtcttggagctgaaccgccatacctttgggccccagatagggggtacggaactgctggaccctcagtgaggagggtgggtaaaggaaaggacatactggtgttccttctagaatggcctattttcattgatatgctttgtcttttttcagttgaggtggtctattgcgttaccgagctgtggggatgcacccacttagctgaagttctcatctaaaaacaaagtatttattttgctttctccaatcagttatgaagttttccgtgtattgccagtttaaattttgtcctttgagttctgggtacagtgcaactgaacttgtctgtagcttgatttcattaagtactgctgaaactgcatcttagtttcaacagaacagtttcactttagggtt

SEQ ID NO: 156914 - DNA, 422 bp, Homo sapiens
tgaaaaaatactatgagaaagttggcggaagaatattctggtcaaagtaaactatattcaaaatctctgaggtaaaaattagcatatacaagaaactggtttggcatgaaattatacacacacacacatatataatatatacgaagtataaataatatatatatgaagaattaatcagagagcacatcatgtaggtctttgtagtccatgggaaggagctggtattagtctacttgtaaagaaagctgttgttgtattctgctcaatggaatgtatgatacagtttattttacaaagagcccaatctggttgccacagtagagtgtacagagaagtcagagtttaaataaccagacttgagtccatttccatgatcaagagtaaataataatgctgacctggactcccacgtaaagaaggaa

SEQ ID NO: 156915 - DNA, 287 bp, Homo sapiens
tgaccttgagcacaaacttacaacctggttcatgaggactgagtaactctgcacctcccacagcctcagaagtggcggaggtcccagaggacagaaggtaacaggctcccctctcttcaaagaactggaagaagctcaaggggtcgtcactcataaggcaggcatctcaccctgccacgggcctgagtgggcgtcagattggaagctgtatgttcacttcaccaagtgaggggaaaccaggtaggaagggaagaaagtacacaaatatgtagcagggagggcctcag

SEQ ID NO: 156916 - DNA, 489 bp, Homo sapiens
gctctcggttctttatttttgataaagtccaagttattttttttcttttgtcaattgtgttttttgatgttgtatctaataattctttgcccaatccaatatcatgaaggttttcctatgtttctaaaagttttatacttttacgtctttcgtttatgactctgattcattctgtgttattttgtgtatggtgtaaggtgaaggtcttcattaatctttttgcatatggatatccaactgtactatcatcatttgttgaaaaactaaccttttcctgttgaattgacttggaaccttttttgaaaaccaattgaccataaatataagggtttatatccgacctctcaattgtgttccattagtttatatttctattcttatgccagtccctactgtcttgactattgtggcattgtaatatgtatttaaattgagaaaggtgaatcctaaaattttgttcttctttttcaacattgttttgggtattct

SEQ ID NO: 156917 - DNA, 438 bp, Homo sapiens
ggcgtgtgtagctgctctagaggatcaactatagacgcactaggtcccttcttttataaaccaatgtactttttactagcttatcctgtgatgttatattaatgcaagaaataagatttataatgataaaaacatagataaaaggaagaaaaggtacatttgcacaaaagaatctgtgctaatgttagcaatgaagcaaaccctctgactaagtcaactttaaaactctaagtttattggatttagaacttaacacatatatagtcaatatcccatatcattcaaattactcaaggcactcagtatacagaatatgaagaaatatttagatcatcggaacttgcctattataaagcaagggttaaaaatactcttcttcaaagtttggtgagtgtgtgagtaagaaacacctgctgccaactccatacagatagcaaa

SEQ ID NO: 156918 - DNA, 488 bp, Homo sapiens
gatccctcatataatctcattccactctgtcctgcgatgcttccactgagaaatgtgtgatattcttatggaaagtctctgtatataccacattgcctttctcctgttgcccttaagatttttgtttttggaaagttgactagaatgtgtcttagtgtgaatttctttagtttcatcatgactgtagtcctttgagcttcttatatttggatatctatttcctttttcacatttggaaggttttggctattgtagtttgaaaaatattctgtccctcatttcctctatattcctcttctgaaattcatgtaatgcatatattgattcacttgatggcgccccataagtcccttaggctttcttcatttttcctttttctttttgttcctctgactcaataatttcaaatgacctgtctttgagtttgctgattctttctcttgcttaataaagtctgctgttgatcccctataattttttttttcaaa

SEQ ID NO: 156919 - DNA, 243 bp, Homo sapiens
gagggagggagggacagatgaaggaatggagggatggatgaatggattaagggatggatggatggatggatggatgaagggatggatggatgaatggagggatggatggatggaaggatagatgaaggaaggaatggagggacagatgaatggattaagggataaatggatggagggagggatggatggagggatagatggatgaaggaatggagggatggatgaatggattaagggatggat

SEQ ID NO: 156920 - DNA, 742 bp, Homo sapiens
cagcataatgtgaggcaaggtccagccgttccgcccagcatacaagcttatggagcagccccctttggagatctccaggtagacttcagagagatgccaaagtgtggagatctgattcctagatttcgactgcccttacggatcggctcacataacgggcctgcgtttttggctgccatggtacagaagacggcaaaggtgtccaagtcacacagagccacggaatctcacaggagcctgagaactcctcctcctgggactctcagaggatccagaactgcagcccatcctcgctgggctgtccctgtccatgtatctggtcacggtgctgaggaacctcctcatcagcctggctgtcagctctgactcccacctccacaccccaatgtgcttcttcctctccaacctgtgctgggctgacatcggtttcacctcggccacggttcccaagatgattgtggacatgcggtcgcatagcggagtcatctcttatgcggactgctgacacggatgtctttcttggtcctttttgcatgtgtagaagacatgctcctgactgtgatggcctatgactgttttgtagccatctgtcgccctctgcactacccagtcatcgtgaatcctcacctctgtgtcttcttagtttcggtgtccttttccttagcctgttggattcccagctgcgcagttggattgtgttgcaattcaccttcttcaagaatgtggaaatctctaattttgt

SEQ ID NO: 156921 - DNA, 799 bp, Homo sapiens
cagcataatgtgaggcaaggtccagccgttccgcccagcatacaagcttatggagcagccccctttggagatctccaggtagacttcagagagatgccaaagtgtggagatctgattcctagatttcgactgcccttacggatcggctcacataacgggcctgcgtttttggctgccatggtacagaagacggcaaaggtattggggatcacacggaaactgcatgccgcctcccagcctcagagttccggaaaggtgtccaagtcacacagagccacggaatctcacaggagcctgagaactcctcctcctgggactctcagaggatccagaactgcagcccatcctcgctgggctgtccctgtccatgtatctggtcacggtgctgaggaacctcctcatcagcctggctgtcagctctgactcccacctccacaccccaatgtgcttcttcctctccaacctgtgctgggctgacatcggtttcacctcggccacggttcccaagatgattgtggacatgcggtcgcatagcggagtcatctcttatgcggactgctgacacggatgtctttcttggtcctttttgcatgtgtagaagacatgctcctgactgtgatggcctatgactgttttgtagccatctgtcgccctctgcactacccagtcatcgtgaatcctcacctctgtgtcttcttagtttcggtgtccttttccttagcctgttggattcccagctgcgcagttggattgtgttgcaattcaccttcttcaagaatgtggaaatctctaattttgt

SEQ ID NO: 156922 - DNA, 397 bp, Homo sapiens
gcaagttctggagcacaggttcagacttgccccattggggaaaaggagaagggaagggcattctggctgaaggaacatgtgataaaggcagtggaggcctggaagggcacagccctgatgtgcttagaaatgaaaatatctcctgggggaggggtacaggagccagcattgtgtcgttgcgggtccgagtgccatgccaaggtgcctggcactcatcctgggggcagacggaagccattacatttttttcaggagagatgacatgtctcagcctgtgtttgacaaaactagatctgaaggcgtgaagacaagttagatggctgttacagtagtccggtaggagagcctgaggcctgcactaggatgcaggcggtgctggtaggatacagtagggaga

SEQ ID NO: 156923 - DNA, 468 bp, Homo sapiens
tgtttgaccttacctccactcgagctgctattcaacaattcctttaatcatcacttactgagtcacaggacaattcaaatagcagcctttcttcaggcctcagttcagtcctaatcacctcattcttggagaatggtatcacctgatatttaactcagactactgaggttctaattttctttatctcttcttcacattcattccttttttcttattagtctctcagaaatgatctttttcctttttccatctcccactttcctcccaatcttttccctgttttgttttaccctcttttctgtcacatttctggggtcttctaggcttaccagcttacctgcatctggatcagtaaattgtcactcttcacccccaatccctgccaccatgcagacacacacttccattcaacattccctgtcttcagactacttctaccatagaaatgttcaataactgccccatgtc

SEQ ID NO: 156924 - DNA, 247 bp, Homo sapiens
aggcacaaatgccttttctctccaataaaaacaacagcaacaaagctattattctctgcttattttctgctagatgtcatcattatctctccatatgtaaatgaggaaactgaagcacaaagaggttacataacttgcccaagatcacaccactagtaagtagcagagctgggatttgaacccgtgctctgagccaccatcctggattgctccttagcctctataaggtccccagatgcagttatgt

SEQ ID NO: 156925 - DNA, 577 bp, Homo sapiens
taagcttcatgtcagggggtgtggctgaccaactacaggaatttcacactagtatacaaagtgactcattcaaatattcagtcgtttaataataatctcttgcactctgccctcctgttttgtgccaggtatgccaagcagtgagaatataatctgagcagaaacaggcatgctctcagtccttgtggagattattggttttggttttgggttttttttgtttttttgtttttgtttttgcaggtgggtgggggatgtagaaataagcagcaaggacatctgctgagaaaattgggatggagtcaaagggatgtgatatgtagagaaaaggaatcacactggatccttcctcaaagtcagtcaagcaaggcttcctaaatagcctctaagtcccacctccgatggcagaaagaaaagaccagattaacagttgtatacatttgttttgttttctaatctttctgggtcagtggcgtttatctttggtcacttgcattcctcctcagagctctgcttttcctagacaaggactgactgaacgggtatctagctttcctgggctgccagcactttggga

SEQ ID NO: 156926 - DNA, 3478 bp, Homo sapiens
gcgggagtagcgcagtcgccaaagccgccgctgccaaagctgccgccactagccgggcatggccatggcgtccccggccatcgggcagcgcccgtacccgctactcttggaccccgagccgccgcgctatctacagagcctgagcggccccgagctaccgccgccgccccccgaccggtcctcgcgcctctgtgtcccggcgcccctctccactgcgcccggggcgcgcgaggggcgcagcgcccggagggctgcccgggggaacctggagcccccgccccgggcctcccgacccgctcgcccgctccggcctggtctgcagcagagactgcggcggcggcctggagcgccccgaccccgcgacgtgcggagcatcttcgagcagccgcaggatcccagagtcccggcggagcgaggcgaggggcactgcttcgccgagttggtgctgccgggcggccccggctggtgtgacctgtgcggacgagaggtgctgcggcaggcgctgcgctgcactaactgtaaattcacctgtcacccagaatgccgcagcctgatccagttggactgcagtcagcaggagggtttatcccgggacagaccctctccagaaagcaccctcaccgtgaccttcagccagaatgtctgtaaacctgtggaggagacacagcgcccgcccacactgcaggagatcaagcagaagatcgacagctacaacacgcgagagaagaactgcctgggcatgaaactgagtgaagacggcacctacacgggtttcatcaaagtgcatctgaaactccggcggcctgtgacggtgcctgctgggatccggccccagtccatctatgatgccatcaaggaggtgaacctggcggctaccacggacaagcggacatccttctacctgcccctagatgccatcaagcagctgcacatcagcagcaccaccaccgtcagtgaggtcatccaggggctgctcaagaagttcatggttgtggacaatccccagaagtttgcactttttaagcggatacacaaggacggacaagtgctcttccagaaactctccattgctgaccgccccctctacctgcgcctgcttgctgggcctgacacggaggtcctcagctttgtgctaaaggagaatgaaactggagaggtagagtgggatgccttctccatccctgaacttcagaattcctctcctcctggtgcattcagatttatttgtattattaattattattttgcaacagacactttttctcaggacatctctggcaggtgcatttgtgcctgcccagcagttccagctgtggcaaaagtctcttccatggacaagtgtttgcacgggggttcagctgtgcccgcccccaggctgtgccccaccacagattctgccaaggatcagaactcatgtgaaacaaacagctgacgtcctctctcgatctgcaagcctttcaccaaccaaatagttgcctctctcgtcaccaaactggaacctcacaccagccggcaaaggaaggaagaaaggttttagagctgtgtgttctttctctggcattgattcctctttgagttctcttacttgccacgtacaggaccattatttatgagtgaaaagttgtagcacattccttttgcaggtctgagctaagcccctgaaagcagggtaatgctcataaaaggactgttcccgcggccccaaggtgcctgttgttcacacttaagggaagtttataaagctactggccccagatgctcagggtaaggagcaccaaagctgaggctggctcagagatctccagagaagctgcagcctgccctggccctggctctggccctggcccacattgcacatggaaacccaaaggcatatatctgcgtatgtgtggtacttagtcacatctttgtcaacaaactgttcgtttttaagttacaaatttgaatttaatgttgtcatcatcgtcatgtgtttccccaaagggaagccagtcattgaccatttaaaaagtctcctgctaagtatggaaatcagacagtaagagaaagccaaaaagcaatgcagagaaaggtgtccaagctgtcttcagccttccccagctaaagagcagaggagggcctgggctacttgggttccccatcggcctccagcactgcctccctcctcccactgcgactctgggatctccaggtgctgcccaaggagttgccttgattacagagaggggagcctccaattcggccaacttggagtcctttctgttttgaagcatgggccagacccggcactgcgctcggagagccggtgggcctggcctccccgtcgacctcagtgcctttttgttttcagagagaaataggagtagggcgagtttgcctgaagctctgctgctggcttctcctgccaggaagtgaacaatggcggcggtgtgggagacaaggccaggagagcccgcgttcagtatgggttgagggtcacagacctccctcccatctgggtgcctgagttttgactccaatcagtgataccagaccacattgacagggaggatcaaattcctgacttacatttgcactggcttcttgtttaggctgaatcctaaaataaattagtcaaaaaattccaacaagtagccaggactgcagagacactccagtgcagagggagaaggacttgtaattttcaaagcagggctggttttccaacccagcctctgagaaaccatttctttgctatcctctgccttcccaagtccctcttgggtcggttcaagcccaagcttgttcgtgtagcttcagaagttccctctctgacccaggctgagtccatactgcccctgatcccagaaggaatgctgacccctcgtcgtatgaactgtgcatagtctccagagcttcaaaggcaacacaagctcgcaactctaagatttttttaaaccacaaaaaccctggttagccatctcatgctcagccttatcacttccctccctttagaaactctctccctgctgtatattaaagggagcaggtggagagtcattttccttcgtcctgcatgtctctaacattaatagaaggcatggctcctgctgcaaccgctgtgaatgctgctgagaacctccctctatggggatggctattttatttttgagaaggaaaaaaaaagtcatgtatatatacacataaaggcatatagctatatataaagagataagggtgtttatgaaatgagaaaattattggacaattcagactttactaaagcacagttagacccaaggcctatgctgaggtctaaacctctgaaaaaagtatagtatcgagtacccgttccctcccagaggtgggagtaactgctggtagtgccttctttggttgtgttgctcagtgtgtaagtgtttgtttccaggatattttctttttaaatgtctttcttatatgggttttaaaaaaaagtaataaaagcctgttgcaaaaa

SEQ ID NO: 156927 - DNA, 571 bp, Homo sapiens
attttatttttccttctcaaaaataaaatagccatccccatagagggaggtctcagcagcattcacagcggttgcagcaggagccatgccttctattaatgttagagacatgcaggacgaaggaaaatgactctccacctgctccctttaatatacagcagggagagagtttctaaagggagggaagtgataaggctgagcatgagatggctattttatttttgagaaggaaaaaaaaagtcatgtatatatacacataaaggcatatagctatatataaagagataagggtgtttatgaaatgagaaaattattggacaattcagactttactaaagcacagttagacccaaggcctatgctgaggtctaaacctctgaaaaaagtatagtatcgagtacccgttccctcccagaggtgggagtaactgctggtagtgccttctttggttgtgttgctcagtgtgtaagtgtttgtttccaggatattttctttttaaatgtctttcttatatgggttttaaaaaaaagtaataaaagcctgttgcaaaaatgaaaatcatgttagaaac

SEQ ID NO: 156928 - DNA, 375 bp, Homo sapiens
acccctgcttttttttttgctttccatttgcttagtagatcttctcccttccctttgttttgagcctatgtgtgtctctgcacgtgagattggtctcctgaatacagcacactgatgggtcttgactctttatccaatttgccagtctttgtcttttaattggggcatttagcccatttacatttaaggttaatattgttatgtgtgaatttgatcctgtcattatgatgttagctggttattttgcctgttagtggtagtgccttctttggttgtgttgctcagtgtgtaagtgtttgtttccaggatattttctttttaaatgtctttcttatatgggttttaaaaaaaagtaataaaagcctgttgcaaaaa

SEQ ID NO: 156929 - DNA, 405 bp, Homo sapiens
aaaaaccaaatggtccatacccttacacacatgaagtgtgtttctccactgctcagcacgcctcctaattaggggtagtgccttctttggttgtgttgctcagtgtgtaagtgtttgtttccaggatattttctttttaaatgtctttcttatatgggttttaaaaaaaagtaataaaagcctgttgcaaaaaaaaaaaaaaaaaaaaaaaacaaaaaaaaaaacaaaaaaacaaaaacaaaaaaaaaagaagagaggggggcgagcgaaaaaaaaagaaaaccaaacaagagagggagaccacacgaacaacgaccacacccacaaaacgggagacaacaggggcggcacaccacacaacggaggcagccaaatacaaacgagagggcggcggcacgcggcaat

SEQ ID NO: 156930 - DNA, 3457 bp, Homo sapiens
gcaggaaaggcgcgggaggcgggggaggtgcggagatggcgctctgcacggcggcggagggagggcgctggcgccggggacacgaaaccgcagagcccggacgagtcagggagtgaggcgcgagccgggcgcccggggctctgcaggcgcaggcggcgcggggacaggagcaggttaccgggccgcccgagcgctcgcaccccgctgaaagaaacgcaggcggcccgccggctctgcctggtccgctacccgaccagctcccggctcggggctcagagctaggggcttacgccaagcggagcccggggaggggtgcccacctccctccgccgcatcccaagcctcggccgggaactccggggtagatgaccgtggacagcagcatgagcagtgggtactgcagcctggacgaggaactggaagactgcttcttcactgctaagactacctttttcagaaatgcgcagagcaaacatctttcaaagaatgtctgtaaacctgtggaggagacacagcgcccgcccacactgcaggagatcaagcagaagatcgacagctacaacacgcgagagaagaactgcctgggcatgaaactgagtgaagacggcacctacacgggtttcatcaaagtgcatctgaaactccggcggcctgtgacggtgcctgctgggatccggccccagtccatctatgatgccatcaaggaggtgaacctggcggctaccacggacaagcggacatccttctacctgcccctagatgccatcaagcagctgcacatcagcagcaccaccaccgtcagtgaggtcatccaggggctgctcaagaagttcatggttgtggacaatccccagaagtttgcactttttaagcggatacacaaggacggacaagtgctcttccagaaactctccattgctgaccgccccctctacctgcgcctgcttgctgggcctgacacggaggtcctcagctttgtgctaaaggagaatgaaactggagaggtagagtgggatgccttctccatccctgaacttcagaacttcctaacaatcctggaaaaagaggagcaggacaaaatccaacaagtgcaaaagaagtatgacaagtttaggcagaaactggaggaggccttaagagaatcccagggcaaacctgggtaaccggtcctgcttcctctcctcctggtgcattcagatttatttgtattattaattattattttgcaacagacactttttctcaggacatctctggcaggtgcatttgtgcctgcccagcagttccagctgtggcaaaagtctcttccatggacaagtgtttgcacgggggttcagctgtgcccgcccccaggctgtgccccaccacagattctgccaaggatcagaactcatgtgaaacaaacagctgacgtcctctctcgatctgcaagcctttcaccaaccaaatagttgcctctctcgtcaccaaactggaacctcacaccagccggcaaaggaaggaagaaaggttttagagctgtgtgttctttctctggcattgattcctctttgagttctcttacttgccacgtacaggaccattatttatgagtgaaaagttgtagcacattccttttgcaggtctgagctaagcccctgaaagcagggtaatgctcataaaaggactgttcccgcggccccaaggtgcctgttgttcacacttaagggaagtttataaagctactggccccagatgctcagggtaaggagcaccaaagctgaggctggctcagagatctccagagaagctgcagcctgccctggccctggctctggccctggcccacattgcacatggaaacccaaaggcatatatctgcgtatgtgtggtacttagtcacatctttgtcaacaaactgttcgtttttaagttacaaatttgaatttaatgttgtcatcatcgtcatgtgtttccccaaagggaagccagtcattgaccatttaaaaagtctcctgctaagtatggaaatcagacagtaagagaaagccaaaaagcaatgcagagaaaggtgtccaagctgtcttcagccttccccagctaaagagcagaggagggcctgggctacttgggttccccatcggcctccagcactgcctccctcctcccactgcgactctgggatctccaggtgctgcccaaggagttgccttgattacagagaggggagcctccaattcggccaacttggagtcctttctgttttgaagcatgggccagacccggcactgcgctcggagagccggtgggcctggcctccccgtcgacctcagtgcctttttgttttcagagagaaataggagtagggcgagtttgcctgaagctctgctgctggcttctcctgccaggaagtgaacaatggcggcggtgtgggagacaaggccaggagagcccgcgttcagtatgggttgagggtcacagacctccctcccatctgggtgcctgagttttgactccaatcagtgataccagaccacattgacagggaggatcaaattcctgacttacatttgcactggcttcttgtttaggctgaatcctaaaataaattagtcaaaaaattccaacaagtagccaggactgcagagacactccagtgcagagggagaaggacttgtaattttcaaagcagggctggttttccaacccagcctctgagaaaccatttctttgctatcctctgccttcccaagtccctcttgggtcggttcaagcccaagcttgttcgtgtagcttcagaagttccctctctgacccaggctgagtccatactgcccctgatcccagaaggaatgctgacccctcgtcgtatgaactgtgcatagtctccagagcttcaaaggcaacacaagctcgcaactctaagatttttttaaaccacaaaaaccctggttagccatctcatgctcagccttatcacttccctccctttagaaactctctccctgctgtatattaaagggagcaggtggagagtcattttccttcgtcctgcatgtctctaacattaatagaaggcatggctcctgctgcaaccgctgtgaatgctgctgagaacctccctctatggggatggctattttatttttgagaaggaaaaaaaaagtcatgtatatatacacataaaggcatatagctatatataaagagataagggtgtttatgaaatgagaaaattattggacaattcagactttactaaagcacagttagacccaaggcctatgctgaggtctaaacctctgaaaaaagtatagtatcgagtacccgttccctcccagaggtgggagtaactgctggtagtgccttctttggttgtgttgctcagtgtgtaagtgtttgtttccaggatattttctttttaaatgtctttcttatatgggttttaaaaaaaagtaataaaagcctgttgcaaaaa

SEQ ID NO: 156931 - DNA, 3424 bp, Homo sapiens
gcaggaaaggcgcgggaggcgggggaggtgcggagatggcgctctgcacggcggcggagggagggcgctggcgccggggacacgaaaccgcagagcccggacgagtcagggagtgaggcgcgagccgggcgcccggggctctgcaggcgcaggcggcgcggggacaggagcaggttaccgggccgcccgagcgctcgcaccccgctgaaagaaacgcaggcggcccgccggctctgcctggtccgctacccgaccagctcccggctcggggctcagagctaggggcttacgccaagcggagcccggggaggggtgcccacctccctccgccgcatcccaagcccggcccccttgatgcgctggcggcctcggccgggaactccggggtagatgaccgtggacagcagcatgagcagtgggtactgcagcctggacgaggaactggaagactgcttcttcactgctaagactacctttttcagaaatgcgcagagcaaacatctttcaaagaatgtctgtaaacctgtggaggagacacagcgcccgcccacactgcaggagatcaagcagaagatcgacagctacaacacgcgagagaagaactgcctgggcatgaaactgagtgaagacggcacctacacgggtttcatcaaagtgcatctgaaactccggcggcctgtgacggtgcctgctgggatccggccccagtccatctatgatgccatcaaggaggtgaacctggcggctaccacggacaagcggacatccttctacctgcccctagatgccatcaagcagctgcacatcagcagcaccaccaccgtcagtgaggtcatccaggggctgctcaagaagttcatggttgtggacaatccccagaagtttgcactttttaagcggatacacaaggacggacaagtgctcttccagaaactctccattgctgaccgccccctctacctgcgcctgcttgctgggcctgacacggaggtcctcagctttgtgctaaaggagaatgaaactggagaggtagagtgggatgccttctccatccctgaacttcagaacttcctaacaatcctggaaaaagaggagcaggacaaaatccaacaagtgcaaaagaagtatgacaagtttaggcagaaactggaggaggccttaagagaatcccagggcaaacctgggtaaccggtcctgcttcctctcctcctggtgcattcagatttatttgtattattaattattattttgcaacagacactttttctcaggacatctctggcaggtgcatttgtgcctgcccagcagttccagctgtggcaaaagtctcttccatggacaagtgtttgcacgggggttcagctgtgcccgcccccaggctgtgccccaccacagattctgccaaggatcagaactcatgtgaaacaaacagctgacgtcctctctcgatctgcaagcctttcaccaaccaaatagttgcctctctcgtcaccaaactggaacctcacaccagccggcaaaggaaggaagaaaggttttagagctgtgtgttctttctctggcattgattcctctttgagttctcttacttgccacgtacaggaccattatttatgagtgaaaagttgtagcacattccttttgcaggtctgagctaagcccctgaaagcagggtaatgctcataaaaggactgttcccgcggccccaaggtgcctgttgttcacacttaagggaagtttataaagctactggccccagatgctcagggtaaggagcaccaaagctgaggctggctcagagatctccagagaagctgcagcctgccctggccctggctctggccctggcccacattgcacatggaaacccaaaggcatatatctgcgtatgtgtggtacttagtcacatctttgtcaacaaactgttcgtttttaagttacaaatttgaatttaatgttgtcatcatcgtcatgtgtttccccaaagggaagccagtcattgaccatttaaaaagtctcctgctaagtatggaaatcagacagtaagagaaaagcagaggagggcctgggctacttgggttccccatcggcctccagcactgcctccctcctcccactgcgactctgggatctccaggtgctgcccaaggagttgccttgattacagagaggggagcctccaattcggccaacttggagtcctttctgttttgaagcatgggccagacccggcactgcgctcggagagccggtgggcctggcctccccgtcgacctcagtgcctttttgttttcagagagaaataggagtagggcgagtttgcctgaagctctgctgctggcttctcctgccaggaagtgaacaatggcggcggtgtgggagacaaggccaggagagcccgcgttcagtatgggttgagggtcacagacctccctcccatctgggtgcctgagttttgactccaatcagtgataccagaccacattgacagggaggatcaaattcctgacttacatttgcactggcttcttgtttaggctgaatcctaaaataaattagtcaaaaaattccaacaagtagccaggactgcagagacactccagtgcagagggagaaggacttgtaattttcaaagcagggctggttttccaacccagcctctgagaaaccatttctttgctatcctctgccttcccaagtccctcttgggtcggttcaagcccaagcttgttcgtgtagcttcagaagttccctctctgacccaggctgagtccatactgcccctgatcccagaaggaatgctgacccctcgtcgtatgaactgtgcatagtctccagagcttcaaaggcaacacaagctcgcaactctaagatttttttaaaccacaaaaaccctggttagccatctcatgctcagccttatcacttccctccctttagaaactctctccctgctgtatattaaagggagcaggtggagagtcattttccttcgtcctgcatgtctctaacattaatagaaggcatggctcctgctgcaaccgctgtgaatgctgctgagaacctccctctatggggatggctattttatttttgagaaggaaaaaaaaagtcatgtatatatacacataaaggcatatagctatatataaagagataagggtgtttatgaaatgagaaaattattggacaattcagactttactaaagcacagttagacccaaggcctatgctgaggtctaaacctctgaaaaaagtatagtatcgagtacccgttccctcccagaggtgggagtaactgctggtagtgccttctttggttgtgttgctcagtgtgtaagtgtttgtttccaggatattttctttttaaatgtctttcttatatgggttttaaaaaaaagtaataaaagcctgttgcaaaaa

SEQ ID NO: 156932 - DNA, 3501 bp, Homo sapiens
gcaggaaaggcgcgggaggcgggggaggtgcggagatggcgctctgcacggcggcggagggagggcgctggcgccggggacacgaaaccgcagagcccggacgagtcagggagtgaggcgcgagccgggcgcccggggctctgcaggcgcaggcggcgcggggacaggagcaggttaccgggccgcccgagcgctcgcaccccgctgaaagaaacgcaggcggcccgccggctctgcctggtccgctacccgaccagctcccggctcggggctcagagctaggggcttacgccaagcggagcccggggaggggtgcccacctccctccgccgcatcccaagcccggcccccttgatgcgctggcggcctcggccgggaactccggggtagatgaccgtggacagcagcatgagcagtgggtactgcagcctggacgaggaactggaagactgcttcttcactgctaagactacctttttcagaaatgcgcagagcaaacatctttcaaagaatgtctgtaaacctgtggaggagacacagcgcccgcccacactgcaggagatcaagcagaagatcgacagctacaacacgcgagagaagaactgcctgggcatgaaactgagtgaagacggcacctacacgggtttcatcaaagtgcatctgaaactccggcggcctgtgacggtgcctgctgggatccggccccagtccatctatgatgccatcaaggaggtgaacctggcggctaccacggacaagcggacatccttctacctgcccctagatgccatcaagcagctgcacatcagcagcaccaccaccgtcagtgaggtcatccaggggctgctcaagaagttcatggttgtggacaatccccagaagtttgcactttttaagcggatacacaaggacggacaagtgctcttccagaaactctccattgctgaccgccccctctacctgcgcctgcttgctgggcctgacacggaggtcctcagctttgtgctaaaggagaatgaaactggagaggtagagtgggatgccttctccatccctgaacttcagaacttcctaacaatcctggaaaaagaggagcaggacaaaatccaacaagtgcaaaagaagtatgacaagtttaggcagaaactggaggaggccttaagagaatcccagggcaaacctgggtaaccggtcctgcttcctctcctcctggtgcattcagatttatttgtattattaattattattttgcaacagacactttttctcaggacatctctggcaggtgcatttgtgcctgcccagcagttccagctgtggcaaaagtctcttccatggacaagtgtttgcacgggggttcagctgtgcccgcccccaggctgtgccccaccacagattctgccaaggatcagaactcatgtgaaacaaacagctgacgtcctctctcgatctgcaagcctttcaccaaccaaatagttgcctctctcgtcaccaaactggaacctcacaccagccggcaaaggaaggaagaaaggttttagagctgtgtgttctttctctggcattgattcctctttgagttctcttacttgccacgtacaggaccattatttatgagtgaaaagttgtagcacattccttttgcaggtctgagctaagcccctgaaagcagggtaatgctcataaaaggactgttcccgcggccccaaggtgcctgttgttcacacttaagggaagtttataaagctactggccccagatgctcagggtaaggagcaccaaagctgaggctggctcagagatctccagagaagctgcagcctgccctggccctggctctggccctggcccacattgcacatggaaacccaaaggcatatatctgcgtatgtgtggtacttagtcacatctttgtcaacaaactgttcgtttttaagttacaaatttgaatttaatgttgtcatcatcgtcatgtgtttccccaaagggaagccagtcattgaccatttaaaaagtctcctgctaagtatggaaatcagacagtaagagaaagccaaaaagcaatgcagagaaaggtgtccaagctgtcttcagccttccccagctaaagagcagaggagggcctgggctacttgggttccccatcggcctccagcactgcctccctcctcccactgcgactctgggatctccaggtgctgcccaaggagttgccttgattacagagaggggagcctccaattcggccaacttggagtcctttctgttttgaagcatgggccagacccggcactgcgctcggagagccggtgggcctggcctccccgtcgacctcagtgcctttttgttttcagagagaaataggagtagggcgagtttgcctgaagctctgctgctggcttctcctgccaggaagtgaacaatggcggcggtgtgggagacaaggccaggagagcccgcgttcagtatgggttgagggtcacagacctccctcccatctgggtgcctgagttttgactccaatcagtgataccagaccacattgacagggaggatcaaattcctgacttacatttgcactggcttcttgtttaggctgaatcctaaaataaattagtcaaaaaattccaacaagtagccaggactgcagagacactccagtgcagagggagaaggacttgtaattttcaaagcagggctggttttccaacccagcctctgagaaaccatttctttgctatcctctgccttcccaagtccctcttgggtcggttcaagcccaagcttgttcgtgtagcttcagaagttccctctctgacccaggctgagtccatactgcccctgatcccagaaggaatgctgacccctcgtcgtatgaactgtgcatagtctccagagcttcaaaggcaacacaagctcgcaactctaagatttttttaaaccacaaaaaccctggttagccatctcatgctcagccttatcacttccctccctttagaaactctctccctgctgtatattaaagggagcaggtggagagtcattttccttcgtcctgcatgtctctaacattaatagaaggcatggctcctgctgcaaccgctgtgaatgctgctgagaacctccctctatggggatggctattttatttttgagaaggaaaaaaaaagtcatgtatatatacacataaaggcatatagctatatataaagagataagggtgtttatgaaatgagaaaattattggacaattcagactttactaaagcacagttagacccaaggcctatgctgaggtctaaacctctgaaaaaagtatagtatcgagtacccgttccctcccagaggtgggagtaactgctggtagtgccttctttggttgtgttgctcagtgtgtaagtgtttgtttccaggatattttctttttaaatgtctttcttatatgggttttaaaaaaaagtaataaaagcctgttgcaaaaatgaaaatcatgttagaaac

SEQ ID NO: 156933 - DNA, 3482 bp, Homo sapiens
gcaggaaaggcgcgggaggcgggggaggtgcggagatggcgctctgcacggcggcggagggagggcgctggcgccggggacacgaaaccgcagagcccggacgagtcagggagtgaggcgcgagccgggcgcccggggctctgcaggcgcaggcggcgcggggacaggagcaggttaccgggccgcccgagcgctcgcaccccgctgaaagaaacgcaggcggcccgccggctctgcctggtccgctacccgaccagctcccggctcggggctcagagctaggggcttacgccaagcggagcccggggaggggtgcccacctccctccgccgcatcccaagcccggcccccttgatgcgctggcggcctcggccgggaactccggggtagatgaccgtggacagcagcatgagcagtgggtactgcagcctggacgaggaactggaagactgcttcttcactgctaagactacctttttcagaaatgcgcagagcaaacatctttcaaagaatgtctgtaaacctgtggaggagacacagcgcccgcccacactgcaggagatcaagcagaagatcgacagctacaacacgcgagagaagaactgcctgggcatgaaactgagtgaagacggcacctacacgggtttcatcaaagtgcatctgaaactccggcggcctgtgacggtgcctgctgggatccggccccagtccatctatgatgccatcaaggaggtgaacctggcggctaccacggacaagcggacatccttctacctgcccctagatgccatcaagcagctgcacatcagcagcaccaccaccgtcagtgaggtcatccaggggctgctcaagaagttcatggttgtggacaatccccagaagtttgcactttttaagcggatacacaaggacggacaagtgctcttccagaaactctccattgctgaccgccccctctacctgcgcctgcttgctgggcctgacacggaggtcctcagctttgtgctaaaggagaatgaaactggagaggtagagtgggatgccttctccatccctgaacttcagaacttcctaacaatcctggaaaaagaggagcaggacaaaatccaacaagtgcaaaagaagtatgacaagtttaggcagaaactggaggaggccttaagagaatcccagggcaaacctgggtaaccggtcctgcttcctctcctcctggtgcattcagatttatttgtattattaattattattttgcaacagacactttttctcaggacatctctggcaggtgcatttgtgcctgcccagcagttccagctgtggcaaaagtctcttccatggacaagtgtttgcacgggggttcagctgtgcccgcccccaggctgtgccccaccacagattctgccaaggatcagaactcatgtgaaacaaacagctgacgtcctctctcgatctgcaagcctttcaccaaccaaatagttgcctctctcgtcaccaaactggaacctcacaccagccggcaaaggaaggaagaaaggttttagagctgtgtgttctttctctggcattgattcctctttgagttctcttacttgccacgtacaggaccattatttatgagtgaaaagttgtagcacattccttttgcaggtctgagctaagcccctgaaagcagggtaatgctcataaaaggactgttcccgcggccccaaggtgcctgttgttcacacttaagggaagtttataaagctactggccccagatgctcagggtaaggagcaccaaagctgaggctggctcagagatctccagagaagctgcagcctgccctggccctggctctggccctggcccacattgcacatggaaacccaaaggcatatatctgcgtatgtgtggtacttagtcacatctttgtcaacaaactgttcgtttttaagttacaaatttgaatttaatgttgtcatcatcgtcatgtgtttccccaaagggaagccagtcattgaccatttaaaaagtctcctgctaagtatggaaatcagacagtaagagaaagccaaaaagcaatgcagagaaaggtgtccaagctgtcttcagccttccccagctaaagagcagaggagggcctgggctacttgggttccccatcggcctccagcactgcctccctcctcccactgcgactctgggatctccaggtgctgcccaaggagttgccttgattacagagaggggagcctccaattcggccaacttggagtcctttctgttttgaagcatgggccagacccggcactgcgctcggagagccggtgggcctggcctccccgtcgacctcagtgcctttttgttttcagagagaaataggagtagggcgagtttgcctgaagctctgctgctggcttctcctgccaggaagtgaacaatggcggcggtgtgggagacaaggccaggagagcccgcgttcagtatgggttgagggtcacagacctccctcccatctgggtgcctgagttttgactccaatcagtgataccagaccacattgacagggaggatcaaattcctgacttacatttgcactggcttcttgtttaggctgaatcctaaaataaattagtcaaaaaattccaacaagtagccaggactgcagagacactccagtgcagagggagaaggacttgtaattttcaaagcagggctggttttccaacccagcctctgagaaaccatttctttgctatcctctgccttcccaagtccctcttgggtcggttcaagcccaagcttgttcgtgtagcttcagaagttccctctctgacccaggctgagtccatactgcccctgatcccagaaggaatgctgacccctcgtcgtatgaactgtgcatagtctccagagcttcaaaggcaacacaagctcgcaactctaagatttttttaaaccacaaaaaccctggttagccatctcatgctcagccttatcacttccctccctttagaaactctctccctgctgtatattaaagggagcaggtggagagtcattttccttcgtcctgcatgtctctaacattaatagaaggcatggctcctgctgcaaccgctgtgaatgctgctgagaacctccctctatggggatggctattttatttttgagaaggaaaaaaaaagtcatgtatatatacacataaaggcatatagctatatataaagagataagggtgtttatgaaatgagaaaattattggacaattcagactttactaaagcacagttagacccaaggcctatgctgaggtctaaacctctgaaaaaagtatagtatcgagtacccgttccctcccagaggtgggagtaactgctggtagtgccttctttggttgtgttgctcagtgtgtaagtgtttgtttccaggatattttctttttaaatgtctttcttatatgggttttaaaaaaaagtaataaaagcctgttgcaaaaa

SEQ ID NO: 156934 - DNA, 3428 bp, Homo sapiens
gcaggaaaggcgcgggaggcgggggaggtgcggagatggcgctctgcacggcggcggagggagggcgctggcgccggggacacgaaaccgcagagcccggacgagtcagggagtgaggcgcgagccgggcgcccggggctctgcaggcgcaggcggcgcggggacaggagcaggttaccgggccgcccgagcgctcgcaccccgctgaaagaaacgcaggcggcccgccggctctgcctggtccgctacccgaccagctcccggctcggggctcagagctaggggcttacgccaagcggagcccggggaggggtgcccacctccctccgccgcatcccaagcccggcccccttgatgcgctggcggcctcggccgggaactccggggtagatgaccgtggacagcagcatgagcagtgggtactgcagcctggacgaggaactggaagactgcttcttcactgctaagactacctttttcagaaatgcgcagagcaaacatctttcaaagaatgtctgtaaacctgtggaggagacacagcgcccgcccacactgcaggagatcaagcagaagatcgacagctacaacacgcgagagaagaactgcctgggcatgaaactgagtgaagacggcacctacacgggtttcatcaaagtgcatctgaaactccggcggcctgtgacggtgcctgctgggatccggccccagtccatctatgatgccatcaaggaggtgaacctggcggctaccacggacaagcggacatccttctacctgcccctagatgccatcaagcagctgcacatcagcagcaccaccaccgtcagtgaggtcatccaggggctgctcaagaagttcatggttgtggacaatccccagaagtttgcactttttaagcggatacacaaggacggacaagtgctcttccagaaactctccattgctgaccgccccctctacctgcgcctgcttgctgggcctgacacggaggtcctcagctttgtgctaaaggagaatgaaactggagaggtagagtgggatgccttctccatccctgaacttcagaacttcctaacaatcctggaaaaagaggagcaggacaaaatccaacaagtgcaaaagaagtatgacaagtttaggcagaaactggaggaggccttaagagaatcccagggcaaacctgggtaaccggtcctgcttcctctcctcctggtgcattcagatttatttgtattattaattattattttgcaacagacactttttctcaggacatctctggcaggtgcatttgtgcctgcccagcagttccagctgtggcaaaagtctcttccatggacaagtgtttgcacgggggttcagctgtgcccgcccccaggctgtgccccaccacagattctgccaaggatcagaactcatgtgaaacaaacagctgacgtcctctctcgatctgcaagcctttcaccaaccaaatagttgcctctctcgtcaccaaactggaacctcacaccagccggcaaaggaaggaagaaaggttttagagctgtgtgttctttctctggcattgattcctctttgagttctcttacttgccacgtacaggaccattatttatgagtgaaaagttgtagcacattccttttgcaggtctgagctaagcccctgaaagcagggtaatgctcatttataaagctactggccccagatgctcagggtaaggagcaccaaagctgaggctggctcagagatctccagagaagctgcagcctgccctggccctggctctggccctggcccacattgcacatggaaacccaaaggcatatatctgcgtatgtgtggtacttagtcacatctttgtcaacaaactgttcgtttttaagttacaaatttgaatttaatgttgtcatcatcgtcatgtgtttccccaaagggaagccagtcattgaccatttaaaaagtctcctgctaagtatggaaatcagacagtaagagaaagccaaaaagcaatgcagagaaaggtgtccaagctgtcttcagccttccccagctaaagagcagaggagggcctgggctacttgggttccccatcggcctccagcactgcctccctcctcccactgcgactctgggatctccaggtgctgcccaaggagttgccttgattacagagaggggagcctccaattcggccaacttggagtcctttctgttttgaagcatgggccagacccggcactgcgctcggagagccggtgggcctggcctccccgtcgacctcagtgcctttttgttttcagagagaaataggagtagggcgagtttgcctgaagctctgctgctggcttctcctgccaggaagtgaacaatggcggcggtgtgggagacaaggccaggagagcccgcgttcagtatgggttgagggtcacagacctccctcccatctgggtgcctgagttttgactccaatcagtgataccagaccacattgacagggaggatcaaattcctgacttacatttgcactggcttcttgtttaggctgaatcctaaaataaattagtcaaaaaattccaacaagtagccaggactgcagagacactccagtgcagagggagaaggacttgtaattttcaaagcagggctggttttccaacccagcctctgagaaaccatttctttgctatcctctgccttcccaagtccctcttgggtcggttcaagcccaagcttgttcgtgtagcttcagaagttccctctctgacccaggctgagtccatactgcccctgatcccagaaggaatgctgacccctcgtcgtatgaactgtgcatagtctccagagcttcaaaggcaacacaagctcgcaactctaagatttttttaaaccacaaaaaccctggttagccatctcatgctcagccttatcacttccctccctttagaaactctctccctgctgtatattaaagggagcaggtggagagtcattttccttcgtcctgcatgtctctaacattaatagaaggcatggctcctgctgcaaccgctgtgaatgctgctgagaacctccctctatggggatggctattttatttttgagaaggaaaaaaaaagtcatgtatatatacacataaaggcatatagctatatataaagagataagggtgtttatgaaatgagaaaattattggacaattcagactttactaaagcacagttagacccaaggcctatgctgaggtctaaacctctgaaaaaagtatagtatcgagtacccgttccctcccagaggtgggagtaactgctggtagtgccttctttggttgtgttgctcagtgtgtaagtgtttgtttccaggatattttctttttaaatgtctttcttatatgggttttaaaaaaaagtaataaaagcctgttgcaaaaa

SEQ ID NO: 156935 - DNA, 1920 bp, Homo sapiens
gcaggaaaggcgcgggaggcgggggaggtgcggagatggcgctctgcacggcggcggagggagggcgctggcgccggggacacgaaaccgcagagcccggacgagtcagggagtgaggcgcgagccgggcgcccggggctctgcaggcgcaggcggcgcggggacaggagcaggttaccgggccgcccgagcgctcgcaccccgctgaaagaaacgcaggcggcccgccggctctgcctggtccgctacccgaccagctcccggctcggggctcagagctaggggcttacgccaagcggagcccggggaggggtgcccacctccctccgccgcatcccaagcccggcccccttgatgcgctggcggcctcggccgggaactccggggtagatgaccgtggacagcagcatgagcagtgggtactgcagcctggacgaggaactggaagactgcttcttcactgctaagactacctttttcagaaatgcgcagagcaaacatctttcaaagaatgtctgtaaacctgtggaggagacacagcgcccgcccacactgcaggagatcaagcagaagatcgacagctacaacacgcgagagaagaactgcctgggcatgaaactgagtgaagacggcacctacacgggtttcatcaaagtgcatctgaaactccggcggcctgtgacggtgcctgctgggatccggccccagtccatctatgatgccatcaaggaggtgaacctggcggctaccacggacaagcggacatccttctacctgcccctagatgccatcaagcagctgcacatcagcagcaccaccaccgtcagtgaggtcatccaggggctgctcaagaagttcatggttgtggacaatccccagaagtttgcactttttaagcggatacacaaggacggacaagtgctcttccagaaactctccattgctgaccgccccctctacctgcgcctgcttgctgggcctgacacggaggtcctcagctttgtgctaaaggagaatgaaactggagaggtagagtgggatgccttctccatccctgaacttcagaacttcctaacaatcctggaaaaagaggagcaggacaaaatccaacaagtgcaaaagaagtatgacaagtttaggcagaaactggaggaggccttaagagaatcccagggcaaacctgggtaaccggtcctgcttcctctcctcctggtgcattcagatttatttgtattattaattattattttgcaacagacactttttctcaggacatctctggcaggtgcatttgtgcctgcccagcagttccagctgtggcaaaagtctcttccatggacaagtgtttgcacgggggttcagctgtgcccgcccccaggctgtgccccaccacagattctgccaaggatcagaactcatgtgaaacaaacagctgacgtcctctctcgatctgcaagcctttcaccaaccaaatagttgcctctctcgtcaccaaactggaacctcacaccagccggcaaaggaaggaagaaaggttttagagctgtgtgttctttctctggcattgattcctctttgagttctcttacttgccacgtacaggaccattatttatgagtgaaaagttgtagcaaaataataattaataatacaaataaatctgaatgcaccaggaggagaggaagcaggaccggttacccaggtttgccctgggattctcttaaggcctcctccagtttctgcctaaacttgtcatacttcttttgcacttgttggattttgtcctgctcctctttttccaggattgttaggaagttctgaagttcagggatggagaaggcatcccactctacctctccagtttcattctcctttagcacaaagctgaggacctccgtctcagcgcaacagtattcgcaa

SEQ ID NO: 156936 - DNA, 264 bp, Homo sapiens
tctgggaccttagatgtgtattggggccctgtatgtgggtgtgtaggatcatgtgtgtgttttgtgtatgtgcctctgtgtgtgtgtgtgtgtgtgtgttgagatctctggtgtatgtctgatactctgggtatgtgagtgttggggtctgtgtgtgtttctatgcctggattcatacatgctccagtgtccctgggtgagtacatatctaggatcttggagtggctgtccttgggtgtgtgtgtgtgtctgggcctctaactg

SEQ ID NO: 156937 - DNA, 278 bp, Homo sapiens
tcccgagtagctgggattacaggtgcctgccactgcacccagctaatttttgtatttttagtagagatggggtttgccatcttgaccaggctggtctcgaactcctgacctcgtgatccacccgcattggcctcccaaagggctgggattacagacatgagccaccgcacccagcccgagcccaggaatcttaatgagcatgttaagcgactattgaggaaggtcacaaagggagtcgcagataatggagactcagtcttggggttttttctggctct

SEQ ID NO: 156938 - DNA, 402 bp, Homo sapiens
cacctgtagtctcagctactcgggaggctgaggctgaagctaggaatgggctggatgtggtgtctgaaccatagctggctgacctcagctcttcaccatggagccaggccctgtccaggagggttctgaccatctgcaaatctaagtcagacattctcagctgggaagagtgaacgggtaagtgcatctgaaaaaccccttagctctttcacatatgcttttttcttctttgggaagctcctcaccgaatctagaaatatgaattcatataaaccttgcaaccaccactgcaagtaggagaaaacatcccgattttagaaatggggaagcccaggcttaggaccaagctcttcagtagagatctgagaagttctctcaaggctgggcatggtggctcgtgtc

SEQ ID NO: 156939 - DNA, 161 bp, Homo sapiens
actcctgctgctcccaactcgccaagcattgttgaacaaatgtatatcattattctgagagactagattacgctttcacttattatggggaaacctagggggagaaatcccacaaatagcctaaaatcccctaaccgacatgccatttgggcgtacgggga

SEQ ID NO: 156940 - DNA, 167 bp, Homo sapiens
taccataaggcatgtagaacacacagatggccaattgtacattggcgtcctgtaaggccactcatttcttacatttagggcagttcaacaaacaggctgacgtactatgatctttcagacagcccacccacccagccaggagccatacatgttatcactcccctctg

SEQ ID NO: 156941 - DNA, 246 bp, Homo sapiens
aatctgcctttggcatcccacctccccatgcctacataatccctacattatcaaaggaaagacccctagaaggaactttggcagcagtagtgagatcagcgcggtgtaagctcattttctaacaaagcagcgggaggagtcggcaaactgactttatttctcaaaaagaatttatgcattgaaattaacaagtgagtgatcaggagtgtgggaaaattcaggaaaagtggctcagtgctgtgagag

SEQ ID NO: 156942 - DNA, 645 bp, Homo sapiens
catgccattgtcctgcctcagcctcccgggtacctgggactataggcgcccgccaccacgcccggctaattttttgtatttttagtagagacggggtttcactgtgttagccagggtggtctcgatctcctgaccccgtgatccgcccacctcagcctcccaaagtgctgggattacaggcgtgagccaccacgcccggccaccatttagtttttaggttatcagacatctgagtccatagccaatttggattctgcttaaggtgcaggtaattgctttgatgggtttaggtattgggagagttgtcagctgcctatttcccatttgacccctcgagtgaatccctgaatctgtctcaggttggtgattgattgctcagcttgagcagacagtacagggccactgtgtgggtgaacctggagcatctcagactggtctgttaggggctgttgtctgaggtaagcacagaagagaaggcacagtgacccttgtcagctccttaatacttggatcctgatgagctccagccagctcttcacctttccagaaagtccagtgtacaggtgcatagaagcagtcaaatgccggatcatttgttttcctgattctttgatttgaacatactgaaatgttgactagagaata

SEQ ID NO: 156943 - DNA, 416 bp, Homo sapiens
ttaagcaatctacccacctcagcctcccaaagtgctggaattacaggcgtgagccaccacacccagcctcctcctttttctttttttcccccattgagacataataattgtacctatttagagggtgtgatattttgatacatatctgcaatgcataatgatcagattgaagtgattagcatattcatcacctcaaacacatttattatttgtttatgctgggaggtctgaggaattcttgattcaaacacccagcccaatgtgcctgtcaactttcttccaggtgtcagttgtgagacgggacagatcttgtgtttcttcatggacttcatgtgagtggctgccctgtgttttcacatttttattaagcagcttaatttgccctttgaattccggtgatgagttggcgccagagt

SEQ ID NO: 156944 - DNA, 145 bp, Homo sapiens
tctgtgttgcttgtcctcctgtgagctggtgttttccccacagcctacatcacaggtagtctcggagggtgggggggtcactgcatttgtttatgaagggatgggctggcccgtatggcagaatagttgtgaagggacagtgctc

SEQ ID NO: 156945 - DNA, 300 bp, Homo sapiens
cacaattcagattccagttccttctctgctgaccatgccagtagtctccatcccactcccagaatagcccaaaagtccctccacccctcacacttaaaactttcccacgagatcacagggttctttctcactgcactgagacgtgctcctgcctcctgcccctgcctcgggctttgccccagccattcctctcctgaattctcgtccactcttccttttggtgctttaagacgctccttatgctagagacctatgtgagcagcgcccccacgtcactcccaggtttcccgacagcatttc

SEQ ID NO: 156946 - DNA, 626 bp, Homo sapiens
tttctatgttggttgggaaagagtgatgtctccacatgtaatttgtagagggtcccatcagtttccaaaagaggaagtgggtgtttgtcttgcttttgagacattttgggagacttagacacaatataatttctattgagaacaaagtagggttaggatttggagaaggaagacagatatttccttctctctgctaaagagatggtctggagtagaaaacttgtggactgtgtttacaattgtggagtactactcttggtaaaaacaataaagcagaatcgatgtctgtagaacagagctggaaggggcctcatggttggttttcaaggtaaactaaccacagacatcagttttccactcctcagcctttttagcatctgggttcatcttccaggaaggccataacaaagctccacaatctgaggatcttaacaactgaaattgattgcctggaagttctggaggatgaaagttcaaggtcagcttgggcagcgtaggtttcttccgggtgccatgagggagaatcattcgtgcttctggtgtttgctggcagccgctggtgttccttggctggcagaagcaccaccccaaccggtctctgcatcatctgggtattctccctgtct

SEQ ID NO: 156947 - DNA, 355 bp, Homo sapiens
ggtgatctagaggatcccgggaggtatggtgatcggaggaggggagtgcgtggcactgcgcaggagctgggcatcgtgggggctggggggagggagagcttttctgtagaaaagcagttcaaagaagctgaccccaaagttgcttaaggaggagcagatgagagagaacatcaaagaaaagtttaaactgatgcttgctgataggacgggagtacagggccaaatcagtgcttcagaacagatctaaatgtaccagtaaagtggatcactaccaccaagcctccacaggttcctgactccttgggaggaaattattcaaataaacacctggagtcaccaaaaagagacagagtga

SEQ ID NO: 156948 - DNA, 239 bp, Homo sapiens
aggtgcaatttatagaacccttgtccctagttctattaaactagacactggtaagtgctgggaatacaaaaacaaattccatttggtctctgccttcaagaagcatatttctggctgggcacggtggctcacacctataatcccagcactctgggtggccgaagtgggtggattgcttgagcctaggagttccagaccagcctgggcaacatggcaaaaccacatctctgcaaaaaaat

SEQ ID NO: 156949 - DNA, 502 bp, Homo sapiens
ttaactagctagcaagtggcagagctgtgatctaatcaaagtctagagtccatgtctcatctccatgaaggaagatgaagccctagaagtcatataacagcaatagagaaggagggatatttgggaggtggcttggacaggagcgagtgacttaccactggctgaggggaggagatggtgagttaggagggatttgagaaggatgctgaggttgctggcttgagtacctgaggacagttggtcctttcctctaccccaaggtccatggaaagaggaggagagatccaagcctctgagagagagttcacgagctcagtgacatacatggacagtccctaggtgtctatgggccacctgtgggcacaggctctatggtgagcagaatctgcaggtctagagcttaagagggaatttggtgctgctgcagtaggactcacccacgtgcagggagccaatcttctactctagcacacttgaggaacacaataggctcactacacaa

SEQ ID NO: 156950 - DNA, 356 bp, Homo sapiens
aggctgaggctgcagcgagttgtggtcgcaccactgcactccagcctgagcaacagagaccttgtctcgaaaaaagcaaaaaagaaatgactagagttttaggagctctgtgccaagaagaccacgaccagatatatttctttttacatcacaatatcacacaccaccttcttatccaagaagaaaaaggaaaaagaggaagagctatgagccagcaaataggaaaaaagtcagacttctctcacatgattttgcctctcacctccacctgtctatctgcactttaggaagtcaaaaatttccttagtcatggaactctccagaacccagagaaagcagattaaaaacaaagccaa

SEQ ID NO: 156951 - DNA, 499 bp, Homo sapiens
agccggcacctattggacttctgctggggatgttaagtaatttgcataaggtcacagctcaggtattctaacatcttctaaatcgtataaatacgtggcatctggttcataggagatgctctctacatgctgagtgaataagctagggttagtgaagcattgactgatatgcaagtttaggaggaaaaaaatgaaggattcatgatgaattataaagtgattattagtattagggtaaaatagaaaaggagtattacagtattaattatgagtaaaagtaaaataatttgttactatgaaatttctcaatagtttcagcgtaacttctccagaatactaactaaagagagctctatggactttggagaggattcttaagaaaactaggaaagaatcaaagaaatcaatatatttccccatttaaattgaaatactattctgagcaacttgagttactccaaaagaagaatctctacttcagattattaggaaagcctta

SEQ ID NO: 156952 - DNA, 415 bp, Homo sapiens
tctgtatactaatggagatgatccagtagaaaagaaaagactgatgatgcaggagacacctgccggaatgatatcccagagtaggtgagggggatgggatcagaaacacaagccgagggctggccttatgtgaaagcagtgacagctaatccatacagcaggagggaaggtagaagataccgagagagatgctgacaggtgggtagcttgcatgagttgtgttactaataaaaaatcaagacacatgggataaagtgtttgaaaggtgggaaagtcccagaaaatctaagctgatggccattataccaacattacaacatttgccatctggggagtcaggattatactctgtcagggaaaaaaaaaacaacttcacttgtaatattcacaaaagtcatgtgcttcacttttcctg

SEQ ID NO: 156953 - DNA, 595 bp, Homo sapiens
gcacaagactctgtttaaaaacaaaaaagatgaagaagaaggaaaaacgagctcagtttattcaagaggctccatgaaaacagaagtctgtagacaataaacttggatgctatattatagatcagcactggacaacagaaatataatacgcaccacaaatgtaagccatgcacgtaattttgaatttgctagtggccacatgaaaaagaagtaaagagaaataagtaaaattaactttaataatacattttatttcacccagtatatccaaaatattcattcaacatgtaatcaaataaaaaatttattgagctcttttatgggtttttggtaccaagccttcgaattccagcatgtgtaagtatacacaaagcacatctcattttggactagtcacatttcaagtgctcaaaagccacacgtggccagtggctaccataatgaacagtgcagatgtaaagcagaggttggcaaatgttttccgtaaagggccagatagtaaatattttaggccctgcagacccagaggcaaaatcaaagatattctgtaggtacttaaatagcactgtttgcctagggcgggctgcccagggtt

SEQ ID NO: 156954 - DNA, 532 bp, Homo sapiens
gccaagatggccgaataggaacagctcctgtctacagctcccagcgtgaccgatgcagaagacgggtgatttctgcatttccacctgaggtaccgggttcatctcactggggagtgccagacagtgggcgcagttaaaagaaagaaatacttctgaatcactgaatatggactcaccataatgaatctgctaattcccgattatgtgtcttgtggtttagttaaatgacaactgcatatttttgaagatcaactactaattagttctcagcggattcacaggaatactgctttccctcaatttggaaaagatcattataatactgaaatttctcattttcatttgtatattgtaccctgtaagctgtactatttttgtttctcattttcatttgtatattgtaccctgtaagctgtactatttttgtttctcattttcatttgtatattgtaccctgtaagctgtactatttttgtttctcattttcatttgtatattgtaccctgtaagctgtactatttttgtttctcat

SEQ ID NO: 156955 - DNA, 265 bp, Homo sapiens
atcacatgctacttctttcaggaatcctttcctcttccacttccagactgggctagagcaatcactaactctagtgctctcacagattcccacatacaggttaatctaaaacccaaaatgctcacaaaaagctgaaactttctgagtcccaacattctgagcaccaacatgacgctcaaaggaaatgctcattggggcatttcaaattttggattagggatgctgaacctgtaagtataatgaaaatatttcaaggctgggcacg

SEQ ID NO: 156956 - DNA, 612 bp, Homo sapiens
gcagagagaggaatgagggaaaatataatgatacaaagttgtccagatgtgataaaaagcatataaccacagagctaacaagctcaacaaagccaaagtaagatcaaaaacaaaggaaaccacaccaaggcacttcttcatcaaatttctaaaaaccattgatacaaataagtttttttaaatggctaaagaacagaggatacattaaatataggaaaacaaaaataaaactggctccaaaattgatgtcagaaacaacgtaagcctgaagacagtggaataaatctttaaggtgctaaaaaataagcaagccgggctggcgcagtggctcacgcctgtaatcccagcactttgggagacagaggagggtggatcacatgaggtcaggagttcaagaccagcctggctaacatggtgaaaccctgtttctactaaaaatacaaaaaattagccaggtgtggtggcgcacacctgtaatcccagctactcgggaggctgaggcaggagaatcgcttgaacccaggaggcggaggttgcagtaagccgagattgtgttactgcactccagcttgggcaacaagagcaaacctccgtcaaaaaaaaaaaaaaaaa

SEQ ID NO: 156957 - DNA, 267 bp, Homo sapiens
cacacactccgtatacacaaattcacaaagccatgctcactgcctgtgactgacaaggaatgggggcaggtactagccctctggcgcttttatcaattgatagatatcaattggccaatatcaataattgatcaattatcagtattatccaccctatctgtctgtaattagtataaaacttcttttctctttcccttccctaagactctaccactggagctaccaatactaaatcagaccgtgtgaatgtgccctttctattccttc

SEQ ID NO: 156958 - DNA, 570 bp, Homo sapiens
cgcttgaactcaggaggcggaggctgcagtgagccaagatcacactactgcactccagcctgggtgacagagcgagactccatctcaaaacaaaacaaacaaaaaaaagttgatggaagtaaaattcaaagtccctatcatagttcaaggaactctaaatgccctggcactgcccatgactccaactcaatctcatgcctccacccttactcacaatgctctgccatgtctgtgtttctcaagctcacccacctcccactctactcccccacctgagggtctttgcatgtactttctttttctctccctggaaccctcgtctccagaccctcatggcactggttctttcttactattcaggtctcaggtgacacagcagctcttcgactcctgcctggcataacccctctctcccttctctttgcggtgattctttgaacatagaggagaaattctaagcccaagggcagatgtggcgtagcttcaatataaaaatatcttacatggaaatggcttgatatcttctggattgtcactgagatctttccttctgcctgaccctccaaaacg

SEQ ID NO: 156959 - DNA, 189 bp, Homo sapiens
tgctgggattacaggcgtgagccaccgtgcccggccacgattgtcaggatttttgagaccttactacaacccctgacacctgacccacagtatagaattttccaggtgaaaaagacatgtagagaaagtcatcaatgccattcttttttttccccattcatgaaaatgattagattttcctttgagctg

SEQ ID NO: 156960 - DNA, 193 bp, Homo sapiens
aattacgcccagattcagtcaactgcaaactcaaactcaacaatttccagcatggacaactctccatgaactctgaccatcatttcattgcagctgaatccttgtctatctggaggggatacgtggggaaccaaccttgtttcaggttctactgagggatatttatgtcctgaggtgctgtggccacaattag

SEQ ID NO: 156961 - DNA, 182 bp, Homo sapiens
gctcggtcccctgaagatggcagagtggaaagctgggaaggacctgaggctttgatggagtcctactgctgaatcatccaaccctcagaactaccctgcctctctatgttatatgtgtgcattgctgaagcctttttatttatttatttatttttttgctatttctggttgggtcttctttg

SEQ ID NO: 156962 - DNA, 512 bp, Homo sapiens
ggagcctgaagtgggaagattgcatgagccagggaggttgaggcggtactgagctgtgatcgcaccactggactccagcttgggtgacagagcgagattctgcctcaaaacaaaaaaaagtataaaactgacatcaatgaacgtacttagaattttgaagctgtttctaaatctttagaaaatgtagggatagtgctaaactctacatgagatactgtgctaagccttcccatcatgtttttacaaacattcataagagtgcagtcaatctgacaggtgagctagtagtcatgaggcaggatttatgcccagcataaaaacgtgcttaacaaaaatgtaaaaaactgataggaaaattctttagtcttacgaaaaggagagcaaaagtctgtatctaatattctagacagggccttttataaaggcaaatagcaagaattaatgaactttttcagttcctatacttctatgttagataaatgttaaggaaaaaaaaaaggctccagttacat

SEQ ID NO: 156963 - DNA, 735 bp, Homo sapiens
tctcagcactttgggaagctgaggcaggcagatcgcttgaggtcaggagttcaagactagcctggccaacatggtgaaacctcgtctttactaaaaatatgaaaattagccgggcaaggtggcaggtgcctgtaatcccagctattcaggaggctgaggcaggagaatatcttgaacccaggaggtggagtttgcagtgagctgagattgtgccattgcactccaacctgggcaactgagcaaaacaccatctcataaaaaaactgctaaaaaaaacccccagtaccctgtttttatgtgttctgggctgttaattacaaatacaaatgtggttttccaaaatgttttttttaaaaaacaaaaacagcaaaattttagcataaacaaaatatagttttagaaactccaggatatgttaatgttaaaactgctaaaaaaaaaaaaaagtaccttgtttttatgtgttctgggctcttatttataaatggatttaccttcatgaatatccaatgaggtagtaaaagtgacacagaacataggtcagttctttactgtgcttgactgtcccatgctttgcagacatctggcatatttgcctctgcccactaaatgacagtgtgtctccaccccacctgatgacaacaaaaaaatgctcctacaggttctaacatgcaccctgggaaccaattttacattctcagtaactactgtgctaacaaaatcttcttccatgtc

SEQ ID NO: 156964 - DNA, 628 bp, Homo sapiens
ttcaaggtcaaattactctctaacttaaaaaactaattttttaggcactactagtctctttccaccatctgcctcagcctctcctactggttgccactctctgttcctagacttaggttgtaattatatcactaccctgctcaaaaagttctgatttcccaccaacaatacgacaggatttaaattcctcagtctaagagacaagaaataagcctttcccccacccctcaaaaaccagtctaaaaagtctcctttaatactctgtctggaagtaatccctgcctctgaaaatgaaatcttcaaacactttttttttttagacggagtcttctgtcacccaggctggtcttgaactcctaggttcaagcaatcctcctgctttggcctctcaaagtgctgggattatagtgtgagccaccacgcccggccatctttcatcttttttaacagttctatgaggccaggtgctgggattacaagtgtgagccaccgcgcttggccaacttttccatctttatgttctccttggatttcacctattcccaaactttaaatgttgtctaccaaatactgacaatttggaacattctaccagtagaacacacctcccctttgaacttcagcctca

SEQ ID NO: 156965 - DNA, 312 bp, Homo sapiens
atttgctatccagagaagtcagaaacagcataagaaattgtgaatcctagttaagatgggaagcaaaggccatagaaggtctggaattggggtcagggggacaaatcctaatagagaaaataagtcctagcggatgggaagcaagacagaatgttggacatgaaccaggtaagggcctttgggtcagggccagggctgcaggcagcaggacagtggaaaccccgctgttgtgtgaggccatataatgtagtagaaaggggccagccttagcacctggctagatttgaatcccaagttcaccacttcgtagtc

SEQ ID NO: 156966 - DNA, 313 bp, Homo sapiens
caagctcaatacagatgtggacagtagtgttcaaggagtcatctacgccagcagtaaccaatattttggcactgggaacaggtttgtggaagacacgggtgggattgggggatggtttcaggatgaaactgtctcacctcagatcatcaggcattaggatctcataaagatcatgcaacctagatccctcgcatgtacaggtcacgatagggtttgagctcctacaagaatctaatgccgcggcggatctgacaggaggcggagctcaggtggtcacgctggctggcccacccctcacatccgtactggcccg

SEQ ID NO: 156967 - DNA, 470 bp, Homo sapiens
gagtcccatgggtgcctcggtagcatctggattgtgggtgtggtttctagaaattgctgtatttggcaataggccaaagtgttgtatttccaaatacatttttcttatcagtgtgggcatataatttcagtcggagcctggatgactttgggctcacagagtgacttgcttcctagccctttgtatctgtgatgttcaccacaatgaagcttcagtgttcttaggatacatttagattaaaacccactggcgttataccattctttggctttagtctggtaccaaccagtttacatgttaaacccaaactagaaagtacaaagataggatatgtttggaattagcttctttccttttaaacaatgcattccaagattctgatacaaatcagatgcattttagagagtacacatggaaaatcaagacttaagaaaaatgtgagcatgcattttttatgttctgataagctg

SEQ ID NO: 156968 - DNA, 325 bp, Homo sapiens
atgtgaactcgttagcacttgttacttttaattatcttaatacttccttacgaggaaggaaagcaacaggctttttaacaacaggtaagattaaaaggcaaaaacaaggccaggcacggtggttaatgcctgtatatccaccactcagattctaccattaacatttcacttgtacttgcatttttatttgctatacaattatctacccctgtatccatcactaaaaactttctcctaagtactttagcatgcatatcattagttcattatttgacacattttcttttgagccaaaatacacatacaatgaaatacacagatttga

SEQ ID NO: 156969 - DNA, 298 bp, Homo sapiens
caacccacttgcacgccaccgtgtggacaccttaaagcgaccttctagctctgaaccccgctgagggaatggtcaccttcgctcctattagatggcttggcccaaaggacctagcgacggcccagacaaaaatttcttcctacaagctccatgtgtctgtggtctctaagactcaaaaacaaacccaaaacgccgccaacccacctttcacgagaggagtccttgagaagagcctctccagccaggaccaggtaagggaatctgtgcacttggccagacccagaacacacagtggcag

SEQ ID NO: 156970 - DNA, 299 bp, Homo sapiens
tatttgaagagaagaaatggcaaaattggtctgcaaaagaacaatctgtaatctaaactgattgaacagtaattctcgggttgaaaagtagagttcggctgggtgccgtggctcctgtaatcccagcactttgggaggccgaggcgagtggatcacctgaggtcaggagttcgaggccagtctgaccaacattgcagaaaccccctctctactaaaaatacaaaattagctgggcatggtggtgtgttcctgtaatcccagctactcgggaggctgaggcaggagaatcacttgaaccc

SEQ ID NO: 156971 - DNA, 121 bp, Homo sapiens
tggtgtgtctgagattactgcatgtgtcttctattctgtttgtgccttcccttcctagaatgtccagactctgtctccacctttgcttatagggagggaattcacgtttaaagaccctagt

SEQ ID NO: 156972 - DNA, 258 bp, Homo sapiens
aattttttgtatttttagtagaaatggggtttcaccatgttggccaggctggtctcgaactcctgacctcaggtggtccacccaccttggcctcctaaagtgctgggattacaggcatgagcaaccacacccagccccagattatccttcttaatttgtgcttcttgcctttcgtatatatctttttcattttgagtttccttgaattaaaactttttaattcaactcttggattgcttagttttgaataatttgaga

SEQ ID NO: 156973 - DNA, 624 bp, Homo sapiens
ccatctctcttaaattcagtctttattagagttctgatctttctgttagatgtctaaataagagaaaaaattatacagtggtctattaaaagggatgctattgatggttattttatattgtatatcaaagcctcttcatctataaggagctcttaccaattaataagaaaaaggaatgacatccagaaaaaaaaataggcaaaagacagaaatagataattcacaaaattagaaataaatacatgttgggtggcagggggaggtgaagggagggtgtctgttttttagccctctagtgaccaaaaactggaaattaaagcatgataaaaaaagaatcctgaataaatggggactttctgttggtggaaagaaatatagattagttacaatctttctttctgagggaattatttggaaatatatatctatctttaaaataggtatatcctctaacatagcaattgcacttcaaacacttatggatataattagataaattggcaaatctgtagatataaagaagtgttcatttcaatattgctcataataataaaaaactggaaacaacccgaaagtccatctatagggagcatgggttaaaataagcatagggcatatagctgg

SEQ ID NO: 156974 - DNA, 251 bp, Homo sapiens
cctttggctccccactgcgcaaacccaaagtttaccaaacttttcaactctacctccacttcagctttacactttactctccacttacttttggcaaatcaatataaaaaaaaccaacccatttcaaatgcagctacctcccagccatcaactttcctcttcagaactcaaaatttccttttgttttcatctaacttctttcttcctccatgccacatctgtattttgtattcttcgcgattagggttagt

SEQ ID NO: 156975 - DNA, 431 bp, Homo sapiens
aggccctctgtgtactctgcgttgcactaggagccagtctacaatgataagcaaactgtggttcctgtctcatggaccctcatagcctagaccatcatcaaagagtcatgtagataataaactttaaagcaacagagatgtgcattccactggaatatttttgctgctgtgaaagtggagggtgaggttctgacctcctgtgggggtacaaataggcttccccagaggtgtagctttggggccgagtcctgaagaatgaactggtgattactgagcaaaatgggctgcagttggggtcccctgccaaggaaaggacagatggggcatggtaagagggaggaacttagaggccggggacagttggaatcagagagtggggacatgtggctgaggaggaggctgaggacaaaggaaggcccatagctgaggag

SEQ ID NO: 156976 - DNA, 502 bp, Homo sapiens
atatggacaaggtagagccatggtcaacaagggaagaaagtatttcaagaagtagggcgatataaaatgttacaattgctgcagaaaagtcaagtaagatgaggctagaggaaggacatggagcttggcaacctaaaagtcatcagaatcctttcaagaattgtctcagtgtaatgacagggctagaagccagattggagtaggctgaggagtgagcaggagtcttacccgttactatcaaccctctgtactctaatagaacttatctcactacgctgaatccatatccttttcaacttttcaaatgaagtgtgagttcattaggaccataaattatttatttttgcattctagtcttatcacaatagtcagagtcgtcctcccaaatcagatcagctctctactctgcctaaaatcctccagtgactctcaagaatcctcatatgaccttccatatcagccattccctttatctctctggcttaatcttctacctctcgcc

SEQ ID NO: 156977 - DNA, 234 bp, Homo sapiens
ttgtctgcgacaaagtcaaggctttaagagcagccattccttcctgcccagtgctgtccacccctggcagactttcccttccccgggctgaaaattagggcaagatacagacagaaaaggcatttcttaaaattttaacaacctggaattcattcgtgattttaacaagaatcattttggtggagtgagagggacagatttgagtcagctgagaaaagtgtgacaaatgaggaa

SEQ ID NO: 156978 - DNA, 193 bp, Homo sapiens
cttttgctgggtcccataagttttggtacattgtttttatttccaagtattttctaatttttcttgttatttcttctttgatccattggttgtttgaaagtgtgttaattttcactaatttctgtattttctcagttttccttctgctatagatttttaactttatcccagtttggtttaaggagagactttg

SEQ ID NO: 156979 - DNA, 371 bp, Homo sapiens
ggaggtggaggttgcagtgagccgagatcacgccactgcactccagcctgggtgacagagtgagactctgtctcaaaaaaaaaagaagccatataaggattgaaaaggaaaagatggagttgtcataatttagagatgctttgagtgcccatatagaggatccaaaagaatccacagataaattatccaaattaataagggatgaattcagtagggttgaaaaaaatgaatatcattcataatagcaacaaaaactataagactatagaaataaatatagcaaaagatatctaagaccattatgaaaagaattttaaagtgttaacataaaagatctaaataggaatgccatcagcaagatggcgaggata

SEQ ID NO: 156980 - DNA, 400 bp, Homo sapiens
acggacaagagtgtgggtctgtgaatgaaggggacagggagccattgcacccatcagcagtgtcacttctggggctgccgggtgacaattgccatctctgcttcctccccggtggagcgtgtggctccagggcagcgagggtgtctgagctggccaggagcgcgtctggtctgttaggggaatatgtactcgcatcctgtccggtgtgaggggcaacgtgtgctcccgagctgtggcggaggtcagtcggggtcagtgaaagcacagaggtgtccctgggttagggtcagagaaggaggacccagtagagcagcgtgcccagtgccccccacccctagcctctctccaaggcttagcctccacccgcccgtctcccctcctctcctggtagcccctcaca

SEQ ID NO: 156981 - DNA, 317 bp, Homo sapiens
tcaaatattgtttatgcaaatgttccaaatgcatctgaagtgagttcactcaggtttcctcagcagtaaccccaaaattatataaatgacttcctcttttcccacattcctgcctcacaatccgtcttcattcagaaaataattgctacatcaggggtctcctcagttctccttctacagtgtctatgggttattatgaacagttttctgtctgtttttagcactacgatgtgacgtctgtaaaatctgtacttcctctccttctccgtacacccttaatgaaaagatgctaccgaattaaagcagaattatgctgg

SEQ ID NO: 156982 - DNA, 371 bp, Homo sapiens
tttcaggatcaatctttttcttttcctgctaatactactaccagacttaagaagttattagaaaaatttaaatcagaatttttttttttttgagatggagtctcgctctgtcgcctgggctggagtgcagtggtgcgatctttgctcactgcaacctccgcctcccaggttcaggcaattctcctgcctcagctccctgagtagctgggattacaggcacctgccaccaagcccggctaattttttgtatttttagtagagacggggtttcaccatgttagccaggatggtctcaatctcctgacctcgtgatccgcccgcctcggcctcccaaagtgttgggattacaggcgtgagccaccgggcccggc

SEQ ID NO: 156983 - DNA, 297 bp, Homo sapiens
aagtgattctcctgccttagcctcccgagtagctgggattacaggtgcccaccaccaggtccagctaatttttaaatttttagtagagactgggttttattatgttggccaggctggtcttgaactgctgacctcaagtgatccacccgcctcagcctcccagagtgctgggattacaggcctgagctaccacgcccagcctatcatcactgattttaaaactttgcatttaagtagtttagatttttatacacacaaatacacaatcttaaacatgtaaatgttgctgtcttgagg

SEQ ID NO: 156984 - DNA, 398 bp, Homo sapiens
ggaccagctctcccttctccctgcctggtgaaccctcagggtccaactgtcactactgtctccactatgtcttcctgatgttccacccccggtcacatcctcaatacatctgtgactttctttttaaaacggcgtctcgctttgttgcccaggctggagagcagtggtgtgatcttggctcactgcaacctccacctcatgggttcaagcgattctcctgcctcagcctcccaagcggctgcgactacaggcatgtgcccccatgcccggctaatttttgtatttttagtagagagggggtttcactatgttggccaggctggtctgaaactcccaaccttgtgatctgcccacctgggcctcctaaagtgctgggattacaggcgtgagccactgcg

SEQ ID NO: 156985 - DNA, 353 bp, Homo sapiens
ctcaaaaacaaataacccctccccaactctgacaaaaataatggacagagaaaactgtgtaagttttctgaagcactataaaggttgcttttagcagaatctttttacttcttttgtttttgtttgtttgtttgcttgtttgtgtttgggacggagtctctctgtgtcgcccaggctggagtgcagtggcgcgatctcggctcactgcaagctccgcctcccaggttcacgccattctcctgactcagtctcccgagtagctgggactacaggcgcccgccaccacgcccagctaattttttttgtatttttagcagagacggggtttcaccgtgttctccagtatggtctcg

SEQ ID NO: 156986 - DNA, 314 bp, Homo sapiens
agtctcatgaacacaattaggagtcaaattctctacttttctgaagaaaaatatttcaaaatatttcagccagttaaggcttttagttacacagaatgctgctcaggcagaaatggactctcattcacatctgaggaagtagtccttgcctcgaaaaatgttgaggacggtaagtgtgaaaatagaaaaaaacatacatagtgtgacaacctttaagttaaaagggatatatattaagaagctcagtatgactacttcaagcaccagctaaaaattaagcggaaattcccactatgagaaagctatacaataga

SEQ ID NO: 156987 - DNA, 412 bp, Homo sapiens
aatagcggaccgagatgggtctgctctacactctacccataggctctcttccctgttgatgtgtctatggcatggaccttctctggccaagttttgaccggcctgactgaccttgaaattttgatgaaacagccaatcaaagatctctgatctacacaggcctaccatggccctgttctgcagccccacttgggggatggaggacccttgcctcctccctctcctgcagccccagagacgggtgaagggtcgtgagcgcttccctggtcccccaacacacggtacacctacaccccttatccccatactagttattatcgaaaccatcagcctactcattcaaccaatagccctggccgtacgcctaaccgctaacattactgcagggacccactcggcagggacccactcg

SEQ ID NO: 156988 - DNA, 522 bp, Homo sapiens
tatgaaggatgtatacttaaccccattttataataaggaaactgaggttcagaaagggtttcggtctcatgaccaacaagtggtagagcaaggattcaaaccagctttgtctaactccgaagctagtaccctttccaccactctacccataggctctcttccctgttgatgtgtctatggcatggaccttctctggccaagttttgaccggcctgactgaccttgaaattttgatgaaacagccaatcaaagatctctgatctacacaggcctaccatggccctgttctgcagccccacttgggggatggaggacccttgcctcctccctctcctgcagccccagagacgggtgaagggtcgtgagcgcttccctggtcccccaacacacggtacacctacaccccttatccccatactagttattatcgaaaccatcagcctactcattcaaccaatagccctggccgtacgcctaaccgctaacattactgcagggacccactcggcagggacccactcg

SEQ ID NO: 156989 - DNA, 219 bp, Homo sapiens
ggccccgaggtttggatgagtgttgtgtccctggctagactgacccctggggtggcaccctcatcctggaatctattgagaggccacccagaggccaccaggaacaccatggggagagggagggtggctcgggaggcagcccccagaggaggcccaactggctggtccttctgtgagccgaggccaccctgtggccacatcacagtgcagagggctcag

SEQ ID NO: 156990 - DNA, 261 bp, Homo sapiens
caaaaatgggagaagaaacacgaaatcctgctaggaagctgagagaaaatctgagaacactcagcaaagaatgcatgagcaaaggatgggatagataacagacagcttttcagtctctagacatcacaaaacggctcagaaaatgaccagaggggccaagctggagaagaggaaaacactgagaaagagcagaaggagctcagttatgcgcggctggctaacgtctggggttgtctgccagggagtcacggtggctgggct

SEQ ID NO: 156991 - DNA, 274 bp, Homo sapiens
gtgctgagattacgggcgtgagccaccatgcctggcctcctatgactcttaattctgcagatggtcagattattttgacctcaggttgcctcttcagggtataacttaagtgatgacagctttctaaactttcaaagtcaatgaccacttaatatatgatgaaaatggggccaaaaaaaatcaatccacaaaaatctgttaatgctttattttatttcacttttacatgtttcgtcttccaggtacttggaatgtcatatctgactgtcttatt

SEQ ID NO: 156992 - DNA, 326 bp, Homo sapiens
cacggcaagggagcatttcaggcacaggtgcaaaatcgaccagggttactgctgggttttgagagtgtcttctcagaaaaacacccagaagagatcatctgaaggcaagttaaacaccgatttttgttttaactaaaggcaagaaattcagaaaaatggggtcactcattccactctagctcaaaagaatggtttaaacataaatgatctcatcctgagttagatataccaatctctagaaatttcaaaataactaaggaaattggggtcaatcctcaaaattcaggggtgaactccatgaagcataccgcttactcccagaaaca

SEQ ID NO: 156993 - DNA, 186 bp, Homo sapiens
agaatgtcacaaatatgaattatcatttctaatggaaagcctatgccttcttctgagctacagagcagattagttaggtctcagtagtcctgctgaagtgcaacctaggaaacttattgagggaccagggccttcccgttcagtatttcattttattcttgaaaaagaaaatgctcctcatcattg

SEQ ID NO: 156994 - DNA, 233 bp, Homo sapiens
actgtgccactgcgctccagcctaggcgacagaccgagaccccgtctcgaaagaaaaaaaagaaaatccaatcctggcttcccttggcctggctcagtcaagcttcagcacctggcctcctcccttgccagccccgacactcctcactgctcccttcagattcctgccacgaggctctgctctgcctcccccagcctggcctggcttggattcctcgttcccaggctctgccc

SEQ ID NO: 156995 - DNA, 220 bp, Homo sapiens
ccgattatttgcaggaaatgaaacagtcatccagataattaggaacactgtgcgaggcactttattttcaaaactatgttccatgaaacaaaaataaactataatatactgcgtttctcaaacagaacttctcccttcttccttcctactcccctgctcctctattgaacacctgcagtatattatagtttatttttgtttcatggaacatagttttgaa

SEQ ID NO: 156996 - DNA, 516 bp, Homo sapiens
cactttatgtctcgatcgttatcagatactcagcaagcacttatgggtgtacgtgaaacagagcctctaaaactcagttagactattgtatcagggaagctatcattgcacagaaaagaatgcaataaatttcaggtcataaatcattcagcatatcttgatagaggagcaaggaaaaagctgaaggggatatcatgtgcttgaaaggacagacagaaggagggaaaggacatttacaagggaaatatgaaatccaccaaatccaagccagccacataacttgccattttctgcacttggaaagctcttcttggttcctcatgtggcaggtgaagggattgaggacttcagatacattcatagaaactgttttcctgagtgctcagtgagaagaaggttaaaaaatcttaatttttcggctcttaaagccaagcttttatttctatgggttgagctctgtcactctacctactttccctggggaagcctgtctgctctctaacgatcgagacatag

SEQ ID NO: 156997 - DNA, 458 bp, Homo sapiens
ggtgtactaaatcaggcttcaaatcgcagccctgcaacttcagagctaccacaggtaacccagaaagggagcatggacagcaccacccactgcctgaggctatgagatggaccagaaacctgtgcttactaccagcctgccttattccagaaggaattcaggaaacacaaagacactcacagtacagcaaaataaagtaaatgtgaatcatgttggctgaggagaaacggaagagtctaagactatgtcataaagtttacctctactctaaactctcattactggcgagccaccaatctgactttaagttctctagcagctaaactgaagaggaaaatgtaatcaggtaaaggtttataagatgcaaacaaaacaggacagccaccacagttgctgagaacacgcgcagctccagctccaggagaaacagggtggccatctcctggggctgccccgca

SEQ ID NO: 156998 - DNA, 238 bp, Homo sapiens
caggaagctgatgcaatatttttgtaataatagtgaaatggaagcattccaaatctattggattaatgcagtaaataagtaaatcttgataccttaataaatgaaatatgtgggttaaaaatgttatgaaaagtatcttttgagagaaatacttatgttattaaatgaaaaaggcagggtaacagtattctgtaacaatatcataattcactattttaaaaaatcacaggaataccca

SEQ ID NO: 156999 - DNA, 539 bp, Homo sapiens
atcaatctcataatgttttaagtaagtttacaaatttgggttgcacaagcttgcattagtgacttcccaaatttctatttccagttggacctttctcttcaactcccgtctctataaccccacttgaacaggcatctcaaacctgactaaaactggctccacctaccttcacactcagtcttctccatctcagtacactgtttaactaaagccttccaatagctcaggccaaaggccacagggtcgtgcttcaccctttctctcataagcacatccaaaccataagcaaatcctatcagcaatactcagaatacgacggcttcttactgcctctcttactacccacctggtctaagccaccattctctctggcttcaattactgcatcaacctaacaggtctccctgcttccatccttgcccttacagtcaacctgaacacagcagccagagtgatcctttaaaaaccttaagccagatcccctcattcctctgctcaaaaccctccaaacacctcccttctcacaaaggggaaaagca

SEQ ID NO: 157000 - DNA, 440 bp, Homo sapiens
tcgctgtgctctccatgtagaagttctcttccccagatattcacattactcatcccctcacttccttcagggctttctcaaatgttaccttatctgcgaggccttcttgagtacatgctgcccaatactccctattctcctcaccttgactcttctccagagctctttccaccacaggaaggagaaactgtctggcttcccttatgagacggaaaggtccacaagggcaggactttgttctgtcacctgatacggtcctaccgtctagaagaatggctggcacataataggaatttaatgtttgttgaataaagtgctttagtgtgggaaatgacgccttactgatgtacacacactttttagttttccctcccaacttgaataatcaaggaacgcccaacagaagaagcaaaggcagaaaatgaccattttccttcaag

SEQ ID NO: 157001 - DNA, 494 bp, Homo sapiens
catctgttctttgttcctcttgtttattagttctttctcttttggcattccatttctccagccctgacaacatcactgtattatccatatctatcatagtggatttttctttttcttgatggatagatgctcacctatatcattttaattcctccttaagaactttctctaacttctcttattacctaaatttgctggtgacaaattcagcttttgtttttctggaaagtctttatttctccttaattttaaataatatttactctggaaatagaattataggttgacagtctttcttttagcactttaaagttgtgggtccactgtttttttcttttttggctaattgctgatgagaaatccatgcctattcattcttatatttctgcctctgtgcttaaggttctcctcctacactttggggcctcaatatggttttctttatctttcttgagttttattaagcatcttcaaattgtgggtttattgctctt

SEQ ID NO: 157002 - DNA, 491 bp, Homo sapiens
  misc_feature (477)..(477): n is a, c, g, or t
gttgctgcggtgactctagtaggatccccttgtctgctttggactacagtcctgtgcaggcggggtggggtaggggggtgcctcctccttcctgctttgcttctggacctgcatgctgctctctctggctggtcaacacctgcttgtccagaagcctcagctgaagtgtcagttcctctgggaagccttccctccgcggagacttagaacttgtccctctctcccctgggactcttcacacagctttctagtccaaaggcaggacaagcttgtcctgcctttggactaccttttacttccttagtacctcattacatcttccatagtcactgaattttattctttgtcattgcggcttatttaaatactgactgtattggaaaaattaaaattatggtatccttaataaaataacattgaagagggtatagatgtctgcactgggaatattctttgtgtgtgaacaaaattcaactntgttatagtccaag

SEQ ID NO: 157003 - DNA, 394 bp, Homo sapiens
agcagccttgaaagatgccagtgcacaggagggtatttttaacaagttagcagaggttttctctcctccccctcaaacaacctgtggacctggatacatcacccggggaagagagggtggagtggatggcgccctgcccgtatcccctccacattcacctcccctagcaaaagacacctgtaactttttactgcaggcacctgcaattccctatctgagggcttttttggccacaggacatgaaaggacccacaacctatgggagttgatggagagatgccccagcttccttgacctacagatggggatagcacgactctgaggtgtgttccatgcagcctcccagagctggagttccaggcacccatgggggtgacctggtccttagccaccc

SEQ ID NO: 157004 - DNA, 665 bp, Homo sapiens
ggcggggctggaatttgtctcatgactcatgattgccagacaccagagccgtttctgtgtttaaacttggtcccccaagccctgtctggttctcatagctgacaaataatatttaatgccttattctttgccagctggaattacaaaacactgctcaatttccatcatagacagcgagaggctgtgtggtatagtggctgtgagtgtgggttctggagccagtcaggtcagattttactatttgagtgactctggacaagtttttaacctctataatgcttcaacttttctcatctgtaaatgggcataataattgtccctgctgagtgtggtggctcatacttataaccccagcaatttgggaggctgaggtggaaggattgcttgagcccaggagttcgagaccagcctgggcaacatagggagaccccgtctgtaccaaaaatagaaaaaaaattagctgggcttggtggcacacgcctgtggtcccagctacttgggaggctgaggctggaggattgtgtgagctcaggaagtcaagaattcagtgagctgtgttcgcactactgcactccagtctgagcgacagatcaagaccctgtctcaaaaaaaaagaaaaaatgcggccggtttagctcacttgcccatttcggcctatcggggtg

SEQ ID NO: 157005 - DNA, 537 bp, Homo sapiens
ggcggggctggaatttgtctcatgactcatgattgccagacaccagagccgtttctgtgtttaaacttggtcccccaagccctgtctggttctcatagctgacaaataatatttaatgccttattctttgccagctggaattacaaaacactgctcaatttccatcatagacagcgagaggctgtgtggtatagtggctgtgagtgtgggttctggagccagtcaggtcagattttactatttgagtgactctggacaagtttttaacctctataatgcttcaacttttctcatctgtaaatgggcataataattgtccctgctgagtgtggtggctcatacttataacctcagcctcccaaggtgctggcgttacaggcatgagccgtagcacccagccaacattttactctttatacgtgtgttcagctacaaaactttcttccctaccaaccctcccaagtctaagtaaaattgatctcggagtcacttgacctatttatctggtattatcctggtacgctgctagaggtatat

SEQ ID NO: 157006 - DNA, 2958 bp, Homo sapiens
attcaccaccctgaacaggttggatcggcatgaacagatctgcatgaggtcaagccacatgcccattcctggaggaaaccaacgctttttagaaaactatcctaccattggacaaaatggaggttcattcacaggtccagaacctttattatctgaaaataggattggtgaattttccagtaccggaagtactttgccagacacggaccacatggttaaatttgttaatgggcaaatgctctacagttgcgttgtgtgcaaacgtagttatgtgaccttatctagcctccgaagacatgcaaatgttcactcctggagaagaacatatccttgccattactgcaacaaagtatttgcattggctgagtacaggacaaggcatgaaatttggcatacgggagaaagacgatatcagtgcattttctgtcttgaaactttcatgacctactatatactcaaaaatcatcagaagtctttccatgccatcgatcatagactttccatcagtaaaaaaacagcaaatggaggcttgaagcctagtgtctatccgtataaactttataggctactgcctatgaaatgcaagagagccccttataagagctaccgaaattcttcctatgaaaatgcacgagaaaacagtcaaatgaatgagtctgcacctggtacctatgttgttcagaatccacacagctctgaattaccaacgctgaatttccaagatactgtaaacaccctgaccaacagtccagccatcccattggaaacatctgcatgtcaggacatacccacttctgccaatgtacaaaatgcagagggtaccaaatggggagaggaggcattgaaaatggatcttgacaataacttttattcaactgaggtgtcagtttcttccactgaaaatgctgtcagttctgacctccgggcaggggatgtacctgttttatctttgagtaatagcagtgagaatgccgcctctgtgatcagctacagtggctctgcaccctcggtcattgtacacagcagccagttttcatcggtgatcatgcacagcaatgccattgctgccatgaccagcagcaaccacagagccttttcagacccagctgtcagtcagtccctgaaagatgacagtaagcccgagccagataaagtgggtaggtttgcaagcagacccaaaagcattaaggagaaaaagaaaactacatcacataccaggggagaaataccggaggagtcaaactatgttgctgatcctggaggatcactgagcaaaaccacaaatattgctgaagaaaccagcaaaattgaaacctacattgcaaaacctgctctgccgggaacctccacaaatagtaatgttgcacccctttgccaaataacagtgaaaattggaaacgaagccattgtgaaaaggcacattctaggatctaaattgttttataaaagagggagaagacccaagtatcagatgcaggaggagcctttgccacaggggaatgacccagaacccagtggagacagcccactcgggctttgccaatccgagtgcatggagatgagtgaagtgttcgatgacgcaagtgaccaggattccactgacaaaccgtggcgcccttactacaactacaaacccaaaaagaaatccagacagttgaaaaaaatgaggaaagtcaactggaggaaggagcacggaaacaggagcccgagccataaatgtaaatacccagcagaactggattgcgccgtggggaaggctcctcaggataaaccctttgaggaagaagaaactaaagagatgcccaagctgcagtgtgaactctgtgatggagacaaagcagtgggggctggaaaccaaggaaggccccaccgacatcttacttctcggccatatgcctgcgagctctgcgccaagcagttccagagcccttccacactcaaaatgcacatgagatgtcacaccggggagaagccataccagtgcaagacctgcggacggtgcttttcggtgcaaggaaacttacagaaacatgaacgcatccacctgggcttgaaggagttcgtctgtcagtattgcaacaaggcattcaccttgaatgagaccctcaaaatccatgaaagaatccatactggagaaaagcgttaccactgtcagttctgctttcagagatttttgtatctctccaccaaaaggaatcacgagcagaggcatattcgggagcataatgggaagggctatgcctgcttccagtgccccaaaatttgcaaaacagctgctgcccttggaatgcaccaaaagaaacacttattcaaaagcccaagtcagcaggagaaaataggtgacgtgtgccacgaaaactcaaatcccttggagaatcaacatttcattggttcagaagacaatgaccaaaaggataacatacaaaccggtgtggaaaatgttgtcctttgagtggcaagaattagaaaaatcttcaaaaatatagttggtggtttttttagttatgatttaagtttagtttcattttgtccatgtgacagtcatgaaggagtgaaattaaaaaaaaaaaaactcatttgtgaaaattccagaaaaaggatcctaatatctactttgggttttagcattaactttatgcaaagtgcacaaaaacaaaatagctgactcctccaatatcccaagtttcttgtgaaagttaataaaattcttagctgtggtatttctaccagtgaaaaaaggagtttaattttagcctagtttaaaactttctaataattgctaataagaactggctgctgaactgtctttagtcactggagaaaataagggtcagatatcctgaagatggcatcttcgtaaatatgttacgtggtaataagctgtgtgacggtctttattcccatctggcttctgcactattaaaatttgtttaaattaatggatacacatgaaatact

SEQ ID NO: 157007 - DNA, 437 bp, Homo sapiens
  misc_feature (368)..(368): n is a, c, g, or t
actgcgggatgggcagtgagccaggatcttagagaccacaagagcaggctcaccttagctgaagctcaaaggatgagctccttcatcccaaaggtgggctctggggcagagcaatccctgagggttaactctttatgtgccacccacatgctgcactctcatttccagtcactttccctatgagaacacactgggtgggaatcacctaccagaggggtgggtggcattgtccacaagcatctctctctagactatacacacaacctgttcaaaaccatcaacaatcttgcctgcccttctcctctgcagctggcatttccaagcaaagtctcagatgtgctctttgatactagtaacagaacagaatntaaaagagcagtaagaaacagaaggggctctctaagaagaggctagtgaatactaactgagcaggtcac

SEQ ID NO: 157008 - DNA, 631 bp, Homo sapiens
agggaggggaggaggcaacacctcctgcttcacagagaagaagagagaggaagtggggagggacaggtggggaaggaggaggggaaacaggaagaagggattcggccctttccccaggtgggctctgggagaggggcaaaatcgaccctttttcaagtccactggctactcccgagaaagaactcagcacttgggtgaggagaccttctgaggtctctttgtgcctttagacctcagcttcctcatctgagatacgggcccaaattccttttcctgccacttcacataggactggaaagctgggacaaaggacagccatgaaccgctgatggactcacccagggacgttcagttcaataaacttctgaagcagaataggttcccacagagcaggccagagtgaaaggggcctgcatgaaaagttttgattcaagggccttctatttgcaagaaaggaaattacatatgaagttcccaggtttctcggagactttcatttccctctcattttccttctcgttaatagtggaagaatttatttagaggtgtagaagagtccctttggggccatacaatcatagcatttgaaagcaacctcagaattggtgtttttttccctggtaatcttcct

SEQ ID NO: 157009 - DNA, 331 bp, Homo sapiens
gttcattttcacagattcctagggcaccctgcaaaagacattcctggggagatggggccgacagggctccaaccctaatctgacaaagggtccattgtgactactgatgcacaggtgcctgtgtcagggcaagtgaaaggaaaaggcacatcagaacagagaaccctctaacctgggaaatctgatctgaaagggtagcaaaaaagaatgtgattgtgactcccatgttaaatacaaaagactcttagcagttgccctgtgttccaagccactatttttgaccaagatcaaatcaatagcctgtaacccacatacttcatgttgaattcaa

SEQ ID NO: 157010 - DNA, 712 bp, Homo sapiens
ttaatattgtggcattgacatcacaattttaaataaggaccaaagggaaattttaaaatctattttaaaatatcattatacagtttatgtaatggtggctttttaaatggcttattaaaattggttgatatgattgtttttctcaaactaaattatacacttttttgttttacaatatttcttactgatctaggaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccaggttagctctctagtcggccagccaaaatgttggcatgttttgcccctctattcaaattaaccttgaaatatatttgaggattctctcttgttttaattaacacttgtgttggtaattaatagaaattcacctgtcttccgtatcagatttctgtataagcagttatgctctggagctctgccaagccaatgattagtacagattcagtcctagatacataaaagattttagctggggaaggctgggcgtggtggctcacgcctgtaatcccagcactttgggaggccaagacgggcggatcacgaggtcagcagatagagaccatcctggctaacacggtgaa

SEQ ID NO: 157011 - DNA, 523 bp, Homo sapiens
aaaatatgcccccaaagggggttgattaagtatagtacattcatgtaataaaaggcaatcatccctcagtgcctgtggggaattggttccaggacccctgtggatcctgggctcctctgatgcttatataaatgatgtaacatttgcatatataaaatgatgcggtatttgcatataacctatgcacatcctcctgtatactttaaatcatctgtagattacttataacacctgatacaatgcctacacatcactgcatttgcatagacttaatgaagtagttggtgtacagcaaggtcaagttttgctttttggaattttgtagaatttttttttttcctgaatatttctgatccttgtttggttaaatccatgaatgtagaattcatggatgcaaaacccatggatatggagggctcactgtattataacaactttacagaattatgttgtagaagaatctttaaataacatattgaattacttgtattaaattgttaggttaataaaagtagctttcata

SEQ ID NO: 157012 - DNA, 574 bp, Homo sapiens
cgtaccacgcacttcacatgcactatataatttaatcttctcagtaagttcagttaccgagcctgcacttgttggaaaatgggattcaaaccctgaatgttggctccacaacctgcacttttaactgtcaatcatattaagattaaatttaactgtcaggaaaatagaaaaatgcatcaaactagcaacctacagatacctgtaacacactactgggtcccaagtagtagtctaagatttaggtgaggagcagtttatgtccaagacaatctaacaccaagacaatggtgtaaaatatagaatgtcagtgagtcaatggttacattaattacaaagtttatgtgtcacttaatttggtttttcttccccattcaaatgaatcatcagattttggcatcctaggaacaggataaacgtggtcatattaattctcaggtaaggaggcctgcctagacatgacataaaagcaaatacagtgataacatgatctcagtgaagctatgactaaaaaagtctcaaatagaaacttcatggaatgagaaatggctctaccacgtccaatactagccagctt

SEQ ID NO: 157013 - DNA, 311 bp, Homo sapiens
aaggacaattccatatggtggttttctttttagactataaatgaaatgtattatttcactgaaccacaggtatgacactaggtcagacaatagtactggaacaaaaaaacacattgtcacctattgcaatggaaggtggctggttgtctactgggtataccgtgatgttgagatcatacactggaaaggacgcatgaagtggaacagatggattgggtccattgtagcaacagccattcacaaaagggccagcctctccatccgaaaccaccaatgtaatggtgtcaaaacaaggcatcaggccaatctcg

SEQ ID NO: 157014 - DNA, 351 bp, Homo sapiens
agatggatagacagacagatgagaggggatttattaagggaataataaatctcactccatcatagaagctaagtcccatgatagccatgtcttagtctttttttctgaatacctgagactgggtaatttataaagaaaataaatttattatagttctggaggctgtgaagtcccaggtcaaggggctgcatctggttggcctctggggagggctttgtgctgtgccataatgtggtagaaggcatccaggacagtagggctcacaagagagagccaacctggtttttataagagactcactcttgtgataagtcgttaacccatgaatgcatcaatgaattaatgagttat

SEQ ID NO: 157015 - DNA, 369 bp, Homo sapiens
gtcctgccgtttctcaagtgactcagcctcccggagtaagcagcaccgtgagcagggagaagccagagagcgatgttgccacaggacattcgacaagctgtcaaaatgcgggtctgggactcgaggggaggaggggtggagagcattgagaggacgtgagcacgtgcgagagtgcgtgtgtgtgtgtgggggtgtgtgcatgtgtgagtgtgtgcaagagtgcgtgtgtgggagaggtgtacatgtgtgagtgtgtgcaagtgtgcatgatgtgtggtggggggttgcgagactgcatgtgcatgtgtggggtttgcatgggggctgtgtgagtgcatgtgcgtgatgtgtggggtgtgtatgtgtttg

SEQ ID NO: 157016 - DNA, 463 bp, Homo sapiens
tgtatttcacttctataagtcaagaacagtttagttcctagtgaactataaggaaatttaaaaattgaggttggtggacttgagcttttcgaaggctgctttgtcccttatctaattcattccttccccttgggagccaatccttgagatgcctcagagctcagctacagtggtgatgtttaggccgcagtagattcccctttactcctattgccatagactgtcctgcatcccaccagatcctccaggccctggtgcccttatagtctcagggaacttggggacattgacccctcccagagcttttgcgaagaaatttagtgctcctctttttcacgggttacagggttccctcagtcattaaaacacgtttctcttccctttaaccgataggtgccctgggctttttgtttctgtgtctgcagaccagtgtcaatcagatttttccaggtgtccttctaca

SEQ ID NO: 157017 - DNA, 331 bp, Homo sapiens
tttggggccttgcctccactagaccagcctccatttttctacctgtaaagtggggaatcagccttgcacccgggggcggctgtgaggacgaagtgaggcctggctaagaaccctacagtcctgccccttccagaacccgccccacagctttggattggcagccccatcaggggccatgacctcctgaggggggctgcctggaggaggtgctattgagaagtcactgtggggccgggcgcggtggctcacaagccgtaatcttaagccctttgggaggccgaggcgggcggatcacctgaggtcaggagttcgagaccagcctggccagcat

SEQ ID NO: 157018 - DNA, 190 bp, Homo sapiens
tcgagtggggagacagatgattgcaatagaatgtgctaagttcatggctggtggggtggggaatgctttcccattagagggaacagtgtgtgcaaaggccaggaacgcacagctcaagacattttagtgggaagttaagggttccaaactcccctcgattgactgctatgtgacgtgtgcttgacctatc

SEQ ID NO: 157019 - DNA, 268 bp, Homo sapiens
gagtcctcaccaccccctctctgagtccacttagggagactcaggttgccagggtctcagggtcagagtcttggaggcatcttggaggtcaggaaagaaagctggtgagagggacccttcgaaagggaacgcagcctgtcctccccaagtccggccacagatgtcggcagctggggggctccttcgggtggtctggggtgacctctctccgcttcacccagagcactctcaggggctgtcgtgatgattgcctggtgggactctgtcc

SEQ ID NO: 157020 - DNA, 331 bp, Homo sapiens
gggcaacctgtatcttagctactcagaaggctaaggtgggaggacagcttgagccaaaaaggtatagctgcagcaatatgagtcttaaagccccattaagaacttcagtgattttcatcatttttcagagcagcaagctgtcacattatttgagcacaagtaaacaatttgggtaaagtatttatttaaactagacagaatgaactactaaaggagggtccccccgtgtgcctatactctatttcattcactctttcttgcctgtcatttaactcaagttgatcagctctccttcccttttagggggcaatcggggtggatggtacaactc

SEQ ID NO: 157021 - DNA, 218 bp, Homo sapiens
cctgaagaccatatggttaggcattcctactgaacattaaactcataaaactatattctctttataagacaaattgtacatttacatcccttttatctcatctcctacccacactccaccatcccttttatagtctctagaatttcaattccaggctctgaaattttattttcctagtccttttaagacaactttactaggctatcggacattacttg

SEQ ID NO: 157022 - DNA, 1232 bp, Homo sapiens
  misc_feature (289)..(289): n is a, c, g, or t
  misc_feature (353)..(353): n is a, c, g, or t
  misc_feature (384)..(384): n is a, c, g, or t
gcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggcaatggatcacttggagtcctttattgctgaatgtgatcggagaactgagctcgccaagaagcggctggcagaaacacaggaggaaatcagtgcggaagtttctgcaaaggcagaaaagacatgagttaatgaagaaatagganactccttgctaaagccgaacagctaggggctgaaggtaatgtggatgaatcccagaagattctnatggaagtggaaaaagttcgtgcgaagaaanaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagtaactactctgactccttcggtagctgcaaccaggagtgagcccttctctgtgttcccagggtctgctgagggccgtgtctggtggggatggggctgggctcaccctcaggagtagggctggggagtcgtgaacgggactcaggtgtgggaagaggcgagagggctgtggaggagctcgcacggcgccaggtgatgggctgcacaggcactgtcccctgcctgcgtcctggggcctgtgcactgttgcgtccatgctcagagtggctgagacttgtgtcctgaccaggccctgcttacctctgttttggtttttgtttttgatatttttttttccattgtgtttttacgtagtgtcatgttctgtgcatat

SEQ ID NO: 157023 - DNA, 721 bp, Homo sapiens
ggagacctcattggaaggacctagccattggagatgaactgatggaaatattttaaacctaaatttgtgggagtaaaggagaaaatgtcagtaaagcagcaagcagaatctgctgaggggtggggccctcatagtgttggcacctatagagtctcagccttggagccttctgattgttcaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagtaactactctgactccttcggtagctgcaaccaggagtgagcccttctctgtgttcccagggtctgctgagggccgtgtctggtggggatggggctgggctcaccctcaggagtagggctggggagtcgtgaacgggactcaggtgtgggaagaggcgagagggctgtggaggagctcgcacggcgccaggtgatgggctgcacaggcactgtcccctgcctgcgtcctggggcctgtgcactgttgcgtccatgctcagagtggctgagacttgtgtcctgaccaggccctgcttacctctgttttggtttttgtttttgatatttttttttccattgtgtttttacgtagtgtcatgttctgtgcatat

SEQ ID NO: 157024 - DNA, 858 bp, Homo sapiens
  misc_feature (289)..(289): n is a, c, g, or t
  misc_feature (353)..(353): n is a, c, g, or t
  misc_feature (384)..(384): n is a, c, g, or t
gcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggcaatggatcacttggagtcctttattgctgaatgtgatcggagaactgagctcgccaagaagcggctggcagaaacacaggaggaaatcagtgcggaagtttctgcaaaggcagaaaagacatgagttaatgaagaaatagganactccttgctaaagccgaacagctaggggctgaaggtaatgtggatgaatcccagaagattctnatggaagtggaaaaagttcgtgcgaagaaanaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcacagaaccaggagatcgcaggagggaatcatcatctatggaaacatccatcgaaaccaaaaagcactgaaaacttctccgcaccgagggaattactgccattgagaaaccgggaagtctattttacgatatggtgctgcctggatccccttctctcaaagaaaaaaacggtgggagcacccggaaac

SEQ ID NO: 157025 - DNA, 500 bp, Homo sapiens
tatattcaattctcgttatttgtggtagttatgttttataacgttgctgtgagtgctgcattagcagatattgaaccactgctcctaggggaaatgtaagattagggtcctgagagcctctggtcacaccaaatcactcaccttttttttttttcctttgagatggacccaagctggagtgcaatggtgcgatcttggctcactgcaacctctgcctctggacctcgggtgatctgcccgcctcagcctcctggccagggtgcggggataacaggcatgagccaccgcaccgggccagaaagggattaaacgcaactattatacttatcctcaatgcagtagaggagaaatatctcggcaaagaggggaaatctcagaaaagaagtagaaaggattttaaaggggccaatgggaagtcctagaattaaaaattacggggatttaaaaaaaaattcgttaaggggaattacccaggaagggactaggggattggacagagg

SEQ ID NO: 157026 - DNA, 343 bp, Homo sapiens
ggcacgtagtaacacagatagagaccatccttgttgtgttgtaaatttcatctggcagaagatcaaaaatgaaaagtacacatcgtagtgaactatatgatatgtgaaaatggttatgaatagggttacatgaaagagactagtacaagatgagggatgtgagaagaggaaggcgtgcttgcgtaaaggggagggctgagggaatcctggaagtagagagcgagaggctgccctagagagccagtcccccacaaagctcatgaaaagcagggaaaagaaaaataaaaataaataaattttaaaaagagccggtctgccacccttgaatcccttggtgcccaag

SEQ ID NO: 157027 - DNA, 330 bp, Homo sapiens
gttcaagcaattctcctgccccagcttcctgagtagctgggattacagtacagcctcaaatttaaggagggactcactcacaggattgtgcaaatgcaaagttggcttttgcatgaccctgggagtaggtgcctccttaaattttgcaccctcagcaactccatcacctgtcactttgctagtcccaaccctgatgggaacaaatgcagggaaggcattccagatggcgggaacagcaagtacaaaaatccagaggccagaaaggcctggtgtgtttcaggaacagaaactcggctcccatgactgaaatggagtagggaaatcctaatg

SEQ ID NO: 157028 - DNA, 263 bp, Homo sapiens
aaaactcctgtgcacattaataaatttgtacgtcttttcttttattaatctgcttttgagagttgatttttcagtgaatcttcagagggcaaaggggatgctttcccttggcccctacaaaccctactggaccaaatcaaaatgcctctgggaaaacactgcttctctgcactatactcacacagcacactcctgataccagatgtgtgaggaatgcccccccaaacccaaaccaagcaaatcttcagcaggcaccagctggg

SEQ ID NO: 157029 - DNA, 532 bp, Homo sapiens
tgggttcaactgatcctcccactttagcctcccaaaaagctgagaccacaggcatgtgccactatgttgcccaggctggtctctaactcctggactcaagccatcttcctgctttggcctcctaaagtgcagggattataggtgagcccctgtgccaggcccatttacttattttttatttatttatttttttgagacagtcttgctctgttgccaggctggagtgcagtgcagtggcatgatctcagctcactgcaacctctgcctcctgggttcaagcgatttccctgcctcagcctctcgagaagatgggactacaggcacccaccactataccgggttaattttttgtattttagtagacatggggtttcaccaagttggccaggatggtctcgatcttccgacctcgtgatccgcccacctcagcctcccaaagtgctagcattacaggcgtgagccacggcacacagccccatttacctatcaagaaggttgagtgtgcaaatactagtaagctctgtgtcaaacg

SEQ ID NO: 157030 - DNA, 293 bp, Homo sapiens
aagctgagaaaaatgacttcattgtgtggctttgtacaagattgtaaatgtactttatctaatttgtaagtggctccgaacctctccctcaagccataaggaaatgctatgtgggcttccagtagagaaggaagagagaagagtcttgggaggataatctaacctgagaccctcataccataatactcttgtgatggaaatagagaggaaatggtcacatgctcatcgtcctgaaggcacccattttaaaataacacagggacacccccacacccgtcaccacactcacatgg

SEQ ID NO: 157031 - DNA, 378 bp, Homo sapiens
ggggcccttgccaaggacttggcctcttctgcccagaatttccctgccttctgtccatatcactgggatgaagaatccaaggtaggaaactaatctctattttctggttttaatcagtagaattcatttctcgatagaaaatgtgtgtaattccagttctacctcttttctcttaaatattttttcttttaatattgttcacattttatgtactaattaaagaaccagacattgcaaacatgacacattgattttttccacaataatgtttgtgagtaacatatggaattgctaactaacaaagttatggtttggtttgtctgtctgcttctccattcgggcctctggcacagcctcctaactggcctccccgcctcc

SEQ ID NO: 157032 - DNA, 442 bp, Homo sapiens
tcgaggatctcggtgttcctttgtctgataatcatgaatgtgctgcatgaacctgtctccccaggacaagtcagtagtttcagacacagacttactctcctctcacaaatctaactctaatattctgacaatctatatgacattctggtaaaaagctacaattacaattacttaatttaagctggttgtctaaggttcaaattaattggcctctgcctatctaacgtacatttggtttttggtgttggtttagtttaattgagatggagtcttgttctgtcgcccaggctggagtgcagtggtgcgattgtcgctcactgcagactctacctcctggtttcaagcaattctcctgcctcaggctcccaagtagctgggattacaggtgcgtgccaccacgcctggctaatttttttgtatttctattagagacagagtttca

SEQ ID NO: 157033 - DNA, 408 bp, Homo sapiens
gcagggagctaagttgcattttcctctcagccgaggatctggtgataagttgggtggaggaggattgtgagttaggtgagttattcgtgcagacgcgctgtgtcctgaaccatgaggaaaggcagacatagccaatctgcgaattctttttgcttccccggctccccccagcctgacttctcttccctaattaggactccacacctgtattttttgttttcatcgtgtgacaaacacccatggacctgccacctgacacaagagccagctcggtcctctcacgtctcacaggtgaccacgatgcttatcccctgcctccttccgcctgggtaaccgtcagcccaaattccgcgctcatcatcccttgctgtccttttaaaataactatctggtatctatacaaatctg

SEQ ID NO: 157034 - DNA, 210 bp, Homo sapiens
attacattgaatctatagaccaatttgagtaatatatatatattttttccttgcaatattaagtattccaatccatgaacatgggatatctttccatttatttgtgtcttctgtaatttcttgcatccatgtatcatagttgtcagtgttcagatctttcacttccttggttaaatttaatttaatctttttgatggtattgtaaatgcg

SEQ ID NO: 157035 - DNA, 750 bp, Homo sapiens
ttggggaggctggcacctccctgtgctgaggccttgttgttcttggggagggcaggtagtgagtgggtcatggggcaccccgagctcatgatcactaaaccaggccatcttctggctttcctcaggggtctccatagccacccagggccaaaattttgaagctgcaaaggtgactctgtgatgcgggttgaggggagaaaggagagaaggcaagtccgttcctgcctcccaccgcagaagctgggcctttagtacttgttacacagccggttgaacctgacagcagagctgggggctgggtagctggtggggagcagaggcccattctctggatcgctactctggtctactgtgtgctggcccctggctatggagataaaccaagagttgctctctgtcctcgggcagctcagtatgggcgggtaggcaggcacggatctgtaattacacaatagttcctgtagctgacccttctggggttttggaggggttagaaaaatgaattagatgggatccagggatttcttctagcttgctgagagagagatgtttgtttagccagcaaaagtttgcggaggacctactacgttctaggcaggcattaaggctatagcagggaccaacaaaaccaagtcccaaactcaatggaactcacatctagtaacaggagatacaacaggtgaagacataagaaaataatttcagacagcgagaaaggttatgaagaaaataaagtgatgtgaaggagag

SEQ ID NO: 157036 - DNA, 357 bp, Homo sapiens
cctgccaggtttattgaccctgcaattcaccagctacctcctcctgtcgccatggcaacacccacacccaagcagctccagaattcacctttggatatccagaattcacctttggatatccacaatccaccgaatttgcacctacgcagttcaaataaaccaacaaaagatatccccacccgctaaactgagacaaccacgaccttttccatttccccgatctctaattcatccacggaacatgtctttaatttttcacccatatccactgaagggagggtgagtcctaaacaacgaccacttttgatacagtaagaggttttttcctttcctccccctcccccactctttttttgc

SEQ ID NO: 157037 - DNA, 511 bp, Homo sapiens
attgcaacttaaatgatagtattataaggtactttttagtgttcattatttcagtagtggtgataaaacctttttttattctgcaaaattatgctggtgaaattgtatgtatctgcatgtgtctgtctgtgatttctaccatagtaaaatgaaacttcagttttgagccagaactgagaactcttggttcttaggtctagcccaagagaagacaaaagggaagagaagggagaggctacctttcctgacagcttcatggagttttcattttttgtgtgtcccctccccacgccgtacacacacatattcccattacacttctgttgatcagttagatcagttagtggctgctctgtttttccctgcaaaaggaatttttcaatttgattttccatcccgatttcccagtgggccttcatgaagcagtcaagacattttcagtatgttctttccctccaacagatgtgaatccagccatattgagcatatgctgtgtttctagggctgtaca

SEQ ID NO: 157038 - DNA, 257 bp, Homo sapiens
actcacagctcattttattctgtttaatcggctctctgcttccccagttaagaaatagaggcaaaactgctcttaggtcacacggtcatgaagtgaggtcttaacctccaggctccttccaggccacaggcctgccccaatctctcctccccttctctgcagaaagaagtccagtctctcagaacagacgaatgctgtgacaaaacataggtggaaagcagctctgcgatgacagggatcaccctgggaaccagtaa

SEQ ID NO: 157039 - DNA, 486 bp, Homo sapiens
tcttagttactggactaaacacagggaagcgattcattcttccctgaggaaataagcatttcttacatacatctatcttggcacaaaaagggctggctaagcaaattaatagtgtaaacaggactgcacgggggaatgtttgtcctacttaggagaataaactttttatgcactttgtgcatatccacttacatacaaataattgatatgctaattacaaatgattcttaaagccccttccctgaggtgctgtactatgctgttagtctagtttgaattactagcatgtccagtgcttgaaagtaataaaaatgcatttaaaaatatcccatgattcagactggctttcctctaattaggctgagttagtgaggcttgcctgtatttaaataggatagatatttttccacttcacccctaacacgtttaagatggtctccctcccctctctattcctccatccccctcaacacggagctggcgcac

SEQ ID NO: 157040 - DNA, 377 bp, Homo sapiens
ccacgtcttatggactgcttctgttcccttcctcctcttactcaccttgtttctgcaccctcaagcctttctccaatgcctcccaggaggatttggggactttctccctggggcgcccagatccagctcggaggcctcactgggacctggcaaggcctccgagctggatctgggcgccccaggaaaagatgggtcagatggacagttaattagctttttgtcttctgggtttactgatgtcctcccactgagtggtaagtttctgggtatttcagaattttggaatgaaaactttggtgatgtgcccaggacgggtaaggcagctagctctcacagacacaccccacagtgaacatcacacacacacacacacaccc

SEQ ID NO: 157041 - DNA, 321 bp, Homo sapiens
agtccctactgtgtgccagcccatagggtgtgctgtgtgccacaggtgaatgcattcacttcccagtggacatttaacaaccacctactgtgtgcagactcatggagatgcagaaatgcaaatggcacagtccgtagtggtttggacacttgtggtgttttgatggggtctttagtcctggctctctctctgcttgctgtgatatacccagtcagccactgttcacaggccacgtggtgacgtccccagaatgaaccagaaacaatccagatgccccaggaaccgacgtgagaacaaggcatccccttcacacgttgtgtc

SEQ ID NO: 157042 - DNA, 351 bp, Homo sapiens
gcttgagagagtaaatcaagagtatcctttcaaccagattgggctagtgccttggtgatgtaatgtaatgttcaaaagggaaattcaagtttctatcttttgtaattggatgagtggtggcatgatttactgagatgggaaataagaaagaaacagattcgttcttactctaaattggtggaattatcagatctctatttccaaggcatattcaagaggcatttaagatgagaggctgaatatgaatttgggactgcaagtttggcatgcaaaggagagatctgggatctggatatattcattttagagttaaaatactgttatttaaagcaaggtcgacgcggccgcgaa

SEQ ID NO: 157043 - DNA, 149 bp, Homo sapiens
tggcacaggtgatgtctggagccccctagggatccccaagatactttcaaggggaatgtgaggtcagaacttttcatagtaatattgattcattatgtgccctttttgcccagccaacagttttctgatgtagatagacagttctgaca

SEQ ID NO: 157044 - DNA, 332 bp, Homo sapiens
caagtcagcagccacaatttctcctactttccatagtccagtctcatagggaaggttgccccatttctgtgtccctcaaatttgaagagtggttcttgccacataactgctatacactttctcaccataccacacctctctccacccacccccaacacctacaacagtaacagtgcttagtagacctatgatgaatatttgcggaatgaatgagatagggccctgccctcacagattttacattctgtttggagaaccagacaataacaaattcagtacacacataggaactcacagtttgtggtaagggctattaagggaagaaacctgcc

SEQ ID NO: 157045 - DNA, 769 bp, Homo sapiens
ctagcaattagtagggactgaataaatgacagcaattattactatgtcccccagccctggtcttataagtgaaatatgtggtttagtaagagacaaagtgatgcaaatccaggtaagttttggcatgggtcagaaataacatttagagtacataaaactgatgttttttttcagtttggagagctatgagtcagggagcagtttaaatctaaactgcaaatttatcccctcttcttcctgggttaagaatcacttccacggtgaatcagagaagggattgtaccactcgtcacgtgtgttgggaaagaagaaagggtgagaaaccctggcctaaacaatccatcccacagatcctcaggcattcctttgtgtacttggtttttcaccactgagctttaaataagaatggaaatacaagggaaaacctgcgttgtaaacatgaggatttgggaacagatctaggacatgccactgaattgaagaccacccatcttccaggcagggccagaattacagaaaacaattctggtaaaatatatttttgtatcactttattaataattctttttaaaattctgtattttctttatagcaagacaagtagaacactaaaccatgaaaattctctatgtgattatgaccatagtgggttttaggccttaaaatattcagatcaggagttaccaattgtttaatataggacatatataaacaatcaaacttattgtaacttaaccttccccaagacacacttgacataaaatgtgcc

SEQ ID NO: 157046 - DNA, 299 bp, Homo sapiens
gatctctgcctaaatgtgatacactgaaatatatcttccacactgctatcctaatttacttaaaatataaatatgaacgtgtcacttccctgactcaaactcttcccatcatgctgctcaggatatcacataatggcccctatgaaattcctgacacctattcccccttcatactctacagtcaggcaacacttcaatagtgtatccgaatacaccaagctctatacacaaacctcatgtatttaagaagtcccctttacttgatacttttatattttatttgcctggctaagtcttcc

SEQ ID NO: 157047 - DNA, 357 bp, Homo sapiens
ttcttgtggaggcaggggctggacttgagggcttcatcaggtggtatccatggctgggacttgagactctgggtctggtgagtgtccataaggacatagactgactgtggaagaatttcttagaattagtgtcatagaatctatattcttttatgtctgacttcttttgctcagcagaatgtttttaagattcatattttatcatattctcatatgtatcagttgttcattcttttttacttctgagcaatgttctattgtatgaaaataccgtttgttagccatttacctgttaatttgggttgtttccagctttaggctattataaataaagctgctatgaaaatgcttatatga

SEQ ID NO: 157048 - DNA, 439 bp, Homo sapiens
gccaagggaggaaatacaggagtcttggaggtgagagatacagcttgtttccgcagagagcaacgtgttcaaaggcctagagtagagggtgagtattttgagaattgggacctaaaagaagcctaatattgatgggacagaaagctaagagacacagacagcatctttctttgccagagtgctaggcagatcttaaaaagctttaaggttatctcaagctcttaagttgtgaggccattaacctaaaggcaaatggaagtcactgaggtttttaagcatgagagaaagatgatcatatgtgacatcaaagatcattctggctttggagacagaatgaacgggagaggaataagaaataaaggcagggaggtgattttaggaggtgatttttagcaggccagtaaaaagataatgatggtctaaattaggatggtggcag

SEQ ID NO: 157049 - DNA, 179 bp, Homo sapiens
ggacactcttgtaccaagccacagtactgcatcaaaatcaggaaattaacattgatgaccatacggccattaaatgtacagattgttcagattttgcagattgtcccaatagtgttctttattaggtgtagtatcagttgtttcatatctctttaatattctttaacctaagaatacta

SEQ ID NO: 157050 - DNA, 498 bp, Homo sapiens
caggcaccccacgaggagccttgagctctgggcttctcctctggctgaccagagccctcaggggccatagagaaagataaaaatgggtcctatgttctggaagtcagggcctgggttggccagagtggatgagtagatgagctaggctaggaaggatgaatcaggtacaagaatccatgttcagtcctgtcacagctctctatcacaagagcctagctttgaaaactactccctgctcattagcaggaaggatgagctccaaagagggtgggctccagagtacagggttgccagtgctgcccagctccatgtcccgtctctgtgtattattctctgagaaagtgatacggctgtacacaggtaaatgtgtcagagaagcaacacataatcattgggaaattgcagaaaggaggaaagggtctcttcttggtatattttactctggtttgtatctgcacgtgattgttcttgcataattataaccacactgtgaacaga

SEQ ID NO: 157051 - DNA, 363 bp, Homo sapiens
agcagagaggaactcatgaaagtggcagaattgaggtgggtcttgaatagggattcaatatttcgatgagtggaagggtattctaggtggaggagggaacagcatgattagaggcaggtgtaaagcctggagcagtctccttttccgaaaggatgatattaaaaatacttaacaattgcaatggtcaggccttaggcaatcagcatgggcacctgtgaacagtggcatggtggatgcgctgtgagggccggtgtggcccactgggtggatatgctgtgaacgctgtcatggcacactgggtggatgtcaaccctgcctgtggggcacatgaagtagcccattttgatacaggagttaagaaga

SEQ ID NO: 157052 - DNA, 404 bp, Homo sapiens
agagcttaggttaaaaaaccaaaaaacaacaacaaaaaagtttgtgatatatacatacaatggaaaattatttagccagaaaaaggaatgaaattttgatacatgcttacaacataaatgaatcttgaatacattctgctaagtgaaataagccagacatttaaaatgacaaatactgtataattccacttatgagatacccaggaaaggtaaatgtatagagacagaaagtagactagaggttcccaggggctgggaggagggaaaatgaggagtcactgttcagtgctatttaatgggtacaagcaggaaaatggcttgaaccccctgagacagaggttgcagtgagccgagatggcgccattgcattccagcctgggtgacagaacgagactccatctaaa

SEQ ID NO: 157053 - DNA, 764 bp, Homo sapiens
ggggtttagaccaagggaggggccctaactccggcgaggagggcgcccacccctcggttcccggagctggtggaggcgtgcgggggagcgtggcggcgcggtgcacaggtggcgggggccgcgccagctgcgcgccgcgctctgctccgcgggtgggccgccaggcgtcgcgctggagccgcggttgccctggagaccaagcggggcgagtgggcggcgcggcgaggagccgagctgcggctggagtagcggggcgtgagttggggggagtggctccccggactgcgcgaggggtcggctagtcctggggcagggctgggtggcacggctggcgagcccggaacgcctctggtcacagctcagcgtccgcggagccgggcggcgctgcagctgcacttggctcgtctgtgggtctgacagtcccagctctgcgcggggaacagcggcccggcgctgggtgtgggaggaccaggctgccccaagagcgcggagactcacgcccgctcctctcctgttgcgaccgggagccgggtaggaggcaggcgcgctccctgcggccccgggatgacttctcagcgttcccctctggcgcctttgctgctcctctctctgcacggtgagtagctccagccctttcttcccggtggggccaggccgggtcggcgggcccggggcgaagctgtttggggacggcaaagagcctccttgctttgccgagggtcgggagtccaactttctcaggggcggcgttcgttgctgcggcc

SEQ ID NO: 157054 - DNA, 567 bp, Homo sapiens
agtggccgtcccgctgttgtaagtggagggacggcagtcagctgaccctgcagtgtgcaggcgagcgcagggagtacgccatgtcctgagaaggggcgattctcaggctctggcagttacagcttctcctcaccctgccgagcaaccaggccacggggctccgtgcatcgccacctagagtgttaccctcttccttgttcacagaggttctccgcagtgtgtgagaaagaggccctctctcagatgaatggataaagaaaatgcaggacatatggggggaggagccaagatggccgaataggaacagctccggtctacagctcccagtgtgagcgacacagaagacaggtgatttctgcatttccatctgaggcaagaagaataaatgtctctggtggaacttttgctctggtggaactgcttttctagaactgttccaagaggaaattgcagaaaccagtctgagtccatcaccaaaggaagtcttgcaagatgaggggcagaagaagtgagcctagaaggatggacttgctgaacttctgtttatcctccaagatgtgattagtc

SEQ ID NO: 157055 - DNA, 1595 bp, Homo sapiens
ggggtttagaccaagggaggggccctaactccggcgaggagggcgcccacccctcggttcccggagctggtggaggcgtgcgggggagcgtggcggcgcggtgcacaggtggcgggggccgcgccagctgcgcgccgcgctctgctccgcgggtgggccgccaggcgtcgcgctggagccgcggttgccctggagaccaagcggggcgagtgggcggcgcggcgaggagccgagctgcggctggagtagcggggcgtgagttggggggagtggctccccggactgcgcgaggggtcggctagtcctggggcagggctgggtggcacggctggcgagcccggaacgcctctggtcacagctcagcgtccgcggagccgggcggcgctgcagctgcacttggctcgtctgtgggtctgacagtcccagctctgcgcggggaacagcggcccggcgctgggtgtgggaggaccaggctgccccaagagcgcggagactcacgcccgctcctctcctgttgcgaccgggagccgggtaggaggcaggcgcgctccctgcggccccgggatgacttctcagcgttcccctctggcgcctttgctgctcctctctctgcacggtgttgcagcatccctggaagtgtcagagagccctgggagtatccaggtggcccggggtcagacagcagtcctgccctgcactttcactaccagcgctgccctcattaacctcaatgtcatttggatggtcactcctctctccaatgccaaccaacctgaacaggtcatcctgtatcagggtggacagatgtttgatggtgccccccggttccacggtagggtaggatttacaggcaccatgccagctaccaatgtctctatcttcattaataacactcagttatcagacactggcacctaccagtgcctggtcaacaaccttccagacatagggggcaggaacattggggtcaccggtctcacagtgttagttcccccttctgccccacactgccaaatccaaggatcccaggatattggcagcgatgtcatcctgctctgtagctcagaggaaggcattcctcgaccaacttacctttgggagaagttagacaaaataccctcaaactacctccaacagctactcaggaccaggtccagggaacagtcaccatccggaacatcagtgccctgtcttcaggtttgtaccagtgcgtggcttctaatgctattggaaccagcacctgtcttctggatctccaggttatttcacgggcattcttttactggagaagcaaaaataaagaggaggaagaagaagaaattcctaatgaaataagctttattcactggatcatgaaggagggaaaggtccagcatgtgcccaactaggaggatacaaatgaagagttctccttatcttccgtgtctccaggagaggatgatcttccacccaagtgttcttctgccaaagcatttcacactgagatttcctcctcggacaacaacacactaacctcttccaatgcctacaacagtcgatactggagcaacaatccaaaagttcatagaaacacagagtcagtcagccacttcagt

SEQ ID NO: 157056 - DNA, 1401 bp, Homo sapiens
agtggccgtcccgctgttgtaagtggagggacggcagtcagctgaccctgcagtgtgcaggcgagcgcagggagtacgccatgtcctgagaaggggcgattctcaggctctggcagttacagcttctcctcaccctgccgagcaaccaggccacggggctccgtgcatcgccacctagagtgttaccctcttccttgttcacagaggttctccgcagtgtgtgagaaagaggccctctctcagatgaatggataaagaaaatgcaggacatatggggggaggagccaagatggccgaataggaacagctccggtctacagctcccagtgtgagcgacacagaagacaggtgatttctgcatttccatctgaggcaagaagaataaatgtctctggtggaacttttgctctggtggaactgcttttctagaactggtgttgcagcatccctggaagtgtcagagagccctgggagtatccaggtggcccggggtcagacagcagtcctgccctgcactttcactaccagcgctgccctcattaacctcaatgtcatttggatggtcactcctctctccaatgccaaccaacctgaacaggtcatcctgtatcagggtggacagatgtttgatggtgccccccggttccacggtagggtaggatttacaggcaccatgccagctaccaatgtctctatcttcattaataacactcagttatcagacactggcacctaccagtgcctggtcaacaaccttccagacatagggggcaggaacattggggtcaccggtctcacagtgttagttcccccttctgccccacactgccaaatccaaggatcccaggatattggcagcgatgtcatcctgctctgtagctcagaggaaggcattcctcgaccaacttacctttgggagaagttagacaaaataccctcaaactacctccaacagctactcaggaccaggtccagggaacagtcaccatccggaacatcagtgccctgtcttcaggtttgtaccagtgcgtggcttctaatgctattggaaccagcacctgtcttctggatctccaggttatttcaccccagcccaggaacattggactaatagctggagccattggcactggtgcagttattatcattttttgcattgcactaattttaggggcattcttttactggagaagcaaaaataaagaggaggaagaagaagaaattcctaatgaaataagagaggatgatcttccacccaagtgttcttctgccaaagcatttcacactgagatttcctcctcggacaacaacacactaacctcttccaatgcctacaacagtcgatactggagcaacaatccaaaagttcatagaaacacagagtcagtcagccacttcagt

SEQ ID NO: 157057 - DNA, 1583 bp, Homo sapiens
ggggtttagaccaagggaggggccctaactccggcgaggagggcgcccacccctcggttcccggagctggtggaggcgtgcgggggagcgtggcggcgcggtgcacaggtggcgggggccgcgccagctgcgcgccgcgctctgctccgcgggtgggccgccaggcgtcgcgctggagccgcggttgccctggagaccaagcggggcgagtgggcggcgcggcgaggagccgagctgcggctggagtagcggggcgtgagttggggggagtggctccccggactgcgcgaggggtcggctagtcctggggcagggctgggtggcacggctggcgagcccggaacgcctctggtcacagctcagcgtccgcggagccgggcggcgctgcagctgcacttggctcgtctgtgggtctgacagtcccagctctgcgcggggaacagcggcccggcgctgggtgtgggaggaccaggctgccccaagagcgcggagactcacgcccgctcctctcctgttgcgaccgggagccgggtaggaggcaggcgcgctccctgcggccccgggatgacttctcagcgttcccctctggcgcctttgctgctcctctctctgcacggtgttgcagcatccctggaagtgtcagagagccctgggagtatccaggtggcccggggtcagacagcagtcctgccctgcactttcactaccagcgctgccctcattaacctcaatgtcatttggatggtcactcctctctccaatgccaaccaacctgaacaggtcatcctgtatcagggtggacagatgtttgatggtgccccccggttccacggtagggtaggatttacaggcaccatgccagctaccaatgtctctatcttcattaataacactcagttatcagacactggcacctaccagtgcctggtcaacaaccttccagacatagggggcaggaacattggggtcaccggtctcacagtgttagttcccccttctgccccacactgccaaatccaaggatcccaggatattggcagcgatgtcatcctgctctgtagctcagaggaaggcattcctcgaccaacttacctttgggagaagttagacaaaataccctcaaactacctccaacagctactcaggaccaggtccagggaacagtcaccatccggaacatcagtgccctgtcttcaggtttgtaccagtgcgtggcttctaatgctattggaaccagcacctgtcttctggatctccaggttatttcaccccagcccaggaacattggactaatagctggagccattggcactggtgcagttattatcattttttgcattgcactaattttaggggcattcttttactggagaagcaaaaataaagaggaggaagaagaagaaattcctaatgaaataagagaggatgatcttccacccaagtgttcttctgccaaagcatttcacactgagatttcctcctcggacaacaacacactaacctcttccaatgcctacaacagtcgatactggagcaacaatccaaaagttcatagaaacacagagtcagtcagccacttcagt

SEQ ID NO: 157058 - DNA, 1377 bp, Homo sapiens
agtggccgtcccgctgttgtaagtggagggacggcagtcagctgaccctgcagtgtgcaggcgagcgcagggagtacgccatgtcctgagaaggggcgattctcaggctctggcagttacagcttctcctcaccctgccgagcaaccaggccacggggctccgtgcatcgccacctagagtgttaccctcttccttgttcacagaggttctccgcagtgtgtgagaaagaggccctctctcagatgaatggataaagaaaatgcaggacatatggggggaggagccaagatggccgaataggaacagctccggtctacagctcccagtgtgagcgacacagaagacaggcaagaagaataaatgtctctggtggaacttttgctctggtggaactgcttttctagaactggtgttgcagcatccctggaagtgtcagagagccctgggagtatccaggtggcccggggtcagacagcagtcctgccctgcactttcactaccagcgctgccctcattaacctcaatgtcatttggatggtcactcctctctccaatgccaaccaacctgaacaggtcatcctgtatcagggtggacagatgtttgatggtgccccccggttccacggtagggtaggatttacaggcaccatgccagctaccaatgtctctatcttcattaataacactcagttatcagacactggcacctaccagtgcctggtcaacaaccttccagacatagggggcaggaacattggggtcaccggtctcacagtgttagttcccccttctgccccacactgccaaatccaaggatcccaggatattggcagcgatgtcatcctgctctgtagctcagaggaaggcattcctcgaccaacttacctttgggagaagttagacaaaataccctcaaactacctccaacagctactcaggaccaggtccagggaacagtcaccatccggaacatcagtgccctgtcttcaggtttgtaccagtgcgtggcttctaatgctattggaaccagcacctgtcttctggatctccaggttatttcaccccagcccaggaacattggactaatagctggagccattggcactggtgcagttattatcattttttgcattgcactaattttaggggcattcttttactggagaagcaaaaataaagaggaggaagaagaagaaattcctaatgaaataagagaggatgatcttccacccaagtgttcttctgccaaagcatttcacactgagatttcctcctcggacaacaacacactaacctcttccaatgcctacaacagtcgatactggagcaacaatccaaaagttcatagaaacacagagtcagtcagccacttcagt

SEQ ID NO: 157059 - DNA, 340 bp, Homo sapiens
ggttggtagaatgatttctggtgttctgtagcaccatagggtgaatatggttaaatacaacttgtgtattttcacaaagctagaagtgaggattttgaatgttcacaacccaacaaaatgataagtttgaggtgatggatatgctagttaccataatttgatcattacatactgtatacacatattagaatattactgcatctcataaatgtctacagttattttatgtcaactaaaaataaaaaggaaaaaagaattctttgcctaaatcaatatcacacagacttcgttttcctctaaaagtgttatgttttatgttagagttttatatttagatcta

SEQ ID NO: 157060 - DNA, 104 bp, Homo sapiens
cttcttgtctttatcgtaagaggtcagatttgtgttttgaaaagattacaggatagagaatgatttacaaaggaacaagggtaagtgctaggagattaatgagt

SEQ ID NO: 157061 - DNA, 320 bp, Homo sapiens
gcttcctagtcatgcttcctgtacagtttgtggaactgtgagtcaattaaatttctttgtatcataaattatgcagtctcagatagttctttatagcaattcaagatcagactaatacacctccccattctccatccttttaaaccttattccaatgtcaacattcactctaacattttttaagattcctacaatgaagaaagtaatgtccttaactttacattaaaaagaaaaacaaactcggaatatagagtttctctgctgttttctatccaggcatggaatagaaattaatgtgcatgagtgttttctctggatgt

SEQ ID NO: 157062 - DNA, 254 bp, Homo sapiens
agcagctccaacaacatggatccatccgacctgtgattccctccgaccccaacctgcttctcccctgccttctccatctttgttaatggcaactctccctggctccagccaaaacctttggagtcatcttggagtgctctcattctcttatactctatgtccaatctatggcgaagcctgtcttccccgtcttccaaatgatttctgaatctggccactccttaccacctccacagctaccataccctccctag

SEQ ID NO: 157063 - DNA, 150 bp, Homo sapiens
tcatagacaaataggtcttaagtatctttaactgcaggctccataaactgaatttacattcccatgatctgtgcctccaaacacccttttatcccctgcttattttagaataagaaatgggaatggaatcaatgtatccatattcataat

SEQ ID NO: 157064 - DNA, 414 bp, Homo sapiens
gaggtttctccctcctccaaagtcagaggtgaccaatccctaaacacattcgtgcaggaagaagaaagagagaaagaaatccctgaacagactcctctggaagagacagaaggatgaaagagagggagagggggaaaaaggagaggagagacggagacaaggaaaaggaagggagagaaacagagggagggagaggaaagaagaggaaggcaagaggaagaaagagaggggaaggggagaggagaaagagggagaaggcagtgaccaaggagggttaagggctcccggagggttaagggctcccggggggttaagggctccctgagggttaagggctcccggagggttaagggctcccggagggttaagggctcccggagggttaagggctcccggagggttaagggctcccgg

SEQ ID NO: 157065 - DNA, 176 bp, Homo sapiens
cgatccccctcctcaggccttgcttagccaccggccccgagaggtcaccgtttccctgcgggccactgggctgatcctgaaggccattccagccagcgacacagaagtttcagggtctagccattgccccctgcctgctgctcctgtcacagaccacacatgtctaaatgcaatca

SEQ ID NO: 157066 - DNA, 384 bp, Homo sapiens
aatatttacaatactgctccaaattcatgaaaaaaaactagatgtaatattatataacataagaaacagtagcaattgctcttctagaagttgctacaatccatcagcaaactgtgtcacacacactaaaagcaaaattctagaacaaaaatactccagtttctgacgagttagaagatgatgattaccctaagccaatatgagttcatagctatgaaaaataccaaaataatttcataggcttcttttcttttggttgctggatactgactcaaggaaaaactgtagatcatccactagcctccaagcattacacacttcaaaatcaccccatctttgagtaccaagatcctgaaccttattccagatcccttgaaacagaat

SEQ ID NO: 157067 - DNA, 377 bp, Homo sapiens
ggagggagatggggagggcgtgtgagctgacgacaccgagggagggagagggggagggcgtgtgagccgacagcactgccggccatgcaagcaggggacctgggaccatgggaagcgaggacattccctcttcctaactgcatgcacgacaactgtgtaagcagcacaagtcaccttacaagattaaatgtgcaaccaccactccactctgccagatagagtaagggcaccggtaagtatcacacaggcagatgagcaaaggtaggcgtggaggccgccgcacagatgtgaagttggcccaggccagcgccccgctggctcatttagggcacaggaaacataggacctggggtgaccaacggctgcaggcaggtctg

SEQ ID NO: 157068 - DNA, 288 bp, Homo sapiens
agagagaggctctctccacccacttcctttgcaatctgcatttctctctgacagtctttcaaatgaagggagcctggctgcttcatttttatggagggttggaagtgcttagtggcaggcacaaaggttcattttacatattgtttatatccttctcaaaagcgtctaggccatacagacaacaaatcctttcaaacaaggggaaaagtacaaaggttgggtgatttctggggagcgtcagggaaggtagtggggggcatcctggctcctcatcagcagaaacttact

SEQ ID NO: 157069 - DNA, 421 bp, Homo sapiens
aatgttttattaatctcatctccttaatgagttctgtggtgagtttaactcattcgtggtccagtccacacatatggaagtatgtgtgaacattcatttgtgcaattatgtattattcctatctgtgtataagtctttaattttggaaaaacactttgccttttacattaacttcatccacaatatgaagggattttgacttttggaaaagtagcaaatcctatatttgagaactttcgggaataagtttgagaaggatgttttcagacagagtgtgaccagagaagagccccagagggacgtgtctgagaggtggttgaaaaacttggtcatgtttatcagagaggaaagagaatgcaggcagatgtggtatggttttcaagaacataaggcactttttatggaagaaggaaggacatca

SEQ ID NO: 157070 - DNA, 267 bp, Homo sapiens
ggtaaatgaagggagactttttgagaagtcaaatacatgtagtcaatacaaaaactacggaagagaccttttatccttttaactataataaaagccctactggcttcccaaaatacctattccatcaaggaaaaagataagctttgtgtgtaaatgaaagagaatatctcttctttgtcctgaaacagttgaaaaataaaaagttttactacaggagtatgagattgcctgaaaaatacatgacataaaagctaaaaattaatcttt

SEQ ID NO: 157071 - DNA, 234 bp, Homo sapiens
cagcctgggtgatagagcaaaactgtgtctcaaaaacataataaaaagaagaattgtgtgtccgttttccttcttaagcaaggaagcaagcaaacaagtaagcaatgagtcagagaaagtccaccaagggcagatttatgaatgaagagacttacacagacagatgttaggatgacagcaacctgattacttgattcagtgaagtctaaactaagctgactctagcaaagaagc

SEQ ID NO: 157072 - DNA, 456 bp, Homo sapiens
ttgcatgtaatcgtagtttgctcatttttattacatttcacacatgaatttaacacaacttatccattttactgttggacaagtattattgttttctttttgtgtctattctgacacttttctctcagtgaacatatatattcatttctgtagggtatataactgtgagtggtcaaagttatatattggcccacatttaattgatattgccaaatactttctcacttttatgtacagggttactttcctgtcagtaatgtgtgaaagttccctttcctctacaacatttgattttttttttttaagttcatgtttctggtggtgtggtgttatcatactaaatgttttactttaatttccatgctgactaatcaagctgaagcattttgcattttattctatgcaccagctttccttcgtttttgtttttgtgttttgttttgttttcttgagaca

SEQ ID NO: 157073 - DNA, 530 bp, Homo sapiens
atagaacaacataatagtgagaaattgtaatatctcactttcaataatggataaaaaatccagacagaagatcaataaggaaacagataactcaaacaacactatggcccaagtggacctatcaaacaaatacagaatattctacccaacaacagcaaattatacattctcctcaaacacacatagaacagtctccagaatagttcacatgctagcccacaaaacaaatcttaacaaatttaaggagactaaaatcataccaagtatcttttctgaccacaacggaatgagacattgctaatagaaataatttcagaaagttctcaaatatgtggaaattaaaaaacactcttgaacaaccaatgggtcaaagaagaaatcaaaagaaaaatcagaaaatattttgagaaaaacaaaaactaaagcacaacatagcaaagcttatgggaaacagcaaaagcaataaaaggaaagtttacagcagtaaatgtctacagtaagaaagatctcaaacaacctaattttacaac

SEQ ID NO: 157074 - DNA, 209 bp, Homo sapiens
tgtattttggggttctgttgttaattacatatgtttgtagttatgccttgctaataaattgatattttatcattaaaatatatccctttttataactggtaacaatttttgccttaaaatctattttgtgggatactagaatagccactgcagttctctctgagttactgtatgcatggtatagcttttgccatctttttttttttttt

SEQ ID NO: 157075 - DNA, 401 bp, Homo sapiens
ctttgcctgattataagctgagcgaagggtgctgggatttttgtggagaggacagcctccgaggccttagggaagccatttttagagcctctagggccactgggggaaattgaatcttttaccagggcctcccacctccagcctcttctccaaaggggagaccctccccaaaagcaccaactgtaatcacccagaaaccccaagcgttttttccttccacactctgaatctaacactatcccccacaaccccaacatcagggaccctggcccaaatccttccccaggagaccatcctcctctcatcaggcctcggtcccaccccctcaaagcagcctcctttccaggagtggtcgaggtcccaccacattctacagcctcttccttgccccagacctcctg

SEQ ID NO: 157076 - DNA, 448 bp, Homo sapiens
ctcaagccgtcctcctgccttggcctcccacagtgctgggatcacgggcgtgagccaccagcccagcatcccttgcctttcattcgcacctccacctccagaatgaccctcattccctcctgcacagacggtgacagcagtaactcctacaaacaccaccagactgatcttcaagagcagaggaactcccaatcacgattccacccccgccgggctctcaaatcctccagggctgcctgctatggggagggaggcacactttgcttggctctcaaggcctcagccagccgggtccaaaccagctcccagcctggcctcaccatcccaccgccaaacctttgctcacactggcccctcttcctggaacatgggcctcatgaccccaggtctacctgtgtgaccaccaccccaccttctagaccatttccagtagcccctcccccatgct

SEQ ID NO: 157077 - DNA, 199 bp, Homo sapiens
caaagagggagaggtacttcaccaagaagagggtggtgaaaagggaagatctgtgtggtaggaaagatctgcaagtgataggtggtgaaggatagtgcttgagccctttttgtttagataggtgtataacatccaccatttaaagtggtcacatttcaaggcttgatgactttttacaaatgtataaacctgtataacc

SEQ ID NO: 157078 - DNA, 208 bp, Homo sapiens
aattactttttgaaacatttacttcagttaagagtgtatgcatatgtactagatggcaatgtaacatataaaagttgaaaaacacaggtttggaggatcataatgtaaaacacatatcttaacatatcatggccagctgtatggccacgtagctctttgagggttgggacattcttgatctatatatccctcatgcccaatgtcctac

SEQ ID NO: 157079 - DNA, 650 bp, Homo sapiens
gctgcatcgttttacattcccaccagtaatacacaagggttcaattttcccacatcctccccaacacttattttctgtttttccttttttgataaatttgtgtgtgtatatgtggttttttatttgtgtgttttgatgatagccaccctaatgggtgtgaagtggtatctcgttgtgttttcttggtttttgcttgtttgtacctttttacccatttttaagtgtgctacttagtagtagtaagtacattcttctttttgtgcaaccataataaaaatccagcttcagaacttttttcatcttcccaaactgagtttctgtacccattgaatagtaactccctattctctcctcccctgacaatcaccattctgctttctgtctctatgaatttgactactctaggtatctcatgtaagtggaatcatataatatttgatctttggtgtatggcttattttacttagcataatatcttcaggattcatccatcttgtagtatgtatcagaattttattcctttttaaggctgagtaatattccattatacatatataccacattttgtttatccatttatctattgatggacatttgggttgtttccacctttttgctcttgtgaatataatggtgctatgaatatcagt

SEQ ID NO: 157080 - DNA, 591 bp, Homo sapiens
gtgttttaggggagaacccgggctaggggagctcaagtgaaaaattacaaaggctggtcagtgtgagattaagctcgctgtgtctgctagctgataattacagtagttaggattctaccttcccagagagaccagaacagaggccatcctgtcctttctgatatcttttcaaagacactcctgaattgcagatttagagacatctcaaaaggacagagaaggattcataatttaagcccttttaaactctcttcagaaaggatgtcagggacctatccccaggtgttggctaaaacaaacagtaaattattctgacagccctgagctctttcagacaacactgagctgggttgtcccagaggtggccttacaccgcgaggagcagtgttaaactttcgtcaagaatcagcacagggctttgaatggagagttcatgccagagtttctgcagttctctggaggaaccccacaagcggattggtgaggaccaaccttggagaccccactgtagctactctaaaacattcagcctttctaaaaacagaatgaaacggcattgcactgtacctaaacagttcacatcactagtac

SEQ ID NO: 157081 - DNA, 528 bp, Homo sapiens
aattcttttcctaaatggatatgcccatgtatactttatcagcattatgtgggcatttctagcatcctcacccatacttgggattgtcagattttaaaatagttactaatttgaggcatgtgaaatgctatctcattttaatttacagttgcttgattattctgaatggtaggtaaaaggataggaaatttattattttctgtatgttttaaatatctcaaaaataaatgtttttaaaggaaaggcacactatcgtacaacatttatgttgaaaaggaccatgaagatcatttcatccaaccttcttactttacagtgcagccaaagaaagttaccagaataagagtaaaatataaaatcctgcccattgtagtattctctggtagtatgagccttaatttttgatgtaaaaatcatgtctttttctttatgattgtgctttttgtttaagaaatcctctttttatattgtctgctaatagttgaggattttttgttactctttgttatttgcatttaggttcatctg

SEQ ID NO: 157082 - DNA, 377 bp, Homo sapiens
tagctgggattacaggcatgcacctccacgcccggctaatttttgtatttttaatagagatggggtgtcaccatgttggccaggctggtctcaaactcctgactttaccacccgcttcggcctctcaaagtgctgggattacaggcgtgggccaccgtgcccggcccttgaatttttaaaaaggcagctgcttagtatagatcagattcttgtgaacttagtatagcaatcgcctatgaacacacatgattcctactgatctatttgaacagcagcaataacatttactgagcacttattccagagcagacattaggctaacaccatacatggcttgtcctgctgaattccatagcagtctgatgaagttgcttgta

SEQ ID NO: 157083 - DNA, 791 bp, Homo sapiens
gcctctaactccttttcggacatccccaccgcgcgctccggcgcccgctactccagcctacggccggccggtttagctccaggcccgctcccccgcggagccggaggacacccagggactggagacttcgcgggactccccacccttccacgcctctcagatttccaggcgctgggggccctgtgcgaacttgactggcttcagaaaagccgaaggccgagtttgtactggcgcgcccaagttgcgttctggactttggagatgccaactttagcccggacacctgggctgtgccatccggaccactcgggccgcacagagtatgcgtgaccctccccattccctggcagcctcgagttctgtctctctccgtctgtttcactctctccccttgtcagtatccacttcctccagctgaggggccttgtctcactattgggaaacgctctgcagatgtcaaggcttaagacaggagctcccgcccccacccctgtggtcaaggagggccaggatcggggtgagcagccaaagcgaggggggagtgtggaggcagtgctgctgtgtttgaggacagtgttcatctcttgacaggcttataaaacacatcttgagttacattcagtccataaaaatcttcctatgctatgggtgtctgactttgtctttcacaacttagaattatttttaactctttaatttctttgggactttcccaggtagaaaatcttcaaccatactggaccgaaaacagattctgatttataatacgagtgttggagtgaacgtcaaaa

SEQ ID NO: 157084 - DNA, 770 bp, Homo sapiens
ttttcattcctctttccaaatccacctccactcaagctttcaatctgtgcctgggctctggtttgaatgagccactgatatatttgcagccaccggggatctggagtgcagatgcaaatggcagtgttccctggtaagtgttggtgacaattggatctttctctgatttgcattcccaaggcctgcaggttttcagaaaatcacatcttataggcagttctggggaggggggaggtttattttcaatgtcagctacaaatgccggcccatgataattcttagaatgaaagacctctcatttgcaaaggagaggatagttagagccagaacaattcacttagcaaaaatttgggcccaaaaatatatatataggagaagggattgttggtgggtagagaggcctggagatcaagagcaagagatgagataaacacaagtttggaagccattggcttgtgaggggacctgagcacttagaatagaggagacccctcagggagagcttgtatggagagagagaaaggtgcatcctgaccccatcctgggcatttctctttgaaactcagccttgttataattcatttctaattctgatatcagcagtgagggttcatctaatctattctcatcacttcttgagcctctcagctctcactggtcctggctcttgcctggagatgattttactcaaaattctagtccaggatttagaattggtctaagtacagatgtgcatcaggaggctatttcaaaatcccagatgagctcat

SEQ ID NO: 157085 - DNA, 239 bp, Homo sapiens
tcatttgttttttccaacagattttcattgaacacctattatgtgttagatactatgctgtatgctgggctatatggttataaacaagacccacccttcatgaagtccattgtaggggagaccaataaagattgtgattgcaattatgaaggaaataaagtgatgatagaggcagtggggaaggccacattaatagagtggccagagagccctctctaccgaggtgtcatttgtgctga

SEQ ID NO: 157086 - DNA, 562 bp, Homo sapiens
cgataagaatgtgtaacaacgactcccaaagaaaatgtacagatttacttcctagccaaaagtatttagatttgaatttgaaaatgatgttattatttgaatttttatggaatattagaatgtttgaatcatatactcttctttcacccaatatcttttatttttaaaagaagaaactctatctaatgttatcaaaagagaaaccacttctttctttctgtttttgcccctgacggaggtgatggtggaagcccacctgccctggagggcagctgttgttgttgacacaggatttcgccatgttgcccaggctggtctcaaactcctggcctcaagcagtcctcctgcttcagcctcccagagtgcttagattataggcatgagctaccacacctggccatccttcctttttatttctatgaatatttcagttacctttgtacctgtaatatatatatcaatcccaaagtttattgttgtatgtgttttattttcatttgtgttttttaattataaagttaatgtgttcttttgttaaattaaaattcagaagtattaagtt

SEQ ID NO: 157087 - DNA, 567 bp, Homo sapiens
  misc_feature (22)..(22): n is a, c, g, or t
aggatccccagtatgtgtaacnacgacctcccaaagaaaatgtacagatttacttcctagccaaaagtatttagatttgaatttgaaaatgatgttattatttgaatttttatggaatattagaatgtttgaatcatatactcttctttcacccaatatcttttatttttaaaagaagaaactctatctaatgttatcaaaagagaaaccacttctttctttctgtttttgcccctgacggaggtgatggtggaagcccacctgccctggagggcagctgttgttgttgacacaggatttcgccatgttgcccaggctggtctcaaactcctggcctcaagcagtcctcctgcttcagcctcccagagtgcttagattataggcatgagctaccacacctggccatccttcctttttatttctatgaatatttcagttacctttgtacctgtaatatatatatcaatcccaaagtttattgttgtatgtgttttattttcatttgtgttttttaattataaagttaatgtgttcttttgttaaattaaaattcagaagtattaagtt

SEQ ID NO: 157088 - DNA, 297 bp, Homo sapiens
caggcgcatgaatagaagcctcagccacccacagcctcagtgcccggcagcgtgtctccaggaaggaaaggcccgggcacaatgcatttctctcaggtttggctcagcttccccggggatttgcaccatcacagagaaacctatctctcctccagggacccacagttggggaggccactccatgctgtcaccccttcctgtccctctgaaacgtttcttccttccactcatttctcctagatgaaattttaactagtattttcttgatattttaaatagacaattaaataaagtctt

SEQ ID NO: 157089 - DNA, 211 bp, Homo sapiens
tttggtctctcactgagaaaacaaggcacacacactaagcaaatatattcttccttgcattgtcatgtaactacatatctaaaatgggagccaccgtaatcctagcacttgggagacctgaggtcaggagttcaagaccagcctggccaatatggtgaaaacccatctctactaaaaatacaaaccctagccaggcatggtggcatgcacc

SEQ ID NO: 157090 - DNA, 375 bp, Homo sapiens
atgccagtgcaaacagtgggcacatgaggttttgggaaatccttcccctgaggttttgctgggtagagcctccatggttgcttttattggctggcattaagtgccagcagattttccaggtgcatggcgcaagctgtcagttctgccattctggggtctgaaagacagtagccctcttctcacagatccactatgtaatgtcccagcagagactctctgtgggggcttaaaccccacatctgtctgcactgccctagtaaagggtctccatgagggctccgctcctgcagcaggcttttgtttgaacatccaagcttttccatacattctctgaaatataggcaaaggctcacaagcctcaactcttgcactctg

SEQ ID NO: 157091 - DNA, 351 bp, Homo sapiens
ctagaggatcccccctgatccacctaaaaatcttccccactctgaggttatttaaaaaaaatatatatatacagttttggattctgcattatttctgttttcttcaatttccttttttactgttttgtttgtttgcttgttttactttgtctttaatattggaagcttccttcaagtatctggtcatccttttgtttatattttatgacgagacactaaaaagctgatagaaggtgctacgtggatgggcaggttggaaaaccggctttttgcatggtacaaccacctcagttcagtttctgtaagtcttttctctggagttttatttttttttccaaagaaggagcctct

SEQ ID NO: 157092 - DNA, 555 bp, Homo sapiens
gacagagaaataacacctatgcacggtggtgcatcctaaaaagcaggaatttccctaatggcaaggaaatcaattgctggggctgttcagctgcagggagtggaagctggagccttgtcagctcagcagggtgcctgccctctgtgcgggagcacctctgccctgaaagcttctactggtggagttgggaaccggcaacaaattgagcagaaaggaaaggagaaattgatgtgtgacatgaagtaaaggctaactacaggtttcctcagatcagagacaactaatgctgagcttgtctagcctagctctgtctagcgctgctgccagtaggtgagatgactgtggttcaagggaagaagagcccattgggagctagacccaggccagactggggagttcacccccaggggtccttttcccagacccaagcttctttcatgatgtccgctgccaaaaatgtcagcacatgtgtgcccaaatcgaaaaatcccaagaaaagcacaatcaccagattcccttcagtgaaaacatatcacagagaagaaagagcaaaaa

SEQ ID NO: 157093 - DNA, 586 bp, Homo sapiens
agaaatagacccatgcaaacatggcaaaccaatttttgatggaggtgtaaaagcaatagaactggagtaattggatatcaaaaggtaaaaagacaaaaacaaaccccaacctaagccttgcgttttacacaaaaattagctcacattggatcgtgaacttaaaactatgaaactttttggagaaaatatttgggaactggggcaaggcaaaagttagacttgacaccaaaaacacagtccataaaaggaaaaacataaatggacctcattaaaattaagaatttttgctctgcgaaagaccctgttaagaggatgaaaagaaaagctacacagtaggagaaaatacttgcaaatcacatagccaacaaattactagcacactgcctatagggttagccctgctctccaaggaatagcaaaaataaaataaaataaaaatgtctggaatacataaacactaccaatattaaacagaaaatggagaaaataatccaattagaacataggcaaatgacacagagctgtttcaccaagaaagatatacagatggcaaattagtgcatgaaaagatgttcaaagtcattag

SEQ ID NO: 157094 - DNA, 661 bp, Homo sapiens
tttccagtaaagggctctggaatccaggtctaatgagtccataccctttccagtaaagggctctggaatccaggtctaagtgccatgtgattggtttaggaatggaccaatgagacactgtgaggaagtttcctgagggcttctgggaattttctcataatagaaagctaccagaattcacaggcccttttcatcttgacttcttgtccatagacctgaggccaggggctgtggcaggcattttgtaggcagcctaagggtgaaacatgcacaagagagaacaagacaacaccacagagaagcagagctcagtaatggctgagccctgcctcacctccaccattcctagaccttctcagtctcttagccaatgaacagccttgattttaaagcaatttttatttgagtttttgcttctggaagccaaaacaaacattttagcctatggaatcccaatttatacttaacgtttttatttgttaatctttaagtttcagaattcttttctgattataaaaataatacatacttattgtagagaaccaagaaaacattgaaagatataaagaagaacattaagaccatccataatctcactatccctagataactgctattgagttttgagttagtttcctctttatgtatccaaacttacacg

SEQ ID NO: 157095 - DNA, 354 bp, Homo sapiens
ttacttacaggaaaatcctctcatatcatccactctctatctaccttcgccctgtgaactgcagcacacacaccatcctacagctagtgggagattgacggctgtatcacctggaattggaattaagtctcccacagccattggagtagcttttatggacagaagaaaccctttcccagcctgcacaggaaaaagaacataaaatgtgaaaccaggtcttaagtaacagctggggctaaagtatgtatcatcaaactgattatactagtgcaataagtgaaaacagctaacatcgatccactgcttaacaggttcccacactaagtctgacttcgtcagcctatcctagcttcc

SEQ ID NO: 157096 - DNA, 392 bp, Homo sapiens
ggagtttagaccatcaattaacaggtctttgggttactgcaccgtactgtcagtgtgataccgcaatcactattcactaaacataatgtatcattcttaggttgtagacatgggaatcagagttaacaagaggtctgtagttgaagttctagaaatacgtaggtctttaaaataatcctacatttcaattgcccttttaacctcttataaagtcttttgagactttataagtctcaaaagtcatagttagccttttgagaaaaaaaaatttttttccctaaagaaatcccctccaccaagccccttatcacattacaacactgcctcaacagactgcacactctgacataaatgctgcaccaacattttctgtttgcctcctcttccccaaa

SEQ ID NO: 157097 - DNA, 334 bp, Homo sapiens
ctcattagagctgggtttgtgtcataagtgagagagccctgaggtgcttggtttgaagcaaagcttggttagccatcagcatctgattggagactggtcccaacccacccatgccgctgaggaggggacatgggtgctggccagcaccgagattagaacactgacccggtgacatgggagactgtggtttccctcatggtacagaaacataaaccatacttgtttttgagatgtctgaccctgacaagactgggaaatagagctagcgactgataagtgttcaggggcagggactgcttcagtttctgtcgacgcggccgcgaatttagtagta

SEQ ID NO: 157098 - DNA, 155 bp, Homo sapiens
ctagactgtccattctgaacttgggccagatcttaacctgctggtaaagcactggctgagggtttagactttcaaggaatttgaggttgttttccctgccttattgcaacccagtgtctggctgctgagaccagaggcttgggccacccaaggga

SEQ ID NO: 157099 - DNA, 529 bp, Homo sapiens
cttccaggagggttctctactttcagtccaggttcactattgcaaccactgggatttcagaaaacagctatgacttagcatttattttttatctgtgtttggcaaagagataacccagccttcattcataactggcctatgttgtaattatatgcctgtttggtcatctcaaaccaggtgaccacagtgtgtgactacctaggactctaactgatgaccagctggaagctgcagctgcgggagaaagctcaaccacttagatgtgtgagtcacaggcagaatatgatgccaccgctctggaatcttctggctccctgtgtgcttgcaacttgaaattgaaggtgtttactttagtctataaaacaaaccccttatggctaatgcacaagttaccttcacattaatctctcttcttataaaccctagttgagaccagttggtatatcacttaggcactctaaatttatgcttcagaaatctgaatgcaaaaaaacattttaagtcctacagaagacccatgcttttagaa

SEQ ID NO: 157100 - DNA, 541 bp, Homo sapiens
tggaataccaaaaggagaagagaaaaagaaggagaagaaatatttgaagtagtaatggatgagaattttccaaaattaatagcagataacaaactacagatctgggaagctccaagaacaccaagcaggataaataccagaactacacctaagcgtatcatgttcaaactacagaaagacaaagaaaagattttaaaaacagccagagaaaataaacactttacctatatagaaacaaaggtaagaattacatttctcatcagcaactgtgcaagagagtagtgtgaaatatttgtgtcaaaagtaaaaagaaaacacccacttagaataatttatccagcaaaaaaaaaaaaaaaaaaacaaaaaaaagtttggttgcggccgcgccctggggccccgagaagaaagttttcaaaaccccttggctgtgggggcgcccggggcccccagggtgttggtggaaccggtggcccaaagcgggttccccaaggggagaccccgggcccggacctcggggcggggtttctccccataaaaaagt

SEQ ID NO: 157101 - DNA, 375 bp, Homo sapiens
aacggggtgtgggggctgggaagaattggagaggggatccctgaagagcccagagccttgactcagctggaggcggtaccatgggtgctggtgccccctcctgccccaaggctgggcaggaccgctgcgcgccagtggaggcctcggtctgggctctgtggcttatgcctgtgagacgcgggtggattgcttgagcccaggagttggaaaccagcttgggcaacatagagaaaccccatcttaagacaaaatcagctgggggttgtggtgcacttgtggtcccagctactcaggaggctgaggtgggaggatcacttgggggtcgaggctacagtgagtcatgatcgcaccactgcactctagcctgggtgacag

SEQ ID NO: 157102 - DNA, 179 bp, Homo sapiens
attccagaaagaagaaatagcaaatgcaaaggatctgagatgttcaacgactaacaaggatgccagagtgttggagacgaggagcaagtgagggagtgaggagatgaagtcagatgtgggtgatgtgatcggggaagtgagaaaatcagcagacagtgttataatttgcaggcaattgt

SEQ ID NO: 157103 - DNA, 305 bp, Homo sapiens
attcactcctttttttcattcatttcttcatgtgctgttacatgtacctaggaacatatagcttagtagcttagcagcttagcactaggcgctgggcacaaaagggtggagagggtgtgtgcttagccttttgtggctggtaactctgggcccagagttgaggggaatgatttgactggcgaggcagactctgcttggtcccattgtaaaccagtcatagaagagatgcctgtcctgggtaggggccctctcttccttccggtagtgttctgagcattgtctggatgacaggcctattgagcagt

SEQ ID NO: 157104 - DNA, 278 bp, Homo sapiens
gagggatttctagggaaaggggtcagcacaggcaaagaccctatgatgggaagaagctgggcacagcttgggattgaatgaatgccaatgtggctgaagggtggtgattgaagaggagggggagacgagaaggtctggaaggcctggggcatgatcagatcaggtgctgaggccgtggaagtagatgggatttttcatctaagggaaatgggaagtcattagagagttttcaggaggggatgatatgtatttttttaaaattgagcattatcctcggt

SEQ ID NO: 157105 - DNA, 254 bp, Homo sapiens
tcacgcctgtaatcccagtagctttgggaggccaaggtgggagtgtcacttgagcccaggagtttgagaccagccagagcatcaaagtgagatgatgtcacaaaaaaattagccaggtgtggtggtgtgtgcctctagtttcaggggaggctgggaagggaggattgcttatgcttggaaggtcaaggctgcggtgagccttgctggcaccgatgcgaatgcattgggtgacagagaacgggtatgggtgacag

SEQ ID NO: 157106 - DNA, 409 bp, Homo sapiens
atgttgcaatacagtttccacctaaatccaaatgtttttcaggtctaattgtaaactgctacttttgtttaatgtggacttacatagtcttctgtatcaatacctacttcgctggcagttttgtcaaagtgtgttgagttgaggcattttgcattatatccgacgtggtgttagcattccttcttgtagcaatcaatttcatttctatttgctgttgtaactcaaagttaacgaacattcaaagtttactttcatttattcatgcatttttttgtggactgctctacaaaagcacctttcttccttaacaacattctatccaaactgagtgcagatgaatccgagtagtttcattttagagagcagcagtcatatttgtattaggaaggcaatagtcttggaagaatac

SEQ ID NO: 157107 - DNA, 555 bp, Homo sapiens
tggtagagacagggtttcgccatgttggccgggctggtctcaaactcctgacctcaagtgatccgcatgcctcggcctcccaaagtgctgggattacgggcatgagccactgcgcccggtgatcaaaagctgtttatagtgaagaagtgacaagggaagccagggacagaccacaggccttcacaatagcccttcacatgttacccatcgccccaccaactctctctctctctctcaggtccagctttgagcaaaggacataggcaacttctccccgcatctatacagaccaggcccctgggcagggtggggcgtggctgcctcagtttctacgtctccttgttttccatctgtgactttggtcgtttttgccaccttcatctctgtctctaacttccagtgtctgtcgcctctgggtagtactaatagctccctttccatcgtggtctctttcttcctccctgtctctcccctttcttgttgtatttattcctcactcatcaaagcccatctttttcgctatggtccggtgcacttctctctagatccctttct

SEQ ID NO: 157108 - DNA, 158 bp, Homo sapiens
taagttcttttgttcttggtacactttcttcctttttcagactggatcctaatgactccaaccactaaacaactcaatctgttcagagagagaggaactgtttatgtgagttggttgtgtagtcagaggttgtgagttgtttcttcatccatgctgag

SEQ ID NO: 157109 - DNA, 147 bp, Homo sapiens
aagcaatcctcctgcctcagcttccccagtatctgggactacaggtgtgtgccaccacacccagttaattttgtttattttttgttgaggcggggtttcaccacattgcccaggctggtctcgaactcctgagctcaagcgatctgc

SEQ ID NO: 157110 - DNA, 123 bp, Homo sapiens
gctagagaattctgatctctttcaaggtctataaaaccctcttaactgctactttatagacattcaattacaacaggccataatacattaaagcattaaaatacacatatatcccaacatatg

SEQ ID NO: 157111 - DNA, 810 bp, Homo sapiens
aggttggttggaaggagttgaagtgagccagtccacactctccacacatctaggatcaagtggcctattcgccaccatggctacgactagctgtatcagctgtgatcatgaaccctcacatttgcgagggcaggcagagggagtccctccctaccacgtggtcattgccttccctctttattattaacccctttcatagaagaatcagctgaagcctagaggtgtgggatattttgcacaaacctatgctggagcaacaaggggagccaggcttggaactccatttgtctgattccagagactgcactccccgccagtacttgatcctccccacagccgccgtctctccaagtcaaaggcccctgaagttctccctcactctgtttcaagtggcaaaagccccaggctccaggcctgttcacggactcccgacagatctcctgcagcttttctcttgctcctgcttttactgggaattataactatttcagcagttttagtgtttgaaggaagctttctctacgtatctttcctccctctggggacaggattgctttactcatcacagggaaggccttaaatgaccttctgctacatccacagattttatttcatctctctccattagaaataaagatgaaggcaagaccatggtttctgagttctcttagtctccacagaatgtaattactacatttttttctttttctaatcacaggagacttctctcagcaacctagttactgattctattactccctcactctccacttccaactgctctttgaagcggcttttttagggaaatta

SEQ ID NO: 157112 - DNA, 143 bp, Homo sapiens
tcctttgccaagggattaataaaaaattgaaggctcagaaatgcttcttcagtggttgactgatagtttgtttacagtaaggtgggtggaaaggcaaccccagctatcctcctctgtctaggggagaaattgcctcagctctg

SEQ ID NO: 157113 - DNA, 383 bp, Homo sapiens
ccccatctctactaagaatacgaaaattagctgggcatggtggcatgcctgtaatcccagctacccgggaggctgaggcaggagaatcacttgaactcaggaggcagaagagttatataatttttggacattttaattgagaatgtattacacacatcagtgttttaagaaggctaaggagaactttcaagatcgtctcttttcatggttctctacttgagtccccaccgaatactggttagaatctaggtgttcttatcccaaactaaactaatggtcactttctcctagtttattgaaagttattgttatgctctatgataatctattaactgactattaattgttaaaccaatggcttaaggatagacaacaatgtagtg

SEQ ID NO: 157114 - DNA, 436 bp, Homo sapiens
tacgataaagcaagaccaaaacgtggggccctctagcacaggctgatctaaactccttcaaatgattattctttaaatagttctacatttccctagtgggaatgaggataaattgattttctaaattatatatatgtgggccaggtatggtggcttacgcctgtaatcccagcactttgggaggctgaggtgggtggatcacttgaggtcaggagttcgagaccagcctgaccaatagacaggtgaaaccctgtctctactaaaaataccaaaaaagtagccaggcgtggtggggtgcgcctgtagtcctagctactcaggaggctgaaacaggagaattggttgaacccgggaggcagaggttgcggtgagccaagatcgagatcaatcatgcccctgcactccagcctgggtgacagaggaagactccatctcc

SEQ ID NO: 157115 - DNA, 196 bp, Homo sapiens
tgcattgtggtttataatctctgaattttctttctaaatctactagaattatactaaccttagaaagttcatctatatttcacctctttcctgattgtagaggtaattatctctcagctatcacatgttgttgaaaattaaatgatttaacttttccaggtacttctataaaatcagaactattaacacttcaaag

SEQ ID NO: 157116 - DNA, 558 bp, Homo sapiens
ctaagattaaaagttaatagttgaaattaaatttaataataaaactgaatgtgtcattcagcattaatttttggtagccttatgtttcaatttgaacatcaaatattatgtaaaactgcatgctctgaagcatctatttaaatttggtacatttttgcagaagagcaacctggaaaaaaattaaataaataaatttggaaggtttgaagccttcaatgttctggggctcaggagcctaaaatcaaatgtgccctcagaaagacttaatattattttaggttgtgcacatttagaggtcgcttctcagaacttaaacacctctaagagttttattgacactctaacttttaaaacaacttccttggagactagtaccaagagaggaagcaagtcaaatcttgcatctcatacttgccctaaacatgagactcctgttattttagatcaaatttatactagaaggcaataaagatggcaactcattcaccacttgtttactcagtaatataaggtatttattctctagctgctcttcatttattcaataaagacattggg

SEQ ID NO: 157117 - DNA, 171 bp, Homo sapiens
tgtgattgaaagtctgtatgatttcaaagtaatttgagttttgactccacattggcatttccatcaatttactgtgttgttccttgcttgcttattggtctgtttacggtatgcttttaggagtaaacaatttactcctgacctgtaattatcaaagttgttggatattga

SEQ ID NO: 157118 - DNA, 142 bp, Homo sapiens
gttgcagtgagccgagatggtgccactgcattccagcgcaggcgacagagtgaaactgtgtctcaaaaaaaagaaagagctgagaaatttaaatgtgttttaaaatcttgagttgatactgatatgttgcactcagaaccag

SEQ ID NO: 157119 - DNA, 196 bp, Homo sapiens
cctggtatttccacccggaagagggaaaggattttaactacaaatacaggaatccagcagatggcatcagagaacactataaaaaagaaacgatttgcaacagccacctctcttccaaaacaattccttacttctgtggtctgcaaggcggttttttgaatggaacagaacatagtaatataggaaaacacaatga

SEQ ID NO: 157120 - DNA, 403 bp, Homo sapiens
gaagtttgaggctgtagtgagctatgatcatgttactgcactccagcctgggacttcctgtctcaggaagaaaaaaaaagaaaaagaaaaaagacttgagcaagtggagaagagaggtggctagtgtagacatggccagtttccatggggaagcgtggggaagggtgaaggtgtgaatggaggattaaggcatattgttaagtagtcttgatcacaagactaaagagttttgatttcattctttaggcgataggcagcctttgaagattttaaagcaggagagtaacatgagtaaaatagtgctttttgtttgttttattaaaagagtgcttgagcaatctaggtgttagataaacggagaggggagaggctggcagagatgctgaggcttggagctagggtg

SEQ ID NO: 157121 - DNA, 515 bp, Homo sapiens
tgaggatccccctgcctcccggggagcaatagcagaattaatatctgggagcgttgataattatatatcagaatctaatttttagcacagaaaatgtgttaatgacagagaggaaaacaaaaaccactagcttctcccagcaggccccaaagtgtcatttattatttctcagctggatatctatcaagtttatgggttaatttttctgtagactgttatttatgggtttttgtttgttttcagccatcattactaacaatacggttaatagcaatcatttgttatccagtactaggcgtgatgcttcagatgagagcactgaactgagaatactcatttggtagctgaataaggccctgacagggcccatttataacaagctcattctataatgtccatcctattaataaaattttgttgctgtctaattagagatgtctgatgtgtataggagcacggcagaggagactttttgctgctgcctttttccccccgcttcccctggtctcttctgt

SEQ ID NO: 157122 - DNA, 163 bp, Homo sapiens
tttagtaagtgacttgatgctctgagacactgctacacaaagtagctagcctatgaactctttctgactggttcagaatgagaaaaagctcttgttccagaatgtaaatcaacatatgatttcatttactaaggaagtcttgctcagaaaacattctgactga

SEQ ID NO: 157123 - DNA, 118 bp, Homo sapiens
catggatgccctcagctatctctcaggctattgtataaatggagacttggttcgttctgtagagcaaccagttatgtaggcaaaggctaaataacgagggaggagacggacctcccag

SEQ ID NO: 157124 - DNA, 724 bp, Homo sapiens
  misc_feature (405)..(405): n is a, c, g, or t
  misc_feature (428)..(428): n is a, c, g, or t
  misc_feature (436)..(436): n is a, c, g, or t
  misc_feature (440)..(440): n is a, c, g, or t
  misc_feature (452)..(452): n is a, c, g, or t
  misc_feature (459)..(459): n is a, c, g, or t
  misc_feature (466)..(466): n is a, c, g, or t
  misc_feature (476)..(476): n is a, c, g, or t
  misc_feature (485)..(485): n is a, c, g, or t
  misc_feature (509)..(509): n is a, c, g, or t
  misc_feature (517)..(517): n is a, c, g, or t
  misc_feature (524)..(524): n is a, c, g, or t
  misc_feature (529)..(529): n is a, c, g, or t
  misc_feature (535)..(536): n is a, c, g, or t
  misc_feature (548)..(548): n is a, c, g, or t
  misc_feature (574)..(574): n is a, c, g, or t
  misc_feature (580)..(580): n is a, c, g, or t
  misc_feature (593)..(593): n is a, c, g, or t
  misc_feature (600)..(600): n is a, c, g, or t
  misc_feature (622)..(623): n is a, c, g, or t
  misc_feature (633)..(633): n is a, c, g, or t
ctaaaaagtttgcacaaagaattgaatatagctagacattgcctaagtattataatttataataattaatacatgctaaatatttactatgtgtcaggcactagtctatatgctctctcatggattacttatttaatccttgtaacaacaatatgacacaagtacccttaatcctgactttcatttgagtaaactgaagcacagaagttaaattacttgcgtaaggatgtgtagccagtaagtcaaggagctgagattcaaatcctggcagtttttactccagagtctatactcttaaccactatacagcttcactgagaccttcaagctttgctttccttgtttctatagttttattaattgtgtgtgtgtgtgtgtgtgtgtgtgtgtgtgtgtatgattttntaattcctagtcatttttctatngattgttntgcnaaagccatttanatcttanggatatngataatcttntgttatatntgatgcaaatatttttttccagtntataggtngcctttnaattntgtgtnncaggtagataanagttaaacgattttcttaggttagtntatcantgtggtttctgancttgttntgtgtagatcttttccaccccnngagtacatanatattaatccatactttcttatggaacttgtatggtttcgttttttacatttaaaccttcttccccgtggtgtgtgattgtgtaactgttg

SEQ ID NO: 157125 - DNA, 255 bp, Homo sapiens
aattttttgtatttttagtagagacagggtttcactatgttggccaggctggtctcaaactcctgacctcgtgatccgcccacctcagcctcccaaagtgctgggattacaggcatgagccacgcacccggcctgactcctttttaatagtgggctttagaattatatagacttaattcattaaccaggcttatgttgtatggaatactacttgaaataaatgagctattggccagagtataggatgctttttac

SEQ ID NO: 157126 - DNA, 221 bp, Homo sapiens
gcaagagagtgagactccacctcaaaaaaaaaaaagaaaaaagaagaaaaaaaaggacagcagacaatggcactctgcaggtggaactgcttcatgtttcccactcctgtccctgttcttcaagagccggcctccccttctctctgctccatccacatgggtttcaaagaagcttagctctttctcaccccagggtttttttctttctttttttttttaaa

SEQ ID NO: 157127 - DNA, 482 bp, Homo sapiens
tctgctcccataatccaatcacctcccacaggtccctcccccatcactggggattacaattcaacgtgagatttgggtggggacacagagccaaaccatatcaagggtctacaacatacgcaatggacagtacaggtggtccacagtgcaaactgtggcactcactattcactgctagtagcagtagtatctaccaaatctgtgataagggtcacagacccaagcctgtttttctagtatcccaagcctagccccaagtctggttttccagtattccaagtaattctgtagctacccagaatcctttcagtaaattatttctttcgattggccaaaattgggttctgttgcatgtaagtaataaccctgtgagatcctgaaccagcacaatcagcatcatttaggaactttgtagaaatgtaaattatcaggcctcaccccagatctagtcaatcagaatatctgggttgtagggaccagca

SEQ ID NO: 157128 - DNA, 377 bp, Homo sapiens
actagctgtgtgattccgatggagccacttaacctctctgagctgtgggatcttcctgtataaaagagacaaccacgtagtgcccacctcaaacagtggttatcaggattgagatgatctgtgtaaagcatttagtgcctatgaagcacttcttagtgtataaagcacttagggtgtaaaaggtgcatggtaaattctgtttgtcgcccgggctggagcgcagtggcatgatcttggttcactgcaacttctgcctcccaagttcaagtgattctcctgcctcagcctcccgagtagctgggattacagctgtgcaccaccatgcctggctaatttttgtatttttagtagagacgggatttcaccaggttggccag

SEQ ID NO: 157129 - DNA, 583 bp, Homo sapiens
gtccacaagtatttatcacattacatttacctattttaattgtttacctagattatttatgataactgtggtagtcataatttaaagttgtgaaaccgccattgcaaaattataactgagacagtaaaaaaaaaaaaaaaaaaatatggcctaacagattccattttccttttaacctccaaactgtccttgttcattcctaggcataggctgaactaactttgggaggaacttagtttatagtttaactttaaaacaaagatggtaacagtcctttctcaaaacaaacctctctactccctgtgtactacactgcctaaagccacaggattagaacgtatggtaatctaggccagatgcagtggctcatgcctataatcccagagctttggaaggccaaggcaggtgggtcacctacggtcaggagttcaagaccagcctggccaacatggcgaaaccctttctttactaaaaatacaaaaattagtggggcatggtggtgcacacctatagtcccagctactcaggaggctgaggcaggagaatttcttaaactcaggaggtggaggttgcagtgagccaa

SEQ ID NO: 157130 - DNA, 768 bp, Homo sapiens
ggcttggcagtcttctctctcaacagaccactcctttctcctttcttctcctactctctcccagccccttgaactcaaaggaccgcatgctttcagccctttctctcccccaacacacagcagccccattccccttgctcccactatccccgaatcaaccaggagtgagcagttgcagggacaacgcctgcaggtctcctctcccactccctgggaactctggctccaaggaaaaggctcagacattcctctctccccttctgccacccaccagatggaagggataattttgcagaggcaatgggagcatatcccaaagaagccaaaatgacatgttcaggagagaacagagttgaaggaccaaaaggggcccccagctgctgacaggaaactcagagtcagtgagacctccctcccccagaaggcgtacgccacccactggggctgccatcccctctaccaggctgaccgagggtaccagactgactccttgctaggggtgggcagcagaaggaaggctgtagtggacaccccagcccaccaccctcaacagcagagcttggctatgctagacaggcaaggtccagggtaaaaatagagccagaggaagcatggcccagtcctgtgaccacccctgcctgccccaccctcctcaatccctgcctgggcagccactgcagacatctaccacaggcctctggagccagcccagctccaactgctctctctccatgccccaaccctgattccctctggctggggtacaga

SEQ ID NO: 157131 - DNA, 388 bp, Homo sapiens
taacacttatgaattccacttctagatatatactcagaaaataaagatggcactaagatcttagaagcctgatacagtaatatattttagacaattatcccataaaatgaaatattttgtacttaatgaggtaagtttccatcatccaagaaaattttattcatgtgatacatcttccttttatcatgatgctggattgataaagtaatgatataaattgagaggtttactaaattgaactacgtaaaacatggaaattctaagattaggatgatgagtaaattgagccaaatggtatttctctgaaaagctgttacaggaaaaaaacaagtaatggaagcttcacctccagagccatttaagagcagggtgtctattgctagatatt

SEQ ID NO: 157132 - DNA, 342 bp, Homo sapiens
atctatactgagtcactggaaagaaaataagcacttaaatttgttgattatcagaatggtatgcaatgtctgtatgttctgaagtggctgtgagaaatgtagtatgtgtttaaagtctgtaatcttattgtaactgaagtaactgtccattattcggcctcctcatctgcaaaatagactttctataaaagtaataatggagaaaaatgggctaaaacccagaaaaccttgatccaagtcagacctggacttgtcactaagcatcctcttaagctttggtttctttagttaggttataaagtatgttccaactaatatgtttctatgaaaaaaaatgctgta

SEQ ID NO: 157133 - DNA, 262 bp, Homo sapiens
gggggcagggacagcggaggggctacaagaaggccagccctgaaaaagcaagggacccacagatccccaccaagcctgctgcagctgcttatgataaaggaagggctatatatttcagtgattggcaagctcgtccaacctggaagtgggtggagttccgttgtcaaggccaggcctagggccctcccactttccgtcttcttgtttcttctgcacccacgtgcaacactccaggcagcacctgccagtggtacccacttcc

SEQ ID NO: 157134 - DNA, 424 bp, Homo sapiens
gcacttcctcatttttctcagaagcagtacctgaaataaaggcagagtccttgtctgcctctatgtacttgataccagcttgtcaagacccacccttcccttttacctcgtctaaaattcacaccagtggacagcagggcctgcagcatgtctgtagaaatttatttaaacttatgtatgattcatagaagactgagtactttgatttgatggggatgggctatatttcttccaataacaaattaatggattagttcataagattagctacattatggaacaaatggaggagatggaggatgagttagttttagttacaggaggaataaggtaataaataacttcaagtagaacaataaaaatttggacttctaaataatttggataacccattttccaaatataggctaagccctgctgtggt

SEQ ID NO: 157135 - DNA, 402 bp, Homo sapiens
cattgcaaccctctctgcctcccagattcaagtgattctcatgccacagcctctcgagtaggtggaattacaggcatgcaccactatgcccagttaattttttttgttatttttagcagagacggagtttcgccatgttggctaggctggtcttgaactcctgacctcaagtgatctgcctgccttggcctcccaaaatgctgggattacaggtgtgagccaccgcgcctggccacatagagatattttaagctttgggaatgtaaggagaggatataaaatgaacgagaataagacccatgtctgagcacggtggagcaccacttttgaagacatctggtaggtaggatgggaagagccagaggaactgggaagctgggaaggctaagtgttacagaagcc

SEQ ID NO: 157136 - DNA, 536 bp, Homo sapiens
aatcaagaattcaaccacttttacaatagcagcaaaaaaaaaaataaaatacttaggaatatacctaacaaaggagttgaacaacctctacaaggaaaactataaaatgctgctgaaagaaatcatagacaacagaaacaaatggaaacacatcccatgctcatggatgggtagaatcaatattgtgaaaatgaccatactgccaaaagcactctacaaattcaaggaactctccatcaaaatatcaccatcattcttcacagaagaaaagaaaacaattctaaaattcatatggaaccaaaaaagagcccacacagtcaaagcgaggctaagcaaaaagaacaaatctggaggcatcacattatctgatttcaacctatactataagtccatagtcatcaaaacagcatggtactggtataaaaataggcacatagaacaatggaacagaatagagaacacagaaataaacccaactacttacagccaactgatattcaacaaagcaaacaaaaacataaagtggggaaaggggc

SEQ ID NO: 157137 - DNA, 840 bp, Homo sapiens
ggcatgtattagctctagaattaccacagttatccaagtaggagggtgggagcatctggtgttcaccagatgctcccaccaagaggaggcagttggaagagtagttccatcttggccaggttcagttgctggtgggcagcctaccagagaatactcacaggcagtcgtggctgcagatggggacctgagcataaacctttggaaagatgcagtttaggacaggggaggagaagggtgatcagaagtatggggaaaaccaagagtctggatgctcaggaagaatccgctggaaggaggagtttggtcagcagcatcagatactgctgtcattttttagaaagatgaaaagagcaacagtccttggatttagtggttagaaggtagtctttgttgctttctggaggaccatgtcagtgaagacgcagaaactgcatttcgggagaggatgtggatggtggggaagcagaattggggctgttagagaccttggtgcagggttgtggtggaaggaggggatggagcagggctaagaggcgtggtttaggagtggggagatgtgagcaggtttgtggactgaggggagaggagctttggtggaggaaaacattgatgctataggaaagcaggaagatggaacaaggtcttagaagagctggagcttgggctcactggtgcagtgctcccttggagttgcacctctctggccaactgtatatgtactctttatagtctttctctggtatatacttaaggaacattttagaatgtttacaaagaaggtcaggcatagttaataaaaaatggcatggtttgagtggtatgtaagatatttgaatggtg

SEQ ID NO: 157138 - DNA, 310 bp, Homo sapiens
ctctctgtactgaccttacttgactgctgtgtggcatttattatgctttaccataccaccttcctgaaacacgttcatctaggggtttccatgccattgcgttcacctgcttttccttccttgtcactggctactccttctcagtgtcctttccttgttcctcctcttccacttgacctctaaacacggaaagacccaaaggtctgctcttgctacacgctccaaaggtgatctcattcagtccaccaccaggtcaggccaccccttgcccaccacaatccagccacactagacttctttggctccatga

SEQ ID NO: 157139 - DNA, 377 bp, Homo sapiens
ggagagagaggagagagaggagagaggagagcgagcatgggaatgactaggagtgcatcaccagccctgaggctgttttatgtgtcaaccccctgccagctgccaaagtatttaatagatggctgactactgtaaaacaccaatttttggaagaggaaatgaatgttccaagaggtctaaatgacctgtccaaagcctgttaagtgtcagagtcaggattcaaaatatgcctaagtccggagcacatgccctccctcgactcagcctcctagagccagcagtttcagactactctccctgcacaggcaccaggggaggccagagcagtaacctcagtccaccccaacagcagttcttgtttgcatggaacaagcaag

SEQ ID NO: 157140 - DNA, 489 bp, Homo sapiens
ccttgtgcctgttgctttccttctccgggctcttttcccatctgtgaaagctgtttaaggtcttttcagcccaggatctggattatagacatctctgacatgaggtacctgctatggccccactagaagaatccattccacttcccagcctgggctatataggtcattcagtacccgccatagagccagatcttgtgtggagagagaggatgcaggattccactgggtaggcaccgactgtccagttgacccacttgtggtgctgatgcctaggcagcagggctgtggtcgggcttgaacaccatggcctgcgcccctctggagatccagctttccataagcaggtacagggcagccatgtttgttctccagtgaagcagcaactgccctgctccctggtgcccaggctggatgctacccagaatgcactttcagtgaggtgttagctacaaggccagactataaccttgagttcagcctttggagact

SEQ ID NO: 157141 - DNA, 291 bp, Homo sapiens
ggcatctagggagtggcctgctcacggttcctctcctgccagtgtaggacaaacaggacagggcagagctgtgcccgcacctcccagagggactgtgcctgtctctggaggagaccatgaaaaggaggatggggcctctccaacgaggcacacgaacctgttaatgtgaaattattcacaaggaaagaggacactaaattaaattagagtgaccttattttgtgtttggaagatgggcttggtcacccccgagagcctgctgcattcatcaccctccccaagggaaaaatt

SEQ ID NO: 157142 - DNA, 358 bp, Homo sapiens
ataaagcgttgagaagtataaagcgttgagaagtataaagcgttgagaagtataaagcgttgagaagtataaagcgttgagaagtataaagcgttgagaagtataaagcgttgagaagtataaagcgttgagctcaacgctttatactgtcctcttggtggtaatccttccaagagtggaagtaggtgcacaatggtgttactgctggattgcaggctggaggactatcagaactttctttcttttttttttttttgggctgtcagaggacctaagcagaaggcttcagatcactccagactccaagggggaacagtccagcctcttgattcaaagagaaccctcctcaaggttgagg

SEQ ID NO: 157143 - DNA, 301 bp, Homo sapiens
tcccggaaataccagcgtggtatagattggtatttcccaaaattcttctgttgggggtccttttacaaactctcagtactcatatattaaaagctctgaaactcctacttaacattgcccaagccagtttctccatgctattaaccagcatattatagcaatccccagaactacttgctctgggatatatttatttatggaaaagaccaaccagatgaaatatcagaagactggagtccctgttccaacaccattagcatactggacaagtcaaccaaatatttctgtcctaccacctatc

SEQ ID NO: 157144 - DNA, 353 bp, Homo sapiens
tcggtggcgttcagaggatcccggaagcacactgcaacaacgtatttaatacaaagcagccttggggcggggcggggcggttaacaaaatgcatctcagcaccagcctagagaaacttttctgtgtgtaaacagaagaggggttaccatggagaaattcattacggatttcgggagggctttttcctcagacatagagtgaaaagaataagtcgttgtgcaataaatctgatactgacgctgtgtgacttagaagttggtccaaaagttcatcttaggcaattatgcctagatgatcaactacacatcttctgcaacaggtgacacgaacctgttgcagtgtgcttccgggca

SEQ ID NO: 157145 - DNA, 189 bp, Homo sapiens
aatggactgtttacgctgtttctctgtgtctttattctaaagactcttgtgtacacatgaaataaaattttgtatggcttatcttcaattaatctgccttttttgagttgattttttagtgaacattaaaagggctaagaagaaattttcccttggtcctgataactgctagtaagaaaagggaagaaa

SEQ ID NO: 157146 - DNA, 282 bp, Homo sapiens
ccaaaatatttttaatgggtgacctgtgactaaagctttcatatatttttaaaaggcctaccttcttacttactgacctcctatgggatacccccttttttttttaagtctttctcttttttttaagctatctctttgatcatctatcactcagcaattgagttcatcatactaattctgtttatatgagcatagaaaagaataaagaaacattagaaaaggtgagactatgcataaaagattttcattcattaagtaatcgattgacatagattaaaaatt

SEQ ID NO: 157147 - DNA, 218 bp, Homo sapiens
ctctagtactctaatagtcgaatcaccattgtcactcacttggattactgcaaaagccttttaagtgttgtttctgccctaatcccctgtggttacgcctcaatgcagcagccagctcacatcatttctctggcttgaaacctttcaatggcctctcatcttaagcaaaagcctaagtccttacaggggcttgccgagttctacgagatgtgattccc

SEQ ID NO: 157148 - DNA, 315 bp, Homo sapiens
ccggtgccttaatcttggatttcccagcctccagaattgtgagaaatcaagttctcctgttgaaaagctgtccagttcatggcattttgctatggcagcccaaatggcctacaacacaacaattacccacatggcttactccctaacttctctcagaggcctgctctgaccatataacatttatatttacttacttggctgtttactgtctgtttctccctactgaattataagcttaggggttttgttttatataaaggtcaactcccaatgcttaaaatccaataggcaccaaacaaatctctgttgcgtgaa

SEQ ID NO: 157149 - DNA, 901 bp, Homo sapiens
atagtctcataatacatttgtgtttccttcttttcaacctttattactttgcttctttttaacaaccttatttcttcagcaggacctacatatgatattaaatagaagtggtgaaagtagacatctttgatctgggaaagggttcactatttcaccattaagaaatatgttagctgtaggtttctttgcagatgcctgttgtaagattgatttagttactctgtagttatagtttgctaagagattttttaaaatcctgaattaatgttaaattttgtcaaaaatgttttctgcatacactgaaatgttcataagatttttctcttttatactgttaatcagttatgttgactgatttacaaatgtaaaatattgaatacttgatcataaggtattagcctcttatatattgctgatctgacttaaatacttgataagaatatttacatttattttcatgagagatattcatctgtaatttcttttcttataatgccctaattatattttggcatcagagtcctgctgatctcataacatcatttgggaagtagtcccttatttcctatattctgagtttatataaaactgattgtaaatgtttgatagaatccatcagtgaagccatcttgatttgaagctttcttgtgccattgtggaaaagttttagattatgacctcaatttttttaatgctattcacattgtctctttttgtgtcacttttggggaattgtgttatttcaagaaaatttttgtttcaattatcaaatttattggtataaatttgctgaaaatattttcttattagcctttggatgtatgtaagatatatagtgatattgtcacatttatttctgatattggtaattggttattaatgtgtccttcctttttaaaag

SEQ ID NO: 157150 - DNA, 728 bp, Homo sapiens
gcctaggaactccaaaaggaacctgtttgtataataacactcagtaccaagtatgtaatccaggaagtgaccagcccgatgtgtgctatgacccctctgaacctcccatgatcacagtctttgaagtaagactaaggactggtccttttcctggtgacacaagtaaagtaatagctagaacagaagaaagaggggtccccaaacatgtaaccttaaaatttgatgcttgtgcttctattaatagtaatcagcaaggaatagggtgcagttctctagactggaaaaaaaagttacacagtaaaaaaaaaaattaagtatatctgtcaagaatcatatttatgtgagatgtgtcaatactggtcttgtgtcatttggacttacttggaaacaggattaaaaaggtcctgtttggctccagaaaggaaaagcagccccactgtgggagctgcagccctttagaactggtaatcacaaacccctcacacccaaaatgaaataaaggaaaatatgtatcattgagcattgatggaaaaggactagatcctagtgtaaacatcttaataaaaggagaggttcaaagacgctctccagaacccgtatttcagactttctatgatgaactaaatgtgccagtacctgagattccaggaaagactaaaaatttgtttttgcaattagccgagcatgtagcccagtctctaaaagtcacttcgtgttatgtttgtgga

SEQ ID NO: 157151 - DNA, 193 bp, Homo sapiens
gggatacaatcagttttctgtattagaaggattctagactagagaggaatgaggccaaaggcagagcagtcttgataaccccttggttgaaagagatacttaggggccaaattagggcatttggaggataaagacaaggtggaaaatatccaaagatatttaggaaacagattgtatgggtttgagggggcct

SEQ ID NO: 157152 - DNA, 141 bp, Homo sapiens
attcctcagcttcctgagtagctgggattacaggtgtgcaccaccatgcctggctaatgagtttaattaaaattaagtaagactaaaaattccatttctcagtcacaatagccacgtttcaagagcccagttgccactata

SEQ ID NO: 157153 - DNA, 507 bp, Homo sapiens
ctaatttggaatctatatgctttttttttttgagggttactctagctattacaatatgcatacttgttatagtctgaagtcagtctcttgtcctctttctgacaatcaaagatctttacacttttataatttatatacaattgtctattttgataatatatatgtgtttctatgtgaatatatgtacatacatatctttgaagagatagtagatttgcatgtagttgtaagagttaatactgagacatcctgtgcacctttcactcagttttccccactggtatccaataaaataatataacgaggatattggcattgataaggtcaagataggacatttccatcagcaccagaattcctcatgatacccttttatagcaacattcactttcctcccacttctggcaactactaatcttttctctgttcctgtaattttgtcattataagaatggtatcttagcctgtttaggcttctagaacaaaaacactgtaaactgtgtggct

SEQ ID NO: 157154 - DNA, 614 bp, Homo sapiens
taatcatgtgtgtctggagtatgtgtgctgtataagacatgtgtgcatgtcgctgggtgcatacatgtgcgtgtgtgtgcctgtttacatgtgtgcctgtgagtgcatgtgtgcctgagcgcatgtgtgtgagtgcatgtgtgtatgcttgagtacatgtgagtgcatgtgagtgaatgtgtccatgtgtgtatgtgtgagtgtatgtgtgtgtatacattaaagaaaaagcatcaggcccatgtctgggttaatccacagcaaaaggaaagtcacagccagagaacgtgactcccggtgagcctggagccagcgtgactgcagagggccagtccccaggtgatgccggtacgctggagaaggcctgggaagatgtgcggagacagacacctgggacacctaaggaccaagcccagagccacgctgctggtgagtgtgggccggcgcttcagtctgtctctatctgaagacacatccaggccttttcctcttccttgcttgggttgctgctcttctcatgcccctgctctcctggaccccacatccagcaccccacaccccacatctccctggcaaaatcccctctgacagagcctctcctgacgccccagggt

SEQ ID NO: 157155 - DNA, 314 bp, Homo sapiens
tgcctgtgtgtacgtgtgtgcctgtatgagaccatgtgtgcatgtgcctgggtgtacgtgtgtgcctgtatgagtacatgtgcgtgtgtgtgcctgtttacatgtgtgcctgtgagtgcatgtgtgcctgagcgcatgtgtgtgagtgcatgtgtgtatgcttgagtacatgtgagtgcatgtgagtgaatgtgtccatgtgtgtatgtgtgagtgtatgtgtgtgtatacattaaagaaaaagcatcaggcccatgtctgggttaatccacagcaaaaggaaagtcacagccagagaacgtgactcccggtga

SEQ ID NO: 157156 - DNA, 235 bp, Homo sapiens
cctgctgctctgtgaaagccgaaggtgctctgtggttttgggatagagcaggaaggagaaggacgaggagtgggcactggcaggtgactcaccgggacaggtggcacatgctgactccagggcaggtcccggctggggatgagattcccctttgtggaaaacatgggtggagggggagccatgcagtgctcatgctgcctgggtaccacccccttccaccctatgttttcccagg

SEQ ID NO: 157157 - DNA, 211 bp, Homo sapiens
aagcacaaggaaaatgggtgagttataacaacatacttggatgtctctccagatcaatgggagtggttaacagaaccacttgcaagagatgggacagtagcaatgctttcatatggggcaggaagttgcactggtcacaggcagcatagcactagtggacagtgccttcccgggctgcagagtcagacagtctcaaattaaaaacacaagt

SEQ ID NO: 157158 - DNA, 284 bp, Homo sapiens
ttactatgcatattgtatgaacaatccggtatggtggttttattatcccccttctcactaatgaagaaactgagacttggaggttttttttttagaaacaaagacaatatctagtacaccaacaatgagacccaagcaccttcactgtcgtctttgcagcccctgcattgttacttaggattgggacaccaacctgctcagctgagacccagaaatcccaacagacccttgcaactctggttgactgctcgagtgcagctgacaattgattacggggagtcaat

SEQ ID NO: 157159 - DNA, 168 bp, Homo sapiens
taatcatgttgaagaagaaaagaatgaattcattaggggaatgttctgggactgccagtcttccttcttggtgagaatttgacttttccagctatgtcttatttcatttcttgctgttccaaatttattttgaaataattgcattcttttggcctctgttgccttagg

SEQ ID NO: 157160 - DNA, 334 bp, Homo sapiens
ttttttttttttttttcctagtagagacagggtttcaccatgttggccaagctggtctccaactcctggcctcaagcgacccgcccgcctcagcctccaaaagtgctggggattacagacgtgagccactgcacccagccataaattcttcaactttaataatctcaatttgcttgtatttgaaatgggggtaacaatagctactgcctagggctgtgatgaggcctgaaaatgtggccatgcatatagagcacccaaagagtgctcgatgggtagtaatcactggtgcctcccatccagaccgtccttgtctttctaccaggaaatgatgctg

SEQ ID NO: 157161 - DNA, 310 bp, Homo sapiens
caccgagatgatacagatgtcagaattatctgacaaggattttaaagcagccaagataaaaatgcttcaatgagcaattaaaaacatagttaaaacaacaacaacaaaacaataaaaagaatgaaaatataaaaaaataaaaaaggtaaaaacatgcttaaatcaaattaaaaaatacaaagcctcatcaaaaaaaaaaaaaaaagagtctcagcaaagaaacaagatataaagagaaccaaatggaaattttagaacttaaaaatacagtaactgaagcaaaatagatgggttcaacagcagaatagag

SEQ ID NO: 157162 - DNA, 641 bp, Homo sapiens
aaaaaaagggcctcattttatgagaacatcattaaggcaatgaggcctcagcctgaatactttgctgttggatactatggacagggctttccttctttcctacggaataaaatcttcatctatcggggaaaggagtatgagaggcgagaggacttcagcctgaggttgttaacccagttccccaatgcggagaagatgaccagtaccacgcctcctggggaagacatcaagtcgtcccccaagcagtacatgcagtgcttcactgtaaagccagtgatgagcttgccgcccagctacaaggataaacctgttccagagcagatcttaaactactacagagccaatgaagtgcagcagttcagatactcccggccgttccggaaaggagaaaaggatccagacaatgaatttgctacgatgtggattgaacggaccacgtatacgactgcatatacctttcctgggattctcaagtggtttgaagtcaaacagatttcaacagaagagatcagtcctctggagaatgccatcgaaaccatggagctgaccaacgagaggatcagcaactgtgttcagcagcatgcctgggaccggtccctctctgtgcaccctctctccatgctgctcagtggcatcgtgga

SEQ ID NO: 157163 - DNA, 740 bp, Homo sapiens
aaaaaaagggcctcattttatgagaacatcattaaggcaatgaggcctcagcctgaatactttgctgttggatactatggacagggctttccttctttcctacggaataaaatcttcatctatcggggaaaggagtatgagaggcgagaggacttcagcctgaggttgttaacccagttccccaatgcggagaagatgaccagtaccacgcctcctggggaagacatcaagtcgtcccccaagcagtacatgcagtgcttcactgtaaagccagtgatgagcttgccgcccagctacaaggataaacctgttccagagcagatcttaaactactacagagccaatgaagtgcagcagttcagatactcccggccgttccggaaaggagaaaaggatccagacaatgaatttgctgtgagttcaccccttttgtcctttaagaggtaaaattaacgggctgagcacggtggctcacgcctgtaatcccagcattctgggaggccgatgcgggcggatcacgaagtcaagagatcgagaccatcctggctaatacggtgaaaccccatcggtactaaaaatacaaaaaaattagccgggcgtggtggcacgcacctgtagtcccagctactcgggaggctgaggcacgagaattgcttaaacccaggaggcggaggttgcagtgagctgaggtcgcaccactgcactccagcatgggcgacagagcgagacttcgtctcaaa

SEQ ID NO: 157164 - DNA, 312 bp, Homo sapiens
tgctaccacagcgttcggcgggcttttttttaaaaaaaagcacaaatgtctgatacaatgtataattcctattaggaacatacaattaagagtctgtagtaaatactttcattatgaaaggtacagagtacagaataatgaaaaataattcttacctattggtatttttgtgaaatggttttgaaataccaactaaggaattttacatttcagtgacacgaaccgattattatgtatgtctgctctcattagattacagtagtacacatatggtgacaacacatcattgaagttaacctttcattacaatga

SEQ ID NO: 157165 - DNA, 261 bp, Homo sapiens
tttattatgttaaagaagtttccatttgtagttttttgagagctttttgtcatgaaagggtaaagcttttagtctttcataattaagtatgatgtcacctgtgagcttttcatatacagctttattttttgaaactgtttcttcttttcctagtttattgaacatttttatcgtaaataccatcaaatgcttttttctgcatcaattgagatggccatatggttgttgtccatcactctgttaacacagtgtattgcactg

SEQ ID NO: 157166 - DNA, 718 bp, Homo sapiens
cctctttgcattcttttttttcaaaccaagggtatgtcaggtaaggtagaatccaggttccttatcagaagattttctaacgtctcttctaaaaggtgacaaatggaactgaatatttaatccaactttaatctagacagggcaaagcagagtttggatgctgcttctcagacatctgggcttgaaacactcatacccacgtctcaggagctttcctccactgtccaaatctgttcactcctgctaatcccttgcactctgtactgccaactgacatttcttaccaaagtcctccaagcacctcaaattatctaatagaaaatcaaaataatttccccaaaacccgttcctcctcattctgtgttcaatgccttgtatgaagactccacaatttgctcaattcctagcctatcaaaaggacctttccttggttctcatcattgtctccattttcaattgcaggtctctgtcttagcaggtctgtcacctcagctccacgatgattcccttctggctctatcactactgccccaatcacgtctaatgtgtatacctgacagtgataactccttccttgaaataaatttcaccatctacagaataaaatccaaactctttggcaagtctctctgggcccttcctaatgtgcaggagccaatctcccttcccaggctgcttgcccacctatgaaccatccccagttataccacagctggtt

SEQ ID NO: 157167 - DNA, 229 bp, Homo sapiens
cgcttttatattttatcagttgatgaatctcaaagtcttgccgtcttaagaaagggctttttcatcgagtgcttgaaatgtaggtttgtgagttgatcagaggcctcaaagcttcaggtgggttgaagttgcaatagataattctttgtattctgactttgaaagcgtttattttcacttcagtgtccaaaattttcacacacagaaaagttgaaaaagtgatagatac

SEQ ID NO: 157168 - DNA, 469 bp, Homo sapiens
ctcatgacttggaagcggtgggctgaggcctcccaagaccatctggcttgttccattgccagccagagtggaggcgacattcacacgaacccaggagctgcaggggcgcgtgagctacagctgccttgtggcatccaaggagtgcgcaactagtctcactctgttgcccaggctggagtgcagtggcgcgatctcagcttacttcagcctccgcctcccggtttcaagtgaattctccagcctcaacttcacaagtagctgggattacagccactttttatcttctctcctgcaatccaacccacataatttccatgaagaaagcggagtggtgtcattttacaacaagaaaactgagttaagaataagtccaatcaattgctaggtgttgagactgaaatggaagtctcttagtactccacccaaggattttcatattaaacaattatcttgtcatcattttatttct

SEQ ID NO: 157169 - DNA, 335 bp, Homo sapiens
  misc_feature (322)..(322): n is a, c, g, or t
aactttttctcagactcggcccagtccacataactctcagatggcccacgaatcagacttctccagatatttcaccaggggctggcatgtaggcatgtgacctgaactaagggcactgtctccaggtgccccaggagacacgctctgactgactggataaactttgaagttacctaaaagtctgacatctaaatggtggttttatttttaaaaggaaaatacacctcaacgctttatacttctgcttggttgttccttgacttggaatgccccctaacccagatcacctgtcttcaccaacttcaccctcaaaagctagatnaagtaacctgctt

SEQ ID NO: 157170 - DNA, 383 bp, Homo sapiens
agaccccagcacacagctccgtcccccagctccccttctgttttttatcctccagaatgaggggcttccctctttgaccctcattctgcctctctggccccctccaccgacttgattttccctgggccttcatgcttcattctttgtcactccgtacctccatatgtctccttgccccacctatgtgcccatcagggaatccatcaaacaagaccttccagtacaggaccctctcctcttactcagggggcatcctgggggttttctgttgtttcttgagcttgccccttgggattgtatgccccactctggaaagcttctgcccaattcttacattaacttgcatcagctgatggacatgtactaactgttcctcctttata

SEQ ID NO: 157171 - DNA, 370 bp, Homo sapiens
ggaactcttccctgttcctctgcctgcctccttaagacctaaatcctctggcttagaaggtaccataagctgctagctagtagctgcatggttccctgacccctgattcccactgtttctgacacagagggcactcaacctgcccatgggcctatcctgagcctgagctggttggtgtgggaggtgccagcttgcgtcatctcttaggctccttccccatgtcctctctctgctgctggttctgtgtcaattaccctcagcatatccctcctgccctccatcccttgggtcaagcagatgagaaagaagtcccattggccaccatttgcagagcatttacaggggctcactggctcctgaggataccccc

SEQ ID NO: 157172 - DNA, 616 bp, Homo sapiens
gttagagaaagaattcaaatggtttttccaagtatgtaaggtgcctacaaaattacactataaaatttattctttaatagcctagttctttaccaaagcaattagttttcataagtcactccagcaaatcacaaagccagatgggtccccaattcaatcaattatctttaatctttcaactaagaaaaattgctctttatatactttgtctctgtagttctctttccagaattaaccattttggcagtgatgtatgcttgttagcaaaagtagatcctacacacaggtgagaaaacacagaattaactgtgaacactttccttcctagcaaggtgagcagaacactgaaccatgacttaacgaaagactgcccaagtcattcactggggtggaaccctatggtgtttatcacaaacatacttcccaccaacacggtggctttgcgctccactggccagtgctttttatattgaaatgagtcaaagaccagatccagcgcagtcaccatagttccactaagatttaagcgaggcaaaccattgtccctgccattctatcctaaatgtggtcataagtgggacagcagagaaagccacagtacttatccaaggttgca

SEQ ID NO: 157173 - DNA, 990 bp, Homo sapiens
cttctgtcatttaatttgcacaataatcctacaaggtagatattactgacatagaggttaatgtgaaatgagattcagagaggttattaggaacttggtagagcctgaactcaagtcctggcagtatgattcctgagcataaactaattagttagtttcttaggaaaggtgaaaggaatgttggaagttatattttaatatttatttcagtaatatctttttttatgcaaaactctgtttcgtaaacagcttttaacttaatgtagcctgaaagattggtaacacacatgtttatccttggtatctttttgtttgccacccttctacttaaatgtaataatgatggcagatcctctgcaagttatcattagaataacatttttaaatactttggtgtaattggaaattggcagaatgatttggtagattggattaggagtcagatttacaaaggctttgtctaagtagttttgaatttaaatgctatagggaacaactgaaggattttaagcaccaggattttaatccctgtgttcactctttgaatagatatttgacatccaggtattttaatgcttttccaatgaatatatttgtctgtttcctctgtagttagatagttcaggaaagccaaggtgtagacatgggatttcgagtccatagaagcttctgcttcttcatttttgttaaatgtgggacattagacaagtcatttgaaatctgtgatccacacttttttcatctctgaaagtgaaagcagtttgtaaactggatttcagtggaatgttttagttatttatcagtattggtcatgtgaaatctttaatttcctttagtgatcagaagatatttttctgtttttatttctttctaatgataacactcattttctctttattgggacttttttccatacataaattctgcttaaaaactgagattgctttaggaattacatgatcagccttgatggcttcgggaaataagaaa

SEQ ID NO: 157174 - DNA, 309 bp, Homo sapiens
tttactggaggcctactgtgtgccctgcataagcagttggggttccagaaggcatgcttagagggaggatggagagggaagggtgatggcttctggagggttgactaattttttaatctgttctccagacccaactgtaaggcttcccctgaggcatcaagtctctatctagccctggagtcttggttctggggttgatgagttgcagacatagctttcctctcctcctaccctgttccctccactctcatgcctttctcagttcatgccatggtgacctttgcccactgacctcacacacagcctgtt

SEQ ID NO: 157175 - DNA, 169 bp, Homo sapiens
agtgtgaatgccatcaaagaattataaaggaaaaggtagtgtgtccggccatgtactgatactcccaggagacccgggacagtccaattccccctaagtgactagctaactcagggaagaaatgcaaaaaggaagcatggtgtgtggcgggcacacatgtgactagtga

SEQ ID NO: 157176 - DNA, 315 bp, Homo sapiens
ctaaattatggataagattttagacaggtataacaaaataataacctagcagcccagaataatttttaacaaggatatttggcttaaagttattacagtattctcttaaacagccaaaacaggagattatatctaaatttgagaatagtaaaaggtttgatttttatcaccaatgagtataaccataagacccccaactcctaagaaaatttcaaaacctacctttagtaaacaacacttccaaaattccatacaggactgttagcaaaagaacaaataaacaaaaagaccccaccaaccatgttatccccgtag

SEQ ID NO: 157177 - DNA, 130 bp, Homo sapiens
actagcaaagagtagacatgcatgtttgtcagatgaatgacattttcactcagctcttcagaaaggcatctgttatataaagtattgctgtacttaaaaagttcaactgtacccaacaaaattgaccttt

SEQ ID NO: 157178 - DNA, 344 bp, Homo sapiens
ggaagtcagttaggggcaagcccagaaaccgaacgacactgacaagcacagaggcaagggagagcagattcacaaaaataactcatcgctgaggtgaactcccgatgctgaagtcctgaggtaaccttggattcccgatgacgtcctggctccagtcttcatgagacttctcgctcttgaagctcctgttcttccagaggcttggtgatttggcctctcctgggttcccacgaggccttttggggctgagatccctgttttcttcattccttataactccttcccctaatattatatgtaacttgagctgttcctcggaaccaaaagagcctgacgaaaacact

SEQ ID NO: 157179 - DNA, 377 bp, Homo sapiens
ttagccaggtgtggtggcgggcacctgtaatcccagctatttgggaggctgaggcaggagaatcacttgaacccgggaggttgaggttgcagtgagccaagattgtgccactgcactccagcccaggtgacagagcaagactctgtcaaaaaaaaaaaaaaaaaaaagagagagaaaagaaaagaaaaaaacccctttcagatgagtttctctctttattttttctttctgatctttaaaaaaaactccactctttaatgactcaatgtccagagcagacccaaacacacactcaggctctgcttgcatggtatgggcccaaagtgccacagctctggcagttgactcttctcaccctgggaatggtttctccaaaa

SEQ ID NO: 157180 - DNA, 485 bp, Homo sapiens
atgctccatgggtgactggtggaaggaccagaacgaagggagcaggcagagacctgccctgggcatcctcatcatcctcctcacactcagaaggcaggcacagaggcaagaccactgaaaagggtgcctggcctggtagacaatccaaataacctggtcccaccctttcttttcatcaaagtgattttactactcttactttttaaaaatttactttattgtgattaaacacaacataaaatttaccatttgaatcatttttcagtatatagttatttgacactgagttcattcacaatattgtggaaccatcactaccatccatctccagaactttttcaccttccccagctgaaactctgtatcgcccagcgtggtggctcacccctgtaatcccagcactttgcgggtgggcagatcacttgaggtcaggagttcgagaccatcctggcccacgtggcgaaaccccaactctactaaaaata

SEQ ID NO: 157181 - DNA, 383 bp, Homo sapiens
ttatacacttttgtcatttagttacccacctattccccccagtggactcccattctgggctcctgcagagggcttgtaagttcacctttatatccccagggtcagagctgatgctctgccgagtgaatggggaagcgccagaaagaacagaagctaatgatggactggctcgaccatggctcccactttcaatactcatccctctgtttcctcagacattttacttgaattaattttgtagttctccttctgaactgctgagcaagtatttggacactttgtgaggagccttttttttttttttttttttggggaaggggggccccccttgtgccccccaggggggaagcgagggggcaaaaccccggtcacaagggggccct

SEQ ID NO: 157182 - DNA, 1234 bp, Homo sapiens
  misc_feature (1063)..(1063): n is a, c, g, or t
aggaggcctgcccccgctaaccggctttttgcccaaatgggccattatcgaagaattcacaaaaaacaatagcctcatcatccccaccatcatagccaccatcaccctccttaacctctacttctacctacgcctaatctactccacctcaatcacactactccccatatctaacaacgtaaaaataaaatgacagtttgaacatacaaaacccaccccattcctccccacactcatcacccttaccacgctactcctacctatctccccttttatactaataatcttataaaaaaaaaaaaaaaaaaaaaaaaaaaaaagaaaaaaaaagaggtttggggcgcgcccggcctatgacggcgtccttgcggaagtacgggtgccgagagaagcagtagtcaataaagagagtgccgtatttcgcagattggagctgagctgtggctgccagaagatagcgaacgaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtattgggaaatgtggcaatgttgtttatataagtataccacattataagtctactggagatccaaagggatttgcgtttgtggaatttgaaacaaaagaacaagcagcaaaagcaattgagtttcttaacaacccaccagaagaagcaccaagaaaacctggcatatntcctaaaacagtgacaaaataaggcccattccagccttaagagttgtggaagagaaggaaaagaaaagaagaagaaaggccgaatgaaaaaggagaccatatccaaggcaaagaagaaaaccatggacacaagcaaaccagcatcagtaaaatgaaagatccagacccaag

SEQ ID NO: 157183 - DNA, 1152 bp, Homo sapiens
  misc_feature (1067)..(1067): n is a, c, g, or t
aggaggcctgcccccgctaaccggctttttgcccaaatgggccattatcgaagaattcacaaaaaacaatagcctcatcatccccaccatcatagccaccatcaccctccttaacctctacttctacctacgcctaatctactccacctcaatcacactactccccatatctaacaacgtaaaaataaaatgacagtttgaacatacaaaacccaccccattcctccccacactcatcacccttaccacgctactcctacctatctccccttttatactaataatcttataaaaaaaaaaaaaaaaaaaaaaaaaaaaaagaaaaaaaaagaggtttggggcgcgcccggcctatgacggcgtccttgcggaagtacgggtgccgagagaagcagtagtcaataaagagagtgccgtatttcgcagattggagctgagctgtggctgccagaagatagcgaacgaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtattgggaaatgtggcaatgttgtttatataagtataccacattataagtctactggagatccaaagggatttgcgtttgtggaatttgaaacaaaagaacaagcagcaaaagcaattgagtttttaaaaccacagagagccagaaactggattttctaaaaaggaaatagncattcagcttagagttgtggaggagaaacggaaagagagaaggggatgaaaggaggattcaggccagagaattgtagcaccgttt

SEQ ID NO: 157184 - DNA, 595 bp, Homo sapiens
cggtcctttcagacggtgtctgtgcgttgataaaggatgggcctgtccccaggaccctgtgagagggaagcccaatgtcccaccaggttggcagggctggggaagggaaagtgttatggcagccccaagaaaaaaaagaggcagcagagggagcaggacagcgctcacatggaactcatgccactgcctgaatgaggggagggaggagtgcacgccagtgacgtcagggggcagagaggcgcagttccagggcggctttccccctcacttcctgccatgttactctgatcgcctccaggtgagcctgcccactttgtgcccaggggcctgtagaaaaccacagctccccatggttatggccccaggagtggggcagaacaccgtcgaaggacggggttttgccatgttggccagactggtctcgaactcctgaccttgtgatctgcttgcctcgggctcccaaagggctgggattacaggtgtaggcctccacgcccggcctcacaaagtttcttaggaaaattaaggtatagataagagagagaatggagacactgatgactcttccaaattttcatagccagacaccaggaag

SEQ ID NO: 157185 - DNA, 625 bp, Homo sapiens
tttcagtggctcagtagccacacacatgtggctagtggtggctgtgttgaacactgcaaatagagaacctttttttccgttatcacagaaagttctattgcatagcactgtagtataaattaatgacaattactacaagatttcaccaagtttatatattctgaaagttggagaatagagtgcaagatatttgttctctggaattcttaggtgggaccttttacaatggttaacctgtctggtaggggacaggaaacttttaaattatagagttcttgctgtgtccttatttgttgttcacaacagccaggccaggcagttagtattatctccgttttatcgatgagatcaaacctgtaagaggaactgtaatttgaaccaaggtttgtctgactttacatcctctattttttgttcttattttggactttaggggtgttgctgaatggattataatccctagttcatggtgtattgtcattagatatcaaagacccttttcttcctcacactcctaggcaaccattttaatgtgtgtttgatttatctttttttaaaattttttttaaagtgaaagcaagtttattaagaaagtaagggaataaagaatggctactccataggc

SEQ ID NO: 157186 - DNA, 241 bp, Homo sapiens
ctggggaaagggcactcaatgctccctgaataccaagatccattatgctgctgcagccaaaacaggaaataaataatgctggacatcatcaggcagaggatttgaaacagctttcctctgtggcatcgcagtgttccaggacttcgttatatgagctgagcctaccttgccttctcatctctggaggctcttcacttcactctgctcatgtcatcactcctgtgtgtctcagacttccact

SEQ ID NO: 157187 - DNA, 523 bp, Homo sapiens
agtgctttaacagaatgcctggcatgagtaagtcctccataaacatctgtggaataaatcagtagtagagattaagaaatggcctcaaagaaggacacagacaaacatggtcctggttctagaggaagctaaatgtgttcacttttcctgtgagctttacacaggagtttctgcaacataaaagagatcacaaggccagtaccgatgaagcccttgatcctgtgcttgttacctgggaaagactgacagtaataccttaaaaatcattgtctctgtgacttaggagaaacaggacaaattatcctagcatgaaatatagcccaagaatattgtgggaataacgcagattgattttttttctcttttctgaattcacatctgtatccctctttcagatatttattgactgctcagttcagtcccttttcatatagagaatgagggtatatttcatttgttcaaaactacaaaaataatcatacctcttatctttcaaataaaaatcaactttgctctcaacatg

SEQ ID NO: 157188 - DNA, 333 bp, Homo sapiens
ctccccacctagtctggatgctggagtgggccagaggtggacaggacaatcatcctgcagcttcctcttacctcctacaagatctggatttttataccagccacctttcacagaagtccctcccactcctcacatgtgtcccatgttttcatttgagggagctgtttggtttataaagggccctgggaacaaggggtgttgtcactgagcacactcaaggagcagtctgatgggcacctgtcactcagagtagttaccaaatgtgcacaggaaggataagcatctggttggggaaagtggttatctctggcaatggagacaaggtagagccga

SEQ ID NO: 157189 - DNA, 418 bp, Homo sapiens
tgagcggtatttgccgagtgatcatgtggatgtggagatgagaaaactgtgggcccaagaagggacagggctcgccagggccctcacagcaggtcaagcatggacctggtgctagagcctccatgcttgtcccttgctcttttgtcccatgctgtctttacctgttacctgctaggatccccaagttctctgtgcacaggagtcccagtggcctttctccaagttcttttggagcctgtgaatccccaagagaccgccggcccctgaagccattgaattatgcatgtggtcatttgcttgcatgtggcgggactcacagagcaaggaatccacttccctgagccaccctcaacatgaatcattccacgttgcctccagcgccaggttcctctcacttcctggagctctcaagtgcctt

SEQ ID NO: 157190 - DNA, 464 bp, Homo sapiens
caggacatggagggtgggaaaggggggatggactacaggaatagcttcaggaagagaagagtgccaagggaagagcaggtacagaggaactggtgttcaccccccgaagacatctggggcaggcaaagggaaaatcagacaggtaggcaaagacaagggctgcaaccataaggagtccagacttgatcctcgggagcttcgggcaaaggagtagcaaacttggatatgcgttttggaaaaattacttattttattaaactggagttggcaaacattttctgtaagaaccaggtagcatatattttaggctttgtgggccacacagaactgctgagtactatttttgtttaagcattcctttaaaagtgtaaaaatcattcttagtttgtaggccatacaaaaacagtccacaagcccagcagtgtgcccacctctgttagataatatcaaggaatcagagctaa

SEQ ID NO: 157191 - DNA, 664 bp, Homo sapiens
tctgccatgccccaggtcatgctacggactccgccacaccccaggccacgttactgcagacgccaccacaccaggccacgctgccttttccagccacagtcccagttaagcccaccctgagtgccgctcccacctttccttccttcagctgctgcagaaagggctgcaggtatgaggatgcccacctcagccccgtgtgtgggaccaccacccagtggcaggggtgggctcggagcagccccacagtcaagtcacacacagagcagaggccagggggcaagacgcccaagcgtcaccgaagcaacaaccgcgtcagcatcccagcagctgagctggcatgccgttaacgtgagaaccacatcggcatcccagcagttgagctggcgtgccgttaacatgagaactacattggcgtcccagcagccgaggtggcaagccattaacgtgagaaccacactggcatctcagcagccgagccggcgagccgttaacgtgagaatcacatctgtgtcctggcaaccgagccaggcatgtcattaacatggatacaaagagaaatgactacaaatacacaagtgctcaaacctctaagtgaacactcagtgtcctcagatgacaaatgatcatctcacattcacgacagtatcagtgcctgtgcgtgacc

SEQ ID NO: 157192 - DNA, 447 bp, Homo sapiens
agctgactgctggttcctggcagcactgggatccttgactcagaacccacagtacaggcagaagatcctgatggtccaaagcttttcacaccagtatgctggcattttccgtttccggttctggcaatgtggccagtgggtggaagtggtgattgatgaccgcctacctgtccagggagataaatgcctctttgtgcgtcctcgccaccaaaaccaagagttctggccctgcctgctggagaaggcctatgccaaaacaaaagctgcagccaggacttcctccactgccttctaccctgtgaagggctctgcctctgcctgctcaccggggacaggaacgtgtaggtccctggcgagaagcccaagcaacagaggcagcagctgctcggatcctattccgatctgcactatggcttcctcgaggatgccctggtggacctcacagga

SEQ ID NO: 157193 - DNA, 689 bp, Homo sapiens
atgcggcctgtacctcttttaaggaagaagccatcaaaggatcactttctctcttacattatctacacctggcatgaggtctgggtgggtcctcagtgtctgctgactcaggggacaatcttcacatatacagggcaaaaaagacaatagccaggaccctggttgtaaccattagaaacatccctacccagcactggggctggtgacatgatcttgagctagggggagtagggaggcagtgattttgtaagacttcttcctagcctgagaaaaatccagcaagaaaaagttattttaggtcccagaatacgaggctgaactgagtcctccaaagagaggttaagatagaaagttaatgaaatgttcatttcaaaaaaactttgcccaacccacggtttgcaactcccacacttatcctggtaccagtgagagccatctccaggcccgggtagcagtaggcagcgtaaacccgttggccagaatagcatatccacgtctgattgtcaagtggaggcagccccgcttactggctctactagagacttgctggttatttttaacacaggccctcacacctgtgcccactcctcctctccattcctctggccccgctcctaacaaacctactcaacattcattccccagggttgtatgttcagcctgtgtgcagcacctctctctcaactgga

SEQ ID NO: 157194 - DNA, 244 bp, Homo sapiens
gcttggtttcccatgtataaattcagaaaaacatcacctacccaatatagaggtgattattaaatgcactatcctctagaagctgtggttattaaccttgactacacattggaatcacctggaaccttataaagtccgggctgggtgtggtggcttgcacctgtaatcccagcactttaggaggtcaaggtgggagcatcacttggggtcaaacgtttaataccagcctgggcaacatagtgag

SEQ ID NO: 157195 - DNA, 242 bp, Homo sapiens
caggaaacaaataaattggggaagcagaatggacacagacaatctggacctcattcaggagctctggactgaagaagaataatgctttcctgataaaacccaaactttcactttgatgggtctatgaaaaagaaattagggccaattcaaacctgaaagaccaggcttttgagacacttcactgaaagcgtcaggacggtcagtaaagaaaggcaggattactaatgtctaagagatttcta

SEQ ID NO: 157196 - DNA, 365 bp, Homo sapiens
tctgacattaaagagtcataagactgttttaagaatttatttggggatctcctggggctgtatcacagggggaaaagtgaaataaaaaaaaaaaaccacaatcaatttgggctgggtgcggtggctcacacctgtaatttcagcactttgggaggccaatggcgggcagatcacgaggtcgcgagttcgagaccatccttgccagcatggtggagccctgtctctactaaaaatacagaaaaattagccgggcatggtggcgggcgcctgtggtcccagctgctcgggaggctgaggcaggagaatggcattgaacctgggaggctgagcttgcagtgagctgagatcgggccactgcactccgg

SEQ ID NO: 157197 - DNA, 202 bp, Homo sapiens
tggtttcacctctgatgttgcctcctctgaaatgcctctgatcaccctttgcagggatcaccccaattgtcttgattatgggtccctgtttattttctccacagtttgccaaatgctgttaatgtgtttccttcgggtggtttctatccatctccctttatatcacagcagcatttgggccagcttcattcaccacgaatgc

SEQ ID NO: 157198 - DNA, 404 bp, Homo sapiens
ggcagttttgcctttcccttccatcatcccctccccttctctgcagatttctggaatttccaggggaagaggaaggagtacccagcaactcgctctcacagtggcccatgctcctggctccttccctaaccttaccatgaagatcagcaccatggactccaaggtgacaggtcacccctaaaaactcctgcagcaaatcacttagtgagctcccacctggccaccctgtggccacattgacaaagtaaagaactgaggcgctgagagattaaattacatagcgaatgtgtaagtaaaaatagaacagcaagtcccaaacttcagagatttgagcactgccttcatgaattttgctatatctgagtgctactgtattattattaatattttaagaatcaatatgt

SEQ ID NO: 157199 - DNA, 648 bp, Homo sapiens
acccactcccagcgccacgccttcgcagaggcggcctgtgccatcctgcacagctctgtcttccaggaatgccacaggctggtggacaaagagccattctatctgcgctgcctggcagccgtgtgtggctgtgatcccggcagtgactgcctgtgcccggtgctgtctgcctatgcgcgtcgctgtgcccaggaaggtgcctcacctccctggaggaaccagaccctctgccctgttatgtgtcctggtggccaggagtaccgagagtgtgccccagcatgcggtcaacactgcgggaaaccagaggactgtggagagctgggcagctgtgtggctggttgtaactgtcctctggggctgctgtgggaccctgagggccagtgtgtgccccccagcttgtgcccctgccagctcggagcccgtcgctatgcccctggcagtgccaccatgaaggagtgcaaccgctggtgagggcagcgacctttggggcaagaggaagaatgtgggggtgaagaggtagcttgggagataacgggtggggtgcagccttgttggttgcagcgtgcatgctgggggtgacagagtgctgatcacttcccctcggtcgtggggcactttagggtccataaagcactttcgtgtgcatca

SEQ ID NO: 157200 - DNA, 423 bp, Homo sapiens
ctttccagagtgggcagccaggcagaggggctcctcacgtcccagacgatgggcagccaggcagagacactcctcacttcccagacggggtggcggccgggcagaggctgcactcttggcactttgggaggccaaggcaggcggctgggaggcggaggttgtagcaagccgagatcacgccactgcactccagcctggacaccattgagcactgagtgaaccagactccgtctgcaatcccggcacctcgggaggccgaggctggcggatcactcgcggttaggagctggagaccagcccggccaacaccccgttagcctattcctgagtagaaaatggcagccttccgttttcctaccagccaccacctcgccccagctatgggttatttgaactgtttgttggactttggggagacctgtt

SEQ ID NO: 157201 - DNA, 234 bp, Homo sapiens
taacccttgtttctccccagtgagctttggatttgcacatccacctgcctagtacacttttactataagtgatagtcaacatgtggataagaacttgagcattggagtgagacataaggctgccaggtctgccgtttaatagcttaatggccttaaagaagaaagtctttatgtggctcagcttccactctgtaaaatcatgaaacctgtcacgtaagatttatgtgcgggtaa

SEQ ID NO: 157202 - DNA, 1103 bp, Homo sapiens
aatggatggtccaaagaaaggtgaatgaaagagtcataaaagatgttgaggtagttctctattgatgccagaatagccctatggtgcacttttgagtaacagaagccaatttgttaaaaacaacaacaacaacaacaacaaaaaaaaaacagagagagagagatgaatgtgcatccagatgcttagagaagagtctgaatgtctgtatactaaatatcaacactagttactctgcgctgtgggattttggatgattttaatttgatccagtgttttctggaaaataaaatttcactacattgacacatcatttgataatcagataaaagaacaatggtgggaaagcaaggactcaagtgacccttgcttttgggtctagagcatcatgtaggaagccagcacagcccatccctttcctaggcgccaccttctggctcctggtgggacttgtaagtcccgtggtcagttacctgattgctcttacggacctgacgctggaaatcctctctctccaaggtccctgcaggagatgggacctgccacagagaatgccgcaagggatgtttctgttgggagctgtgagtggggtggatgtcctctgcctctcttaaatagatgagctagattgaacctggggctggccaaagggagtctcctctcagaaaccaggatgcagtgggccgtctgtgtcccagccccaaagcagccagggtccagtggattagcacagagccgaccaggcctggagggtggtggtctgggattgggtgagcagccaccagcaggaatagcaattggagggaaggagaagcattgccaagagcaacttagggggccgtgagtgcaggtctctggacagacagcatggtaactggctgaggcaggaagaagcttggtgggctcccatggtgctaataataggccgtgtaggagcaggggaggcagctccagacttggagtgaaaagacgtggggtgcagtcagaatgaactccccagccatccatgtggtctcaggcaagtcactctgcctccagagccccatgtccactcctataagatggtacatccccacagtgccctgccacaggtgattataggtgaa

SEQ ID NO: 157203 - DNA, 631 bp, Homo sapiens
cactcaattcagccagagcagctctcttttaacctatttgatatattgcacattgttataatgttttggttagaagagtttgtttcatgattaaaataagtttgaagaatcattgctccgagttgttcgattttttttttttaaccttttcttttttttctaggtcaaaccagacattgagatcactggctttttggataccttgtgttggctgcatttcttgtatatttggataccgagtgttggctacattggataccttgtgttggctacaattcttgtagaatgttttctactgaatcatactttaagtactttgaattgtactttggcttgcattgagggataaaaaggggtggttaaaactcacttctgtgtttatccttgttggagttatccattacattactcactgacccattaggtttcagcgaggatgcagatgtcacataaagcttcacttctcctcaatagctcttagacaatgtttatcttatggttgatatttcttattcatcttatgccctttgatttattggttttgtaccttgcttacagggcttttatagtttatttttgaaataaaccaagaagttgagtgtgcctctgtggccatttccagccatataac

SEQ ID NO: 157204 - DNA, 295 bp, Homo sapiens
ctttctccgacataaatctgatcatacacacacacaaacatcccatatatttgatgtcaccctatccatgtccatgggttaatggccacagtttccatggctgagcctgagttgagccaggtgagtctcagacataccgtggtttagcccttccacctgagcacctgtggcttgcagggttctcgatgcttggtctgagctggcatcctccctgcctagactaccccctcagtgccagctctggcctgcctgtgtgcgtccccacagtgccttctacctggatcacccccttcct

SEQ ID NO: 157205 - DNA, 318 bp, Homo sapiens
gtctattccagatctaagacccacacatgcaaacccaagtgcatggctccctgggtacagtttgtaacattgccagtgaaagtcatgtctcttcattgtgagtaaatcacaccgttaaaactctgagtacggtctagctgattaacgtcaggttaatccagatcctttattctgtattccagttactcccagctcccaggcagtgatggctttaccggcccaggaggtccccgggccctgctcattggatctttttggtgggatacaccccacagaacacagaaaacattcccttttccgtatccatacataggagtg

SEQ ID NO: 157206 - DNA, 488 bp, Homo sapiens
ttgaatgcaagtctcattttagttgtattataaatgcatttcagcttagcttaaccatttgagttttgatacatagtccttgtatttgtcatttgtttctaattaaaatttcaccagtgactccctcattgaccaatgagttttaggagtatatttttagctttttaaacatgcttttcctatttatattgacagaaacaaaatcatgttttggttgaagttgttggatgtcttagatttcttcatgcctattggtattttgctctgcaggtttggagtgtgatgccttgcttccttttaactatgcttttcctagctagcagtactatagctcaccagaattatgacctccttggcagttttcactttctgccatataaattgacttgtaatgagctttgggattatgttagtagacttggctctattgctggtctggaggctctgtctttcctttagtctctgtttctcactctactagagtgttg

SEQ ID NO: 157207 - DNA, 555 bp, Homo sapiens
aagtatgctccagtcctcctttggaaaaggcagcctgtgtccagagccagcttgaggtgactacacagggtgagccagctttccaagcctcgccatcatcttgctcagatggaggtaatgatctccatcctgcttccccaaaatgccatgaagctgaaagacttggaaaacttcagtcagcaaatatgggtcagtgatttcacactgaaaagttggggtttcgagcacgactgtctaagggttcctcacttgctctgggtctgcatcccacaccctggaaaagcttcctaccattctacaaagtggggtcactgtcttgacaccctaaattctcaaaggtcagcatagcggtggttttggagaccatcttttcttctgttttgcttgtcagcagaagtgagaccaaatgccttgctcacaggaagtgctggtggggcccggggcccagctctgtaattcaggcagacatggattccagctctccttttgccagatgtttcctatacatctgtgctgtcccaggccctgggagtatactgctgtaccagagagaac

SEQ ID NO: 157208 - DNA, 621 bp, Homo sapiens
ctgatgttttggaaacgctgaaaagtcataggcctctcaggggttgcacgactccaggctggggtcattgattcattatagcattttcattttgcagacaaggaaatttagttccatagaggtttaggtgggttacacagggtcacacagcttctcggtaaaagagccaggactctgacctggtgccttgactcagggatgaatgaggaacaatagcaaatctagaacccctggttgatggttttttaagtttgagggggtataagggggaaattagatcaaaactttaatatttgtattgtacaggtcattaaaggcctcgattctgatgccagctgagtgaatcactctgtagcccacagtttaacaatgtaatctactctgctcaagttgattgtcttcattttgcatggaggagtagagattgcatgtagcagatgatgtgaacagtgcacagcttcaagtattatttattgttcccctcaaggctctgtgtggtgaatgaggcacagatagaattagaggccttggcttgattccttgaggtcacaccccctttccttctgctagacagccagcagtcagccacccaccctacaccatgatgtgatgagttccgtg

SEQ ID NO: 157209 - DNA, 194 bp, Homo sapiens
agggggagagaggaagcagtgtaactgtactataacaactataactataactaatatgtgggttgcatcacttcaagtaaactttggactgtgtgcggtcattcatgcctataatcccagcactttgggagtccaaagccggagtatcacttgaagccaggagttcaagaccagcctgggcaacatagtgagac

SEQ ID NO: 157210 - DNA, 154 bp, Homo sapiens
gagggctgcggccgccgcagcgggcacggccaacgagctgcgggcccgggatcgcggcggctggacggggctggagctgtcgggagggcggagctacagggcctgcaaggatgttggctgtcccggagatgggcctgcaggggctgtacatcgg

SEQ ID NO: 157211 - DNA, 474 bp, Homo sapiens
gagggctgcggccgccgcagcgggcacggccaacgagctgcgggcccgggatcgcggcggctggacggggctggagctgtcgggagggcggaggtgagttctggggcgggggctgccgggcgccccgagtggagaaaggcgaggaggtttgccgtcccgggctgtcggctgagaccccaccaaaaacctccagactttgtctggtggggacagatctgcaagcccctctctgcagcgtggctgcgggctcgggaaggcacttggggcagcgaccttggtctcccacctgggcttcgggggaccacctcccctgtccctcgcacagctgctcagaggcttaggctggagaaactcctgtgtcttaggggctggcaggactggtgtgggctggggcctgctccagggagccaaactgagggacccggtgcctaggtctgaggtggaaacctgggagttgagtgtatgtgtgtgtgt

SEQ ID NO: 157212 - DNA, 142 bp, Homo sapiens
gcgcttcacagaaagtctaagggaaaagacagacaaacacacctgcttgggccctccttagcacaagttcgtatgtccctgtctcttcactcattcaacaaatattttctggttatctacagtgtgccagccactgtcacag

SEQ ID NO: 157213 - DNA, 442 bp, Homo sapiens
cgccattgttcctgcatggctaagtcccgggttcgtcctaattgagctgaacactagtcactgggtgccacagttctcttccatgacccacggcttctaatagagctacaacactcactgtatggcccaagtccttggaatctgtgaggccaaggaccccaggtcagagaacaaaaggcttgctgccatcttgggagcagccccaccccatcttgggagctctaagaacaaagacccgcccataacagagtgaagtggtgtgatcacagctcactgcagcctcaatctcctgggctcgagccaccctcccacctcagcctcctgagtagctgggatcacaggtgcacgccaccatgcctggataatgttttaaaataaagcataaggaggctgtcagtatgtttgccaggctggtctcaaactcctggctcaagcaatcctc

SEQ ID NO: 157214 - DNA, 498 bp, Homo sapiens
gtacagcagccactatcctgtctcttccccttgtcacctctccctggctgagccaacttgctttgcgttaactacctttctcacacatccccaagagcctacagaaaaggtctatgatcttggcttgttactaccaaatcatctcaaacctctcagcatctttacctactcagttaagtaaggaaactcacaattccttgagtagttcctgtagccctctcccagcctgaatggctcttcctggtgttgccgatgctaatcaatgactgaacacaggactgctgtctctctcatttctctgacctagctggcatatctttactttcttccctcttggcttctaatgaagacaaaactgcattgcctaattatcctttagaaagaaaaccttaacattctttaatacttgatctcttttcaatgccttctatttgtttctgtaattcagctaaaaatagttcagccattgaaaaaaatagattccaataaaacatattg

SEQ ID NO: 157215 - DNA, 470 bp, Homo sapiens
cccccaccccacccgcccctcccccgcctccccagccatctgtggcgttggcagcagcagtgccagggcggaggagggttcacgctgcacctttaccagggtaggactggccagcctgggctctaccgggcaggtcggtgggatgcttcagactggagggataggcagggggcaacactggtcctcctgaagccaccttcccttcctgagagctccttggggagaaggcaagccctggaagccaccgactgggggctcgggcagagcaagggcagggtaaggggcagcttggccaggaggcacccttgggagccagggtttcctcatctgtaaaatgtgactctgcgagggcaggagcttggtttcactcgctactgtaccccctggggcctacagcagggctggttggtacacactaggtgtctaataaatgttgagggattgaatggatggaccgatgaaaaggttgg

SEQ ID NO: 157216 - DNA, 221 bp, Homo sapiens
atgtataaactgtttttcacagtgagtcagctgacaacacaaatgaagtaggatggctagggaggcagagtcagtgatcatgaacagcagtgcttggttttgtgtgtttcaggtcagggacctaccaaacctttcctaattccttccgctgcattaaattctttctttatttgagcctctaaagcattttgttcataccttaaaacctgctttctactaga

SEQ ID NO: 157217 - DNA, 530 bp, Homo sapiens
gttcttattctttattctctcttttgtctttctgcattgattcaaataattagtctttgagctctgagattctttgctcagcttgccctgttgtgttgttaatgcctccaaccgtattatgacattccttgtgaatttttcacttccagaacttttccagttttttggtttagttctttcttaaaatggctattgcatctttcaattcttggatcattttactggattccctggattctttggattgtgttgtgactttcttctagatctcattgagtttccttgccatccaaatttctaaattgtacatctgtcatttcagccatgtcaatctggctaagaagcatttctgggaaactagtgagatcatttggaggtaaggagacacttagactttttgaattgccagagttcttgtgctgattctttctcatctgagagggctggtgttcctttatctgttttagaaattgctgtcatttgggtgggatttttatttttatattctttatttatcttaagggtttgac

SEQ ID NO: 157218 - DNA, 451 bp, Homo sapiens
gtgaatgttgtgccataggaaagctttatcacaggtgcacgttggtagccaaccaaataacgtgagtgtcaagtacagtatctagtgagtggagaataactgtaataattacaattacagttgtagttaaagtgaagtttgtatcaaaatttctgtttcaaaggtgaacttttagggggtgtatctgcagtgtttcctcctcagatgtgatttctctgaagcagtggttctctataactgacttgacacacagtgcatctgatatttcgaatgacttaagtgatagtatcaaaattactatcatatacatatttaaatcacatgactaacttgtgtgtggtattatgcaaactgctcagctcagtaagggaacagaaataagaaaaaaaaaggacaatattgggagtcttttatacaattaaatttgttcgattaaaggactatcctttct

SEQ ID NO: 157219 - DNA, 464 bp, Homo sapiens
gcgtatgactttagaggatcccagatgatgcatagaaccgggaggcggagcttgcggtgagccgagattgtgccactgcactcccgcctgggcgacagagtgagactaaagaaaaaaagaacagtctcttctcctggaaaactttcttgggacagtcccctccccactcaaccctcaggttttgtttttttacatgtatttgtcctctgtgtgtgtgtatgtgtgttactttgttggtcccttcggccgtgttttggctattaggaaggaggagtgtcgtgcatgttcccatagcagcctttgtgtgggtagtttcatgtctcttgggtcgatcctgagggttcgactgcccggtcacaaccatgttgtggttgtgtctgactataaaatgcggccgtttattttccagagtggctgtgtccccttgcgtctcatccatgatatgagggtttccagcattgtcg

SEQ ID NO: 157220 - DNA, 401 bp, Homo sapiens
ggtgggtagcaataaagattgcatggctcaaaaagcctaaaatatttactatctggcccttcacaaaacaagtttactgacctctggccgattgtgtggtctgttctggagaatgttgcatgtctacttgaaaagaatgtgcattcttttgtttctagtgaagtgttctataaatgtctattagtttaagttgcgtgatagcgcacctatggtcccagctacttgaggcgctgaggtgggaggatcgctggtgcccgggcggttgagtctgcagtgagccataactatgccactgcactccagcctgggagacggagcgagaccccgtctcaaaaaatataaaataaaaaaataaaaaaattatcgagaatggaatattgaaatgaagtattgttgttgaa

SEQ ID NO: 157221 - DNA, 311 bp, Homo sapiens
  misc_feature (10)..(10): n is a, c, g, or t
gtatgtctcnttcgttactggccaggctatattttctcctccattgattcaaatgctgactttattatatattaatgtctacaaaagtatggatctacttctggactctgttctcttccactgatttatcagttttaccagtatatccatataccacaaccaaactgtcttaattacaattggcttactttttttttttttgtgacagagtctcaccctgtcagcgggctggagtgcggtggcacgatcttggctcattgcaacctcccactcctgggttcaagcaattctcatgcctcagcctcccgagt

SEQ ID NO: 157222 - DNA, 436 bp, Homo sapiens
ggaggtaacagtggttcttaaccagagctacacatgacagtcctggaggctctgaaaataatacaggtgatgccacttatatgaaatggccagaaaacgggaatctatagaggcagaaagtagatgagtggttggctttgggggtggggggaatggggattaactgtaaagaagtatgaaggctctcatttggggtgacaaaaatgttctacaattgggttgtggtgatggttacacaactctgtaaatttactacaaatcattgagttctacacttaaaatgagacattttttgaaatatgtcagacacagaaagatatataccacatgttctcattcatatgtgggagccaaaaaaaataacgtcataaaagtagagagtagaattgtggttattagaggctgggaagcatagggtggaggagagatagggaga

SEQ ID NO: 157223 - DNA, 313 bp, Homo sapiens
tagaggatccccggcaatcaccagcgatggaagctagaggaatgatgagattcttcatagatccttgtacttacatcgagtaaactatgactaaatggtgtttataatattaaataagcataaaaagtgatactataaaccctagaaaccatatttgggtctagtgggcagaagtcaaatgaaagaactgagattgctggactactgagtttggctttccataaattcatgttggaagggaaaaatccccaaggcttaattcagtttccatattaggttctcatgccgctgtgtattccgcgctggtattccg

SEQ ID NO: 157224 - DNA, 330 bp, Homo sapiens
agccacaggaagggacaagcgcgtggagggagaggagagagggcagaagcctgaagaatgttgacactcaggcagcggaaagaggaagaggaaccagggcagcaaaggcgcagtcagagaggaagggaaacagaggccatgggagaacagacatttaccctcctagggggcagggtccagtctctttcttctgcatcattcccgagtctaacaaggtactaggcatagagtaggcacttggcaaccgctgaagtaataataaaaagcaattatgtgagagagaccaacatgtgagtgatttctaagatgcaaagaaaagaaggtaaaggc

SEQ ID NO: 157225 - DNA, 555 bp, Homo sapiens
agaatcgcttgaactcaggaggcagaggctgcatgcagtgagccgagattgtgccactgtactccagcctgggcgacggagcgagactatctcaaacaaacaaacaaacaaacaaacaaaaagaaattggggaattcaagatatataaatgaacctttaaactgcacttttgcagagaggaatttaagggttcaaagtgatgaaacagatgtattacagatatctttctgtgtttttacacttgcacatcactgacattttggaagtaaagccatattaatgcagaagtatatctcttctggactgttgggctagatttgagcaagaataatgttgtgacataacagtgttctccatcccttccctgtgatctgctcctcccttgtacagtctcatccttcctcttgacctttcctgtatctataacttttctcttgacctcttcatgcacttccccttctcagctttcctccagtctgcaactgtcttatcccttccctcagcctaaatttccgtctggcttgtaacctttttacctctgtcaactttccatcc

SEQ ID NO: 157226 - DNA, 308 bp, Homo sapiens
ggctgagggaacatgtcagagggggctggggcagtctgctgccttactttctttaccagcgtcaaagaaccatttctattagcacagtgctttacacttaccgcacaagaagtataagaattaatgaacacacattgagaataggagtaggtttgacaagaaaaagaatccaatgatgaagagggagaagaataagagtaaattgtcagagaataagatcatttgaattcctttttatttcaataaaatagtagtagtagtaatagtagcagtagcagcagctaatgtttattgagtgcttactctgg

SEQ ID NO: 157227 - DNA, 438 bp, Homo sapiens
aaggtaaatgtcctttcttccctgtctactagtatagtgaccattttctcctgaatcaaatactgcagccttgaaactagttaaaaccagggttgtgccatacttctactcagctcagaaggaggctctccatttgagaacacatgggttccttttgctaccaggacatgcagcttggaacctctgattctcagtgatgtaggcattttcttagcatacagcagcctggaatttatcataatgtacatgtcacaggaggatatgaaatagagtaaacaccttttttatagactttagattttgaggtctcactacagcagcgttttgcaactttttaaaaaagaaccaataatgatctctttggatgttcataaaagcctcacactctgctgtcccatactagattctgatatacctaactttgaaggatgtccacca

SEQ ID NO: 157228 - DNA, 293 bp, Homo sapiens
tagtttggcacctaagcgcacttagtaaattttttaaatgattccctagtattttctattttctatttactatagttcatttttgaaaaatctgtttgcaatccactaggtttattttacaagcttcagtgggtctcagctttcagtttaaaaaagcaatagaaccaagcacagtggttcacgcctgtagttctagcactttgggaggccaaagcaggaagattgcttgaggacaggcgttcaagaccagcctgggcaacatagggagatgctgtctctacaaaaaataaatt

SEQ ID NO: 157229 - DNA, 324 bp, Homo sapiens
gcgattatagcatgctccttattagggctggcaaagctgggctggtaagcgcttccatttatcaataggataatgaataaatatgtttgaatggttgaagagacggaagaaaacagaatgaagtttaggaaattatggtctaaaattgatgcaataatattatccattctctttattcagctcgaagcataaatattaccaaagaacaaatattttatttaattaacctaagggtgaattctgcagtgcaaaaacaaacaaatcattttttatttttagagatgaggtcgcacccggttgtccaggttggagtgcagaggcaca

SEQ ID NO: 157230 - DNA, 283 bp, Homo sapiens
gcaggaagattgcttgaggccatgagtttgaggttgcagtgagctatgatcacaccactgcactatagcctgggcagaagagtgaaattctgtctcaaaaatatgatcctggtggttagatttgttattggatttttaataatttatttgttcatgtttaccaaacatttatttcaatacttcccatatgccaggtattgtgccccctactaaggaatccaaagtcaataagatccatgacctctctaatttagtctctctatgagtacctgtctacagcatc

SEQ ID NO: 157231 - DNA, 450 bp, Homo sapiens
gactccaggggcctcagtgagggaggctgcctgcagcccagcagcctggtatttcttcatgggatggagaggccgaccctgcctcctgattccctgttctccccagaccgcccatccactctgctttgccagctggaaattacagtcctagaggtttctgccatccccacctgttacccctttcgtccctaaatcctgtcctttctgccttctgtatcctaaatccaactccgtgacagccaggaccatgtctggctcacgtaaatcagtcacctcctttcatctcaccggctcacctggagggtggcagaggcatttcttcctcttctccaaagtctgcctgctctgtagatgcctgggggttcctgtgatgatcacgtctctgccttaccatgctccccattgcctgcagggccaggtgcaaattcttaggctggtccctaggccccc

SEQ ID NO: 157232 - DNA, 489 bp, Homo sapiens
gaaggtgttatgtgagctaagatatcactgttacaaaaaagctgaagacgtaaaaatctgaggaaggacactcacccagaatgaggggcaactgcaaaatctgtggaagaaataaattctttgtgcctgaggagtgtaaagaaagtcagtatgaataacgtataggaaacaaatgacacagtggcaagaagaaggttgtagcgcacattcaggtcagatcatattggtcttgtaggccctgcgtgattttgtttaaggagccatctatgattctaggtgtgctgggattccattggttggtgtaagccagggagtgacaggatcagatcattcattcaggcttctctgtgcaggatgaatatgaataagggagctcgactcaatgagttcctaagtgcaagcaaagaaaccagctttggctggtttaagcagaaagttatattttttggtcagcatattgattaacccggagaattgccaggaaggctg

SEQ ID NO: 157233 - DNA, 319 bp, Homo sapiens
tacagatcaactgaacagagaacccggaaataaagccacgtatctacagccaagtgatctttgacaaagttgacaagaatatatgctgcagaaaggacacatacttttcaataaatggtgctgggaaaactggattaacatatgtataagaatgaaactgaatccctatctgttaccatacttaaaaataaactctcattaaatttacacagaaaagaaaaatcataaatttctcccaagccagctgcaattttcataaggattgtgttgaatttgtagatcagtttagtattactattttttcatttaagattatagt

SEQ ID NO: 157234 - DNA, 513 bp, Homo sapiens
acccttattttcaaaaatttctacaaacaaaaagaaaaagcccaaaaaaacatttcagctgctggaacagtatggacactgatcactgagtactgtatgtgccttgaggcattgtgtttttgtgtaacgagattgccatactgatagtttgcttctctttacatgggcattagattaggtttcagataggagactccacataaatcacatacaaaatgtggaagataggctggttgtggtggctcatgcctgtaatcccagcactttgggaggctgaggcgggcagattgcctgaggtcaggagttcaagaccagtctggccaacatggtgaaaccccatctctcctaaaaatacaaaaaaattagccgagtgtggtggcatgtgcctggaatcccagctactcgggaggctgaggcaggggaattgcttgaatcagagaggtggaggttgcagtgagctgaaatcttactactgcactccagcctgggcgacaaagcgagactctgtctcaa

SEQ ID NO: 157235 - DNA, 221 bp, Homo sapiens
  misc_feature (47)..(47): n is a, c, g, or t
  misc_feature (85)..(85): n is a, c, g, or t
gcgtatcgtacaggacttgagtcttaaatgtgcagcaaggataaaantcaagggaatttgtcagatatggttactttcacatttncagtgttacttgatgtctccaaagccgtatatgtatcagacatataaatgtattaaaaacaagtttcaaaaataaaaaataatgaaagcccaagtggcaaaccacatgcactacgttgaagtactaaaataactgg

SEQ ID NO: 157236 - DNA, 289 bp, Homo sapiens
tgggcagtgattacctgtcatccttcctaccaggaagtcctcaggcttctagtataccacttttcttgtctggatttggattttcatgaaaatctttttattatttctgacgctccggggcaggaatgggaggttgcaacgtgtgctcagtgtgcatcttgccgagcttggcagaacgctagggaaatcgccaccctttccctcatccttcctacccctcacacctagagccagctgatcaccttatcagactggactgtgaggcagccaagaaagcaggagatcagga

SEQ ID NO: 157237 - DNA, 218 bp, Homo sapiens
agagcagatgtggaaggcaagtattcccattaaacatttactcttcagaggactctgccaagccaagcctaaattctgccttcagaacaaaggtaagcactctttcagactggtgggcatatccacagggagccagctgatgccaggaggagaaattgggagaacagcaggctttctaagcaatttggaactaaaggaaggaaaacccgccgaacaag

SEQ ID NO: 157238 - DNA, 195 bp, Homo sapiens
atgttttgctacttttttgtggaatgttttatttttttggagtcaggtagacctaatcaactctgactctacagcctactaactctgggcaagtttcacaatccttctgaccctgtttgcccatctgtaaaatgggactggatacacagccttgctgcaagtattaaatgacttatgtgtgaagcacacagtaca

SEQ ID NO: 157239 - DNA, 459 bp, Homo sapiens
ctcttatgaggacactagtcacattggatttagaacctacctaatccagtatgacctcatcttaactacagtcatgcatcataatgacatttcggtcaatggcacactaaatatatgattatagtctcattagattattgtaccccaattgcctacagtagtcagtacagtaacaggctgtagaggtttgcagcctaggaacaataggatatagtatatggtctaggtgtgtaggagactgtaccgtctaggtttgtgtgagtacactctatgatgtttggacaatgatgaaatcacctaacaacacattactcagaatgtaaccacaatgttaagcaatgcatgacatcgcaaagaccctatttccaaataaggtcatagtctaaggttctagagaaaacatgaatttaggagagacatgcttcaacccagtacacagctccagttctacctctgaac

SEQ ID NO: 157240 - DNA, 461 bp, Homo sapiens
agatgtctcctgggcccccctcaacatcagagggactctcctgacaccgttgctcccaccttggcgtgtggggccgagatgctgcctcctggttttttcccaggatgaggaaccctgcgatgccaatccctctccctccctgtccccccgcaggcctcttgtctcctttcaggctcctggagatttgtttacagtttatttttctttatttttataacagcttcattgagatacaagtcacatactgttcaaataacccatttaagctgtacaattccgtggtacgattgaatgggattcacagaattgtgcaaccacccctccatcaattttcaaatattttcatctccccaaaagaaaacctgataccctttagccatcatccccaaaccttccattctactgtagccctcgatttgcctattctgagcatgtcatataaatgtagtcatacaatatat

SEQ ID NO: 157241 - DNA, 193 bp, Homo sapiens
tttcctctgtgttcttaagtaagaatttctaaagcctcgttgttatgttcatgaatgaatgaagtgaaagtgatacaggtttgctataatttcagagtcctaaggctggaggttgtggtagggccagttttggttggctgaagcctgttcatgattatcctcccacgctaaaggctctgggtcagagttttgt

SEQ ID NO: 157242 - DNA, 375 bp, Homo sapiens
atctctggtgctcatgaaggcagctctgagcctggctccttagtacccagggctcatgggcactttattctgcttccctgtgcacctcagttccctcctcagtaaaggagacggtaaaggtattgacttcatggagctaacagcatgagtgagtgcccgaggcaatgagaacccggctcaccacatgcttgtccagcccatgtcacctagaaagatgtttaagaatggagactgcatcgttattggtgccctgctgggcagggatctgaaataggggcaggaggtttgcttcaacctgctccacccacagggtgtggcctcatggtcagttttcttccagggctttgtgcttgggatttcttttcttttcttttt

SEQ ID NO: 157243 - DNA, 399 bp, Homo sapiens
tttaagaataactgaatttagagcagaactggacaaacttgagacccaaagtccataaaaaaaatcaaagaaaccaaaaatttgttctttgaaaggataaacaagattgatacactgctagctagattgacaagaaagagagaaaatccaaaccataaatgacaaaagtgacattaaaagcaatcccacagaaatacaaaaaatcctcagagaccattataaacatcttctatgcacacaaatttaaaaatctagaggaaatggataaattcctggcaacacacaatttcccaagattgaatcaggaagaaattgaaaccctgaacagaacaatatcaagttccaatattgaaccaataataaaaaacctaccaatcaaaaaacgctccagaccaaatg

SEQ ID NO: 157244 - DNA, 716 bp, Homo sapiens
tcagcctgggcaacaagagtgaaacttcatctcaaaaaaaacaaaacaaaacaaaacaaaaaaaactgacccacgagtgtcctctcttactgcaggtttatttactctgaggacactgaggcccggcatggatgcctcaccacaactcggctacagccagccaagtggaggggctgcccctacaaacagcgctctgtcctcattgatcaaagtccacacatcgttggtttggtcttgacctcacaatggtgctgtgtgatggacttggacctctagtgtagtccatgggtggtgcccctgccaagcagagggcaagctgttcatggagagtctgtttctcaaccagtgcattaaaagtgttggggcttccttgcaataagactttctttatgactgaggttgacacatttccctgaaacacacagcatcaggaatccctgtcctgatgtattgaaacattccttcgtttatgaaaacagtactgttactctctggccatcaggcctgtgtttcgagcccctttttcgggattgtggtggatttgtgctcatctttgtttgcttcattttctcttgcctggcccccaggagggacagcgacacatctgttgcccccactggggagcttgggtcttgttatgaactccgaaagagaagagcatcaccagcacttgtgagccacaagcccccactcagatcccttacggccgtgtctca

SEQ ID NO: 157245 - DNA, 554 bp, Homo sapiens
agtcttgcctaaaaggggtgctctctggggttctcaatcctagattatgtgacgttttatgtgtggtaacaaattaatgggagataatggtgcctctgaagggccagagagattttgattatgtgaagatgacacctagtgctaacttctttaggaaataaacactatgcagatgcactaacgcttcctttaatggcttaacacactcttcaattgacttttgggtaaagctaaaggttgtgttgaccagtttcgtctgcggggagcctatagaagccacgtctaaagttgaagtagctggaaactgcaacttagaataagattgcttcttcagccacaactgtagtgtccctgccacttgccaccacaacgctgttctcctttttcaactgtggagaatctctttcacctgtcaaacacgattatgcagccctctctatagcatgctctacggtacatatcactacagctgttttatatgtaaaagagacttacaaagacattactatgcatagtgatgtctttgtaagtctctttgtcgacgcggccgcgaa

SEQ ID NO: 157246 - DNA, 889 bp, Homo sapiens
  misc_feature (368)..(368): n is a, c, g, or t
  misc_feature (498)..(498): n is a, c, g, or t
ttttttattaaacattaaataaaataataaatgtaaagtgcctggcagacagtatctacttggggtaagtattaatgattggctacattcaagagcaattcaaagagagaaatcactgcctctaaaaactagttgctgtacagatataatacataatatccctgaagtaatttataatactttcaactggagaaataaagaaaaaatacaagattcaacaaaatgtcaagattgggattaatggggcgattataagtttgttgaattattaaccaacaaggccagaaaatcaatgtgctgtcctaaatatggtttgttgcattactctcaaaaggttaagaagacactggcctggtgttaacaggggnccttgaattgaacatattgcatttttctttatcggtatgctccgataaagaaaatgtttttatgggtatgaggagcatacccataaaaaaaatgcaatagtacctacaactctttcgggaactgactgtntttgaaaaaataacagtcagctgccttttacgggggttggtggggaggtaattatctaaatataaggtggcaagtgaaaactagttacctaagaaattgcattacttaagagaagtcgccaaggttcactacatcacatctttcaaatcttaaatgagcacctttcctcacattatccctttgtcggaagcaatttctctttacaactattctggctacctcagacctccatccaaaattctcctgaatccttcattatcgacaaagcctggagcagaacgcaagcattcctttctgaaagcacacatacttactgatcactgctttccaaaaatgcatctaatgcccaagcatgaaattacaagcttgttctcttatgtctcagccatga

SEQ ID NO: 157247 - DNA, 175 bp, Homo sapiens
gatgtgcttagactatgtctaagcctgggtttcccccaccggggttctgagcccttgaaggaagtgtacctggcattgggacgctttggagaagcaactactctagaggccccaggacagaacagccaggcagccccaagaccagtcagcccagagggcggagctggcccggcag

SEQ ID NO: 157248 - DNA, 389 bp, Homo sapiens
acaactagaggatccccccccctgtgaatacctggtcccccttatcactatgccttctctgaattcctagcagccatttctgcctaaaatctataacctaaaatttcactttaaaaggctggaaagaaagcaaagcagaagaaaattttaaaaagcagaaaccaatgagatactaaagacaaatactgacaattacctcagttggttatttgaaaaaataaccgataaatcactagactggtcaagataaaaagaacatactggccagatgcagtggctcacgcctgtaatcctaacactttgggaggccgagaagggtgaacagcttgaggcctttcccccatctatgtttatgatcacctccccttcacttcaaggggaaatgatca

SEQ ID NO: 157249 - DNA, 190 bp, Homo sapiens
tagtatgcctctttcccctccacccagcatctggcccactgtcttgaacataggagatggccagaatttgcttgttttttttcctttggtgtggcgtcatttgtaaagctctgacccagagaggataggaaggtttcttaaggtcacatagcaagaagtggtggagaagctatggtgtcagaattgagag

SEQ ID NO: 157250 - DNA, 345 bp, Homo sapiens
gcactccacgcgggtgggtgacaagagcaaaactccatttaaaaaaaaaagaagtagtgaggaggtagaaatgagtgaattcatagtgcctgaggagttaaatggtgttacaggtaagcctcccacatctgaaaatctgaaatctgaatgcttcctaatctgaaacttttggatgctcaaaggaaattctcaatggagcatttgagatttcagaattttaaatttgggatgttcaaccagtaagtataatgcagatattctgaaatctgaaaaaatctgaaatgtgaatcacctctggtctgaagcatttcatagaaggatactcaacctgtattaaagtagaaa

SEQ ID NO: 157251 - DNA, 231 bp, Homo sapiens
tcacaaccggaggtcaagatgtgtgggaacagtcacgagtttagaaatcagataacacacagttcaactccagggtcactgccacaatagagtgattttagtcaagctacctaggttccaccaagtagacttggagatgagaatacgcacaggctcagaggggctgtgaggtgcaatcatgtattctgttagagatcacaaagcagaagtatgccaggcacacagtaggtg

SEQ ID NO: 157252 - DNA, 427 bp, Homo sapiens
gcctcaggggcagctatttgtgggcatcagaagtggcattagtgctatccacagacagcaacaccacccctatggccacctgtgggcatctataggggtggatgatgccttgatgatttccttggatgtcatggctaagccattgttttttggcagctgcagcttctgaagatgttactgagagccacagagaaagtgaagacggctaagacaaccaggtcatgcgagacatgcccaagacgcccagattgcttaaaagacatttgggaaagggagcatttaaagttctttccagaggatggatggggacaaaactacctggagagcctattttttattcccaggcaaatatgactgaaaaaaaaaaaatcacaggtgttaaagaagaaaaataaaattggatgaaaaaatgtctctgctttttctg

SEQ ID NO: 157253 - DNA, 476 bp, Homo sapiens
tgggcttggccagagaggtgcagagatacctggaggtgcaggaacagtgttggactaggctgatgtttcctgacccttgaggacctgagtgtggcacatagctgaccaactgcctttaattcttcttagttgcctttaatgtccaagggataagcaggaggaggagtgaattgtctggtgtctcagataggatgtctgcaaagaagggtccagaaggatagccaagcaggagaggaaaacacaggtagacagagctagactgtggtataaccatcccttcctgggaaccaaagaaagcaaagaaacacaaagttatttagtgcttattataggccaatatgctaaatgctttgcagatattattttgtcttcatgataaacctgtgtgcaggtgttacaattgctgctttatgaataaggagactaaggctaagaatgggtaaactcaactggcctctactgatcacacaataggt

SEQ ID NO: 157254 - DNA, 572 bp, Homo sapiens
agttgaggtctgaaaactgtcacagcaggctggtgaggcactccatgcttgggagtggaggtggctttcctgggagaaacgtgtgtgtggaggggaagttcagagccaagttctgttggttggttgtggtcagcgctggtttcagaggaaccaccgtgagtccctggtctccaagccacttgccttcccctttggctgggtgtgttgttgcagggatgtgggcaggcgggagagccagtagagacatcttaaaggaagatgtgtgtctggttggctggtttggggagggtctgattgggggtatgtcttgggcatctccgtgccgtcaactggagctcattacaaacagcgcttccctaatatgcaacagggagacactttgctgagatgggccttctgtcctttttcctttctgtgacttgctattggtgaatggctcttcttttccatggaccatgagcttgaagggccagggaggacaaagccccatcgtcctcatcctaaatcggaagtcagtggccttctccatgctatggctgctgtctatgtctgctcagcctgtttgtttgatg

SEQ ID NO: 157255 - DNA, 545 bp, Homo sapiens
ctcggtaccatgtagaccaggctgaggaagacggtggctttcctgggagaaacgtgtgtgtggaggggaagttcagagccaagttctgttggttggttgtggtcagcgctggtttcagaggaaccaccgtgagtccctggtctccaagccacttgccttcccctttggctgggtgtgttgttgcagggatgtgggcaggcgggagagccagtagagacatcttaaaggaagatgtgtgtctggttggctggtttggggagggtctgattgggggtatgtcttgggcatctccgtgccgtcaactggagctcattacaaacagcgcttccctaatatgcaacagggagacactttgctgagatgggccttctgtcctttttcctttctgtgacttgctattggtgaatggctcttcttttccatggaccatgagcttgaagggccagggaggacaaagccccatcgtcctcatcctaaatcggaagtcagtggccttctccatgctatggctgctgtctatgtctgctcagcctgtttgtttgatg

SEQ ID NO: 157256 - DNA, 426 bp, Homo sapiens
caaggccatgcctcagtcccccaagagaacagaggctggggtcacgaggcccagcttcctctccctcctctctgtgtgaccccccaacaggtggctgcccctctctgaactttgtggcagctcctgtgagcggagcaagctgaacccactcttggctttcccatcccaacgaatgatttatttggttaaactatgacccaaccaggtggacatctggaaaatgcaaattaagaagagaaggggaatttaaaacatttgctcaccccaacttgggtgcagtgagtgtagacatgttgggtgtttggccttctggaagaggtttctttctttctttctttctttctttgtttttgagacagcatcttgctctgttgcccaggctagagtaaagtggtgtgatctcagctcactgcaacctctgcctcc

SEQ ID NO: 157257 - DNA, 383 bp, Homo sapiens
gcctgttgtcctaaatgatcacagggctggcatcacccttgctgtgatgggctggcaggccaatgtgcttggccctcctgccaaaagtatctacgcacattctgccatggatggtacatttgcatgctcccctctccttaaaatctgagctgggagatggggaagaatgaaaggagaaaatcaaattaaatgtttgaccagcagaatgaattctgtctccagtgaggctggcttgcatttgtcttgctttttattttctgaactttctctcaccataaatcctttttcctttccttttacccattaaaatgtttttactctttgtgccagcactttgtcctttggctctttctgtgtctgtcccagctccataatcctcccca

SEQ ID NO: 157258 - DNA, 391 bp, Homo sapiens
gagttgagttaggctatcttcccggagcttctctttatcgctagatgcagtcagctggaaacatatgcctgctaattgctgaatgtgtgcctcatggagcaacggtgcagttgtcgaacgacctcggggaaacaagtctaggcctatttgtgcatttctttctttcaccatgggactcaagtgcttcgccaggccactattaggacagtggaaaatcaaggtggaaggctctgatgaaatcaattatcactaagttattttcactggtgaaggggtttcctcacaggggtttaatagtaaattattctttccatgggatgtgctagattaatggaggaaacaaagcaaacaaatgttgcctggtaagactaagaggagggtcccaaaatac

SEQ ID NO: 157259 - DNA, 157 bp, Homo sapiens
ctcccttcttattgaaacttcattcctaaggctttcatgaacccatacttctctgattatccttgtacttaattattccttctttttacctttgtgggtccttctcctccattcatttaaatattgatttatgtgtcccagggttctatcttcatca

SEQ ID NO: 157260 - DNA, 391 bp, Homo sapiens
gatgcagactgaggctgtctctacaggacgaggcacccagtgtaggaagacttctcacaccacatacagcctctccctgtgtccttgctcagagagggtgagcgtctgcccagtgacacagcctgggagcaggatccacaggaaggcctgggatgcagccatggccagggccacatggtgcacacactacagtccatgcagccaggccagggccacacaccacagtccccgcgaccttaggcctaggggtcacccctccggtttgtagcagaggtggaggtgagttgctaagggaggggtgggcactcctggcaggtggccatctctccaccagtggtggcccatggcagagtagacaggagcagtgctcttggggcagagcgcctgtgtg

SEQ ID NO: 157261 - DNA, 590 bp, Homo sapiens
ggggggtttcctaggttgtggagagagcttggttagtgaaaggtagcttgggttctgtcactaacctgtgattgctgtgccatgcacacacctctctgggccttagtttcccctcagtaaattgtcacatccaggacattggagaaagtgagtgggagattaggcacttaatgctgtgagcttgcttttttgtggttacaagtgggaagcccccatccccactgttaattgaaatctggtgtcatacctgtagctagtccagaggcagcgcttgtgtcctgaggctgcccttttgtgaacaacagtgcttcctgtcactcctggggaagcagggttggggtctgtctggagaatgagcccagcaagggcctagtgctttcatagccggaggtcatagcggctggctggctcagtggggatgcaaggtccgagtatgccctggtccagctggccacccttctctaggttcagaccaagggtaggagacaggccaacaggcaccaaagtgtttaagcgacagggtcttgctatgttccccaggctggaatgcagtggcagttcacaggcatgatcacacatcctctaactcc

SEQ ID NO: 157262 - DNA, 514 bp, Homo sapiens
gctaagaaacaggtaattatgataaagcatgatcaatattatgatcaaggaaaatatggtgcaccatgagaattaatagcaaggaagagggtcttatccttgttcaatgtgggaagaagataaggaatttggacatcatcctaaggacaacagaaaagaggagtgctatggctggatttatgttctaaaaagatcactctggctgctgtgtgaaaagcttgagaagagcaagcctagcatcagggatactaactgggagatttttttcttttttgagacaaggtctcactctgttgcccaggctgaagtgcagtggtgctatgacagctcactgcagcctcccaagtagctatgattaggtgtgcatgaccacacctggataatttttgcctttttttttttttttttttggtagagatggagttttgtcatgttgcccaggctgatctatctcaaactcctgggctcaagtgatccacctgccatggcctcccaaagtgctggggttacaggc

SEQ ID NO: 157263 - DNA, 283 bp, Homo sapiens
ctcccgctgagtcagacgctctggttgtggggcttgggcatctgagttgaaccagccctcggcgctgcttttgcatgcaaacattagagaaccacgtgtgtcaggactatccgatgcggtgctgtcaaattccatcacgactgggtgaaaacttgattctgaggcatgagaaggtgagaggctgcagggagtgggaaggtttggtttgtgacaggaaagggcaacagtcactgggcaccaaggaacccagagtcaaaaactaggtgagagtggtaagttacgg

SEQ ID NO: 157264 - DNA, 786 bp, Homo sapiens
ttctgaaaactcctgaaaagagaggcaataaactgtgtggaaagaatatgctgacacccactgccaatttcccattgtcaacccaacccaacccaacgtcaccaaacggagaagaatatgcttagaaacaaccagatagctgctgacaggaatgcgactctcacccaggaaggcagagtcttaaaagacagaatcaaagcacgctggcattgggaaggacctggcgaccacttagtcccactctctcatttatatcatagatggggagactgaagcccagagagcagtaagtgtttctgccccattctggaagcctctgaagtgcacacagggctagcagtttttggtcccattgtccagcactgaaatcatcttcctcaccagaccaattttctcctccacactgtctcagcatcagcatcagcaccagcaccagcagccacctgagtcagtgcttattcctcttccctcacccacatctaactggttaacacgccctataagtccagcaaagcctctcccctactagacagctccctcctggcctcccaaacctctgacgggctgcgggacacctaccacctggaacatgggagactgggaccaaaagcttccttgaatagaaaacaaatcacagggggcagctgacctcttcccagtatagccagtcaagggaaagctctgagccatcccatgatggctacagaggtcataaagacccctgaggactaaacaaacacaatttacctagagaaaataaaccgggctgggtggggtggctcacac

SEQ ID NO: 157265 - DNA, 490 bp, Homo sapiens
tgctggggtttattgggttttagatctcctaggagatcttgaaccttatgtgtagatcctcaaagtaaatgtggagcgtttgttaggatttttagaaacagtactaagtagcaacccctctttcagcctttcttgtcacttctaaagtccttaccctctgccatccttagcaatctccaggaaacaatgaaagagtatcttccttcttgaaatgtagggactcagctctggaggctctgagtgacaaagaaatgatgggagagagatggggagaagaaagtgggaagagaggggaggattctcaagggagattttcagtttcttaggagagattttcagttgtggaaccactttcatttttggcccttagctctgtatgtcccagcttggactcttagagataaggcggagaaaatttcatataattagttcataaccacagaactcactgaatgaaaaccagtcactgggcctatgatgaggtacttgt

SEQ ID NO: 157266 - DNA, 636 bp, Homo sapiens
cttcttggctgtgaaattagacaaaaactcattgaaaattgaatctacatatccattcatcctaaagagggagcacaacatcttctgaagatctagggaaatgctcataagatgtaaagttttaattcctgaattttgctgacaggcgatcatatttccttcctcttttgcatcaggccaaggcactggatagctgaggttgccaaccaaataacttacaaataagtgagatgttcctgtagttcagttgcattatattctaagaaatgaacttacccacacagaaagcagaaggaacacagtggcttctggaatattcctctctccctctccagaagcagaggaggaaaagtacattttaatccattcatcctaacgagacagcacagcatcttctgaccaccagagggcactgtgtaaacagtaggcttttctcagctaaaaacgcttcaccaggaaatcccttattgcacatggcattcatattcttagggttcgttttgtaggacttctatttcaaagtactaattctgtggactcagattttgtctggaacccacttaaaaatgcccctccctgtattttgtctcagctgccaccactatgtaccaatcacctagactacttgggagctac

SEQ ID NO: 157267 - DNA, 245 bp, Homo sapiens
ttgttaaagagaaatgtgacagttgtatgactttcccacctttccagatgggaaatgtctgggctgaaccccaggtggtctgataacccctatgtccaagccaatggcaaagctcaggaagttaggggccatgcagcatgggctgtcgggatagtattgccatgaggacataggattgggccaccataagctaagggggattcttttttttttctaatttgacatataggacactctcaattact

SEQ ID NO: 157268 - DNA, 808 bp, Homo sapiens
aaagcccaggcccagtgggaatacgtatcacctgctcatgtcccatgggtgagaacttagtcatgtggcaaagctggatgaaaggaaggctggcaagtagagccttagcaacagctccacactatggaggagaaacggtgacattttggggggatagtcatgtctgtcgcccatggctgtcaaggttcattattctctgatcccatcctccttcgtctgtcttcccttctgctatttaagcccctccttccctttcatatgcaggctgggggcttcctgagggctaggaccctgaatgatttacttttgtatcctcagtgcttcagtgcataaggtagggcacaggaaggagctcaccaaatacttgtgaaatgactgtcagggcccagggaaacctgtaagacaggaataaccatcgatagcagcacgtgtgccagaaccaaagccacagcgtcttgaactttcaaggaggccagatgatcttctgggccgccttccaaggtggcatccttcctctgtggctctgggcacactcacgagtgcctgtggattcatttgcccagtcttccaccttccctaagcagttggaggctagagctgcactgttcagtacagtagccagtgtctaaatttggctatttaaattaattaaaattaaattaaaaattcacttcctcatctgcaccatagcaatactccaggtactcaatagtcacaggtggctagtggccatgcatagaaagttccattgtccaaaactgggtttgatctttgggcttttggcaacatgacttctgttagaagatcc

SEQ ID NO: 157269 - DNA, 338 bp, Homo sapiens
ccaggataagaaccttgtgggtctgttgggagatttaatatgagtttttatcccttttattgatgctgtcaatgcagctaacaaggcttaggttctcctagcgagaggattcgtgattttgagcaccattttgtactaagatgttgtttatggaaatactctttcatgtttggagaatcatattactccactccaccaacaaggacgcatttcaatcagaatttggaacgggctggttattgattgacagtcttttttgggtcctaatggtctgcgtacttacctttctagaaatgatctcagctgtaagcttgcattacagcacatgacttatttga

SEQ ID NO: 157270 - DNA, 478 bp, Homo sapiens
agccacaagaactcattcagtatcattaggagacttgtcatcatcttgacgtcatttatgatcttcctcacatttcaaggctgttactgcattgctttctagaagatcttcagaggccttcttcaatggcagctactatttagtaatcactctccagaaataagtattaaatctgtgtttaaaaccgaatcctcccctttttataaaactagtttgttgttgtaaccatgacaaagtatccaatattagagttggcttgacatccttccatacctcagtgtccctgactagtgatgagaacttcactgtctcagccatttcacagactaactggagagatgcctctgggactgggactctacattcctcttttgaaatcccaaacaccattcctttccctgggcatgactgcatacttggatttctctttctcacttccaggtttttttgaagctttttttttttttttttttggccc

SEQ ID NO: 157271 - DNA, 105 bp, Homo sapiens
ctggctttgacgtggtgctactagttgagtgtcttaattccactgagagatggtataagggagatgggcttccccacctataaaccagatacacacatgtttgta

SEQ ID NO: 157272 - DNA, 588 bp, Homo sapiens
atttagcacatgacagatgggttggagggcagcaagagtggagtcaggcaggccagtgagaaagctgttgcagtaatccaggagaggagggctttggaaaattggacaaagtaatggtagaagggctggaggtaactgaattgtttcaagagaaaattagaagatagaatagatagcatttggtacttataaataggatatgttaagatgatgaggaacaagtctaggatgatactcaattttctaatttgagcacagagtagaggacaatggaagtaacatggtttgggaaaagttgtcttctgagatagaagcataccctctttctttcctgcattctgagataaagcttaagccctgggattactgctccttgagtcaccttcccttcttccttacctgaatatcatagctcataatcctctgcacctgctctggtccccaccctgactccttgttccctgtagtccaggaggtctcagacctcttccagtgcttgggggcttggatacaggcagatacatagggaagaccatgtgaaagcactggttgaagatggccacctacaagccaagaagtgctgatcac

SEQ ID NO: 157273 - DNA, 282 bp, Homo sapiens
caaaaaaactctttcattcctaacgctacctatgtggacacagtcagtttccagctctccctccgaagtcctcccgactgtacctgcttgtccctggacagcgacctctggcctggccaccaaggctgcagcttggagctctgtcaggccctgtgcacagccatttctgactctcccctttcctagatgactgtgtgtacatgtgtgcgtgcgcgagtgtgggcatgtgcgtgcatgcacacgcttgtgtgtatgtgtgtgtctccatatctctggtgccac

SEQ ID NO: 157274 - DNA, 372 bp, Homo sapiens
ttggagaccagctggggaaacacagtgagatcccagctctaaaaaaattttaaaattagctgggaggatggcttgagcccaggagttcaaggttacagtgaactatgatggcgccacggcactctagcctggcagcctgggtgaaagaaaaagactctcttaaaaaataaataaataaaaaagagtcttgtctaagaattctgaacctggggtcccctgatgtatgtaaaactccaaaaatttttcgaaacaacatataacagatgaattaggacctaaaacttaaaagaaccactgattaaggcaaatgccctaactttacacacaaaggaactgcagaaaagaaggaaatgtctccaaagtgcttctcaa

SEQ ID NO: 157275 - DNA, 555 bp, Homo sapiens
accagcagttattgaatgagtggctcagggtttcacatgcgaagctgacagggaaggtgtctggggtcctcccgtagtcatctcgcctcttcacagatggaaactccccacttcttctccctggggcggcctttccctcactctcctggttccttcccccgaagctggaaatgctggttgtaagagcccaggccccacgtacccagccagtgtccaccccaagaaaggggctgaaatgtggagcaaacttcccattccatcacgaacgggggaaatgagcttgtgtttctttgaaataagccaatattaaactttaaaggaaaagatatattactgaagtctttaagtgtatacagtcggcccttcatctcttccagttccgcatccaaggattcaaccaactagggatacttgggaataaaatcaataaaaaagaacaatacaacagttaaaaaattaaaaaccaatacagcagaacaactatttacataacattaccttgtattaggtattataagtcatcacgaaatgatttaaagtacacagcggggatgt

SEQ ID NO: 157276 - DNA, 268 bp, Homo sapiens
tatattaaattcagactcaggtgaacattgctcattcatccaagaatcttaaagaacttgagctttggccctttaatcgagtccagagcatgacccattaagttattcttgcagtttgtgaaatccagtggtatgttccattaggcatgtgagcattccaaaacactgcacataacatgcacactgcagcatcattagtaccccatcctttccatttgcatttgccctaacaaatgtgtgtgtttataaatgggcacacactttttgt

SEQ ID NO: 157277 - DNA, 298 bp, Homo sapiens
agtctgtccctgggctgagaagggaggggagaagagggaagagatggaaaaggaacattgctcttcccagtctccctggcctcgtcatataaccttttattttacaaattcagtcttgtggcattttgctttaatgcttagagctggccccaggtgccaggcagcaggcacatttccttctgcccaaaaaacaaaacacacatgaatctgaggttgggcgtggtaagggcaggccaaggctgaccgtcctatgtggatatctgtgaggtagtgtgcctacatgtaagggtctgttgtg

SEQ ID NO: 157278 - DNA, 302 bp, Homo sapiens
ccctcgcctcttcacactcctgtaggttccctggaggccacaggtgtacttcagggctgcgaagctgtcagcccaaagctctacaatgtgaccctgcaaggccagccactctgagctgcaaacccttacacgcaaaggtctcttctggctcaaaggttttcaaaagttactcctctaagatcgtgaatctctgtacctctggactctgtggaggtttactctgataccacctgacacaggtgagtaaggggccactttcccccttcttccttccagagatggcctctgcgattagggatagt

SEQ ID NO: 157279 - DNA, 603 bp, Homo sapiens
taattgctagagtctttgggtaaggtgttactgcctctgtttcacagatggacaaactgaggctcagaatgttaagggtttgcccaaatttaaacacttagtaggtaatactgaaagaattgaatctgcacagccctatagtctgaatgaaatcccaatggcagaattcttaattagtattttaatagcttgaactttaaggtatttctgcttaacgtattaggttttccttagtgagcctcagtttttgttagctgaggaaaatggataattgaaagcatgtaaaattttcccttatgttagagagtgaatgttaagcatggataatgcagctaaatagctgtaatcatccactatgcatagccaatagtcaacagatgttcaacatagatccaacagatctaaggggaaaaaacacctaccacatctaacctaacacaggactttatttgcaataatgcatcctaaaacgaaggtcaattttggcacacaaacaacaattttggcaattcttactttttgacatcatattttcctattttagggctgtatgctggcttcatccaaagaaaaacttggcagtctaaacagtgtatatagatg

SEQ ID NO: 157280 - DNA, 412 bp, Homo sapiens
ccgggagcccttaaccctccgggagaccttcccctccaggaggccctccaggctgccccagcccacgcagagccccagcttcagagctcctaccagctctgccaggaagtgagaaccacaggcctcccctcactgactcctcgtctcctctacccgccagcagaggcgctctcagggtttgctcttcatccttccctcctgtctccctgcagcacggacagcacaagctgcagatagatagatgcgcgagtctgcatgaggaccaggtgtcaggctgggctgagaagcagcagccagggtccaaggggggcagatgatgcccaggttttcgcctgcccacgaggcttacaaccatgccatgatcaggacagccaggggggcaccaagcagcctctcttctacttgttccttc

SEQ ID NO: 157281 - DNA, 298 bp, Homo sapiens
  misc_feature (5)..(5): n is a, c, g, or t
actanaggacccctctatccttatctcttgatttctctggggaattggttaagagatgcatgagggtcttattaacacagtgtggaacatagggataacaataatttgcaatttaaagaattatttaggaaacaaaatatgcagaactagctcgactgtttattaaatataatgacatagttaaatattgatgggggaagggagtagtctgtattacatccagaggagggatggttctactggaacttactggacagctagatgacaatatgaagatctaaggaatggggaagagaag

SEQ ID NO: 157282 - DNA, 398 bp, Homo sapiens
cttcctccccctccccacactcctgcaggcgcggggcgcaacttgcaatccgaacttcgcgcggccggagcaagtttgtcggggcgagaagcgcctggtcctcggtccgcaccaccgcactaggtccccgccaccgccccaccactgtgtcaggggccaggcgtggcccccggctggctagggaaccgagcgcggcgccgcggctgcgcattccgtgcgggacgccgctgtctcccaagggtcgggataaactagggggcggttgatctgaaagtcttagccacgactaatagtcaaccgcccaggtgcgacccgcagcagccttggcgatgcagctcgttctccagacgcgggtccacaccggcgcgtcctcgcctccagggaccgatcgctgttct

SEQ ID NO: 157283 - DNA, 152 bp, Homo sapiens
caatgagccgagatggcgccactgcactccatcttgggcgacagagcgagactcagtcttgagcccacaagagtacagggaggtaagaatgtagtgggtgtctggccaagctgggcttaagtttcagttacagctgaatctgcacaaacccc

SEQ ID NO: 157284 - DNA, 966 bp, Homo sapiens
cctcagcaaaaccttctgggagaggctttccccagggaaggaggaggaatgctcttcccgcgagggtggcaaacggcagccgagcctcctggttagagcttccaacaaactctcagtgcccaactgtgggggatttcttcaaggcaaaacagaaacagttaattcagaaatctctgtgcttttatgctgattttgttacttaagttgctttaatacctgtatgaaagcagaatataaaattagcaaatggacttttctaaatcatttcattttctttcaaaaataacttaaaaattttttttttttacctgaagtgatcaacattgtacgttctgaaagtgtaaagggactgaaaagacaggctgaaaaataaagtaagaagaagattgtacaacatttctagctgcctttttttcctttgataagggaacccatgcagtcagctaagagctgccaccaagatcaaggccctgcagggcaccgatgagcaggatcaccgggagcgctgtgtttacagggatttcatttttcattttgaagggttgccacgtcactttcccaagttttgcggggcagagtgaggcttcatcaagacatgcatccatggactgggcgaaattccagtgtccattatttcctggggaaagcgtgtaagaggctctctctatcgctcttcttacttctgcatcccccagaacacacatacacagtcacagtcacacatgtttgcaccaaacacggcctcactctcacaagacactcacgaaggtacgttgacagtctcacagggtcacaaacatgcactagaaatctgacacacacacacacacatccaatctctctctgacacacacacactatctcacacacacatgctcctctgctctgctgagtcatcagtcttggatctcagcctcagcacgtgtggggcctgccctgtgggaggctgttgaacacagagggaag

SEQ ID NO: 157285 - DNA, 391 bp, Homo sapiens
cctcagcaaaaccttctgggagaggctttccccagggaaggaggaggaatgctcttcccgcgagggtggcaaacggcagccgagcctcctggttagagcttccaacaaactctcagtgcccaactgtgggggatttcttcaaggcaaaacagaaacagttaattcagaaatctctgtgcttttatgctgattttgttacttaagttgctttaatacctgtatgaaagcagaatataaaattagcaaatggacttttctaaatcatttcattttctttcaaaaataacttaaaaattttttttttttacctgaagtgatcaacattgtacgttctgaaagtgtaaagggactgaaaagacaggctgaaaaataaagtaagaagaagattgta

SEQ ID NO: 157286 - DNA, 499 bp, Homo sapiens
aatgaaagttgaaattcattaaaattttaatttcatcttattacaaaacaaagatacatttacttctttccaattttgatatatattatactgacatacacactgtattctatggtgaattatactgattgaatttcacattttgaactaacactgaattactttgaaaaactctactgggtcataatgtattatgtttttaatatattttaatacaatttgcaaaaattctgttttaaaattacctctctgttccataaataaataaatatgtaaaaaaaataaatgtttgtattattcaagtgaagattatagcaataattttgaatatctacttaacctcaactagttttaattcagaagtagcaactccataaaaattcaacttattactaccttattactcatacttgtctccttgaagaagttcattgttatcatccagtttagactgggatgtcataaatctctagactgagtagtataatattcactgttc

SEQ ID NO: 157287 - DNA, 560 bp, Homo sapiens
  misc_feature (374)..(374): n is a, c, g, or t
  misc_feature (471)..(471): n is a, c, g, or t
agtcatcgagagcgttcctgtaatcctgtctaattttccgaatgaattttccgaatgacgcactcgtgaaacttagttgtggttaactttgcaaaatgggaaggggggttcaaaatcggaaaagactttacttttcatttttaatcagcctggtgcctttagagctaggatttagtttctattctttctgtctcattttcaagtgatttttttcttcaaatggcatctactgggctcaagaactggagatccccacaaagctgagattcacatgggaattttgtacacacccacacaggtatacacttccatttacatgcagacatccacccacagatacacacatccggagaccaagacagaacgcaaactgncccataaaagcacggttccccaaacaggagaaacgcaccattcactccagggaggtatctatttgtttaattcagcctctgatagtcaggctgttgncaagcccagctctgaaactcttcccctctaggaaagaaagatggattttttctttactcaagaatatagatctctaaaaaaaaaaaaca

SEQ ID NO: 157288 - DNA, 251 bp, Homo sapiens
gagctgtgggaaggggccattgtcttccagacccaagaatggtagatccatcagcagcttgcactgtatgcctggaaaagctgcaggcattcaactccaatttgctgaaccctgcaaagccacagaagtggaagtgcccaagaccttgggagcctgcccctcatcagtttgcccaggctgtggcaaatggagtcaagggctattttggagctttaagatttaatgattgccctgctgggtttaggacttgc

SEQ ID NO: 157289 - DNA, 268 bp, Homo sapiens
tgtctagggaagccttaagtgtggctgggaggcaactggaccctagggtctggacaggccgtggcaggtcacaacataaggtggcaccatgaaaaagtctgtgttttcattttctactatgaaaactacagtgtgaattctaggtcatggagcaaataaaaactcttcacaagcagtatactttctttttttttattttatttatatatattttttgaaacagagtctcgctctgtcacccaggctagagtacaatggcacaatctcg

SEQ ID NO: 157290 - DNA, 736 bp, Homo sapiens
ggcacgatatggcacactgcatcctccatctcatgggcttacatgatcctcctgcctcagccctctcaagtagctgggactacaggctacttgactgtctaacttttttttacggatggggtcttactatgttgcccaggctggtttcgaactcctaggctcaagcaatcctcctgatttggactcccaaagtgttgggattacaggcgtgagccactgcacccagccaaaagagaaatctttttttttttttttttttttttttttgacagagttccactctcgttgcccaggctggggtgcaatggtacaatctcggctcaccgcaacctctgcctcctgggttcaagagattctcctgcctcagcctcccgagtagctgggattacaggcatgcgccacctatgtctggctaatttttgtatttttagtagagatggaggtttctccatgttggtcaaggctggtcttgaactccggacctcaggtgatccgcccgcctcggcctcccaaagtgctgggattacaggcgtgagccaccacgctcggcccaaaagagaagtcttaaacataaaaatattttcaggttgttttcttttattttaaattaggtactcaataaagcttttagttttcatgattttttttttttaagaaagcataaaagacttgaatatttaacaaaaaaggagagaaaaaaggaagtgcaacagatgacaggaactcttttggaggc

SEQ ID NO: 157291 - DNA, 302 bp, Homo sapiens
aggcaaaatgtgaaaaaaatgacatcattgaaagacctgatggagttgaaaaagaaccattctgaatgcttaaaatactttttaagtattttaaaagtaacgatgctcatagcaaatttacagaatacacataaaaagcacctatgatcctaccacccagagatactcactattaactgtgtataccagaattttatctataccttcctatatttaaaacctgtttgaggccattatttatgtagtgttgcaagttacttttcatgtattagatttctctgtcttctgaaacagcacagact

SEQ ID NO: 157292 - DNA, 443 bp, Homo sapiens
acgggttttaaaatgtcccttaataacaggaaagatacctcatactctgacactgatggggggaaggaagaatgggtattatggacttttgtacatttttgaagtaatccatatatgatggtctcaattttcatgatgaattaggaggacaggttcttagaacaagagtttcagagataagacccttgaaacagccactgagaggaactggagtaatagctcaacaaggagaaatagaagcatcagcggctgtattgaggaaccactggagattggggccaccaccctctttgccttcttagtacactgatagctaaataattgagctccccaaggattatacaatgctggccatatagtgggtaatcaataattcccttaaaaataataggctttaaaaattaaattagtacatatttggtcattgtagaaaagttgaaaaa

SEQ ID NO: 157293 - DNA, 166 bp, Homo sapiens
ttttgagacaggatttcactctgttgcccagatgagagttcatggtgtgatctcagctcactgcagtcgtggccacttgcctggctaattttattttttttgtagagatgaggtctcactgttggccaggctggtctcaaattcctgggcttaagtgatcctctgg

SEQ ID NO: 157294 - DNA, 192 bp, Homo sapiens
caaattgttcccacctagtgagagatctcatggctttgtggttaagcacacagactctggggcaagaatgcttaagtttaaatcttcagcttttaccacctattatctgtgtgactttgagcaggttacttagcctcttggtgcctcagttatttcatctatagaatgggaatgatgataacattaatagta

SEQ ID NO: 157295 - DNA, 493 bp, Homo sapiens
tgaagaagtgagtcacacccctgtcacaagccctatggggggataaaggaattcctcccgtttcagggagagagataagcaatgctggtagtgtgcccctttctggtggcactgtagtagttttggctgagggctggtgagagagtgaactccatcttcttggccataccaacccagagtggagcttgcatcatgctgaggttgtattggcaggaaggagtaggtcatggcttcactgctgcagactcttgatgttcttgttcacatttagtcaattttcttgaataaatgattttgtatttgctattttcccttagaacaatttctagtctttaaatgattgctataattgctcttttgttgttgttatttttattttgaatgatttttcaacagttacgattgttttgctgaggagtgggtctatggagctcctcacacagctatttcagaatgtaaggatattggtactttaggcttcagggcaacctgg

SEQ ID NO: 157296 - DNA, 552 bp, Homo sapiens
taccccacaccacctgagtcataccacctgagtcacaccacctgagtcacaccacctgagtcacaccacctgagtcacaccacctgagtcacaccacctgagtcacaatgtctatttttaaagtagtcaacctacttcttagagccacgcacaaaacagaatacaaacacacttcaaatctgttacatggtgaaatgtttgtggaatgcaattttcatgattattttttcagtgcattaacaattgcttttcaggaaatatcacttctctccaagtgccttttgactataccacagagtgctttttaacacctaacgacaatttattcagatttatatttagatagttaattactgtaagatcatacttcagtgaaaatgaccaaatgtaatattattgatagttcattctcctgctgctggtatttcacctcttgaaaaatcacattatttggtgcatgtgaaataatgttacattaattcctttactctttcacaaagcaaaatatttatggtaaaactgcaatgcactaatcatgctgtgggaatgaaa

SEQ ID NO: 157297 - DNA, 464 bp, Homo sapiens
  misc_feature (8)..(8): n is a, c, g, or t
  misc_feature (49)..(49): n is a, c, g, or t
gtcaacancactgattgaacactctggcaaagatgctgtggtagacganggttggagttagaaagaagaagcaagcactggcctggccttgaaagaacggaagtctttcccattcacttctctagaatgctgccaagacagaggcagaaagaaatggatgataattctgtcaagcacacttctattctttattaagagaaacaattatgtttggaattcagcatctttggttggaacgcattggcttttttttcttgttgtgatagaaatggaattaagtaaaattatagtttgtcttttctgttgtcttcaaattttataatgtcttttatttttaatttaatcccattcaattatttaattgttatacattgacattaactgctgtattttatgactttgttcaataattttgttctttcagggctagaaataaacttttttaagaaatgtgcatttttccc

SEQ ID NO: 157298 - DNA, 301 bp, Homo sapiens
aacgattcgagctcggacccctccataatgtgtgcccaacagtaccgtgttttatccatggttatttgggttgcttccatgttttcctgtaatgataccctgaacatttttgtgcatgacttttgattcatgcatgagtacgtttctgttaaatactgagggatttgctatgtcatagggtgtgcttgttttaaactttcatggagcatggttttctgcgtggttttacccatttacactctcaccaggagtaatcattgtttcatcctcaccaacacttgttctgggcagtctttgtgag

SEQ ID NO: 157299 - DNA, 286 bp, Homo sapiens
ccccagttgttctttgttgctgggccccaaagcctcctgcttatataaatagtttctggggcctttttgaaggctcagatttagtccttaaggcctggtaggagataagtttatctcattccaccttccatagttcttcctgacttgctgttccacccaggcaccagagcaaataattcctcacttcatttcaaaaaactaaaagccttatgcatatgaattcgtaaaatctcatacaaatatccaaagaggccgggcacggtggctcacgcctataatcccagca

SEQ ID NO: 157300 - DNA, 124 bp, Homo sapiens
gcttgcctttggtgcatcttcccccatcccctcacacttctcacgaagaatttgggggcacacagcctctccttccagggcagtatacctggtacgtatggcaaaatatttggggtgaggggct

SEQ ID NO: 157301 - DNA, 334 bp, Homo sapiens
agaatgtgtgtgtggatggaggaggaaacttggaaatatctctccaagacaaggtgaaggtgataacattttgaccagaaatcaagaatcagagaccagaggtcagagaatctaaaaggataatggaagtatttcttggaggaacgaacttcacagtggaaccacaaagtcaccagaactctgtggttccactgtgaagttcgttcctccaagaaatacttccattatccttttagactcaggaaagtgaaaatagaagatcaaaatgtacaagttagtatttttgaatatgtaggtaccaaaacatgcattctgcagactacaacactgcaga

SEQ ID NO: 157302 - DNA, 284 bp, Homo sapiens
gtgtcacttttgtttctgaggtgggggaaattaaattgtgtgtgcacacaattaatcttgctaatggcagcctccctggacctagaaattaaatgttaagtatcttgcagccagccgctgggatgacgccctttggaacagatcagtcggctcaggctcatgatactaattggggtggagtctggtgtttgtctagctctgaccctgtttgggggacgttggtcttatcgtgtccacgatgaggctgagacttggagatgtggaagctggaaaagcccttccca

SEQ ID NO: 157303 - DNA, 430 bp, Homo sapiens
taaagtaggcaagggcatacattcctgccctgacacctgtaagagttgttgcattttgagtagtgaggtttgtaaatgtggccaggcagagaggagagtggctggggagagtcggcaggctgaagagcccactcacctggagacattaaacaccatctaaggtttgatctcctaccgcctgctcaggatgctgcctcttccagaccccacatgtgttagcattgagttgttaagcaggcagactgaattcatttaccctctcaacaaatgaatgagatgctgaactctgtaatggatgttgatgttttcctggctatgaagatttttagggggcgtatttcccatattctcacgaacttggtagccatggaaagcactgagagtctgtttcctaaagttgacttaacctggggactctggcttaaactaa

SEQ ID NO: 157304 - DNA, 321 bp, Homo sapiens
cattcctggggagcccacgcatctctctgcacagtggcagcccgtggataacttcacctaataagaattgatagagctgacccagaaagtactagcctacaccggaccatagccctgccacccctagcaattatatagggattagagcagaatattttatcccagctttccccgtggcttttatcttatttttccttcctttatttatttttatttttttagatacagggtcttgttctgtcacccaggccggagtgcagtggcgtgatcgcagctcactgtagcttcaaactcccagctcagtctctgaagtagccggga

SEQ ID NO: 157305 - DNA, 578 bp, Homo sapiens
tgccctaggcattctttgcattactcaaagcccctgttattccatctctttaactcatgccttttgagaggccttctctgaccactctttctaaaatctctttccctctcctcatcctcatttatgtttcttcatggtaagcatcacttactgtttccgtcaccccgtctagatggacagctccacaagcagaaagacttggttttgctgtcacagccgcagcactaaaaccttgcttagcaggtgctcacttcacttgtccaaggaatggctagcatactgaggagggagagcctgcttcctgcctgggacactggacaggcaaatcacttcttcttgcctcagtgccaccctttgtaaggacactggttggttatgcctacccttcccatctccctgggtacaggcacaaatgaaaagaataacgtgtacacgcccgcgaagcagagcagcaagtggataccgagcattattacgccgtgcgttcggccgccctttttctgcacggagaaccccctccgctcccattttccagcgcccccgtcccggcgatccagagacccgctgtgggcggccgc

SEQ ID NO: 157306 - DNA, 614 bp, Homo sapiens
acctgtgtaccctttgcctagtttcttccagtgataccatcttgtaagattctagtatggtatcacaaccaagatgctgacatggacacagtggagatacagaaaatttccatcactacaaggacccctcttgctgtccttttatagccacgtctacttccctgccacttctgttttctccttcacctctgtcaaccactgatatgttctccattcctataattatgtcatttcaaggattttatataagtggaattctgtattatgtagccttttggggagccactcataatccggaaatacataatcccaaatgccatgatcatgaaggttgaaaccctgataatcataatcccaaatatgtaattctggaaagaataattttaaaaacctttaaaagatatttatttacattttgtttgtttgtttgttttgagatggagtcttactctgttgcccaggctgtagtgcagtggcacagtctcagctcactgcaacatctacctcccaggttcgagtgattctcctgcctcagcctcccaagtagctgggactacaggtgtgcgccaccatgcccggctaatttttgtatttttagtagagatggggtttca

SEQ ID NO: 157307 - DNA, 577 bp, Homo sapiens
  misc_feature (12)..(12): n is a, c, g, or t
tactctacaggncttcacgtaccacctgactgacttctgcattttcagtagagacggggttttgccatgttgatcaggctggtctcgaactcctgacctcaagttatctacctgccttggcttcccaaagccccggctgagggcactggttttcatacttggttttctgactgtaaagtgcatactactatccgaagtaagaagagttgcctgcctagttgcctgatttttaccttgacagaactactgtagcttaatttaagtattctagttgatagtagtggcagggatatagtaagaattcagcagtgaaactcctaactcattaaattgagtattttgagtagaaacatttaagtcatcatttttgaatagttaacttaaggcttcactcatgttctttaagtttgggtttcagtaaaatgaaatttctgtagaatgttttattgctggaagaacatatttttccttgtactgatggtgagctgaatattttcatctctgttcttcagtgtttttctagcttagtaattcgcataagttgcttattctttttagtccatatgtgacttgccag

SEQ ID NO: 157308 - DNA, 330 bp, Homo sapiens
gtttatttaaattcctactcctgctagggaaatagaaaaccaagggcacgagacagtgctgataagagatctcatcattataaaggttaaggttggagaagggtcccggagagtgttgaacaagtgattgctacctggggaaattgtctagggcttcaggaatatgaggaaggacagagaggagtagggtagaagggagttgggggtgggggactgggctaaggacaaggacaggttttgattctgaagtgaaagaaccaggtcctaaagacccttgacccttcctcctcctacctgaaaggtactcttttgcttgaatttcaggaacgt

SEQ ID NO: 157309 - DNA, 358 bp, Homo sapiens
gggcagtgctgtgatcctggctcactgtagcctctaactcctgggctcaagccatcctcctgcctcagcctcccaagtaactgggactacaggcactgccactgcaccctgctaaaggaatgactcgacttttaactatcaggtagaatcctgggcgaagtcacatgagcctggtgttttttttggtggaagagctctttgactatttctgtgaaaactggtctgctaagatttttcatcttgactgaattcattttgggtctctaggattagaggctgtaggactcaacaaggaccagcttcatgggcatatgataattgcacagggccccgcacccaggagggggcctcacacata

SEQ ID NO: 157310 - DNA, 342 bp, Homo sapiens
ttaatgcaacagttcaaactacagagtaagtctaagcctagaataaaagtggctgtagctcagtgaacagcaaagtatctatgagatactcaatctggcccgttttttttttttttttgagacgaagtctcactcgtgtccaccaggctggagtcaatggcacaatctcggctcactgaaacctccgcctcccggttcaagcgattctcctgcctcagcctcctgagtcgccaggcgcctgccaccacgcacagctaatttttgtatttttaataaagacaggtttcaccatgttggtcaggctagtcttgaactcctgatctcaggtgatccatcccacct

SEQ ID NO: 157311 - DNA, 485 bp, Homo sapiens
tcaattaacgaagaactgatactggtataatttgatcacctaggcttgtggttcctacacggggatgtagtagccttctcgaaacagacatttgagctcctctggctttcatccgagcttctggtgtttagtaggaaatagtctccgaagtgcaggtcatgtagtcctagtgttttatagttataaagctgaattgttcttacaggagttacagaggtctataaagaaaatgtccataatctctctgtcttcaagttctagttccttagccctaaagtcagcaaagttaacatttggtgtccattattcccacacttttctctttgttcatatcatcgtgtataaacatatacacaggctgggcatggtggctttcacctgtaatcccagcactttgggaggctgacgctgaggtgagaggattgcttgaggctaggagttcaggaccatcctgggcattaagggaagaccccatttctacaaaa

SEQ ID NO: 157312 - DNA, 268 bp, Homo sapiens
aaagaaggacattgagtaatatggaagggcggaaggttttgtggttgaactaaggaagccaaggacaaaggaagggatcaatttaagacatccctaacaagagcttatttttatcaagcttattttgtatgccttgtgctctgcagagcacctgctttttgttatccatcgaatttttatgtactccctgcactccacacctttgaggtggcatttccgtttgcttgatgaggaaactgaagctcagataaatttagtgacctggaag

SEQ ID NO: 157313 - DNA, 710 bp, Homo sapiens
gacaggagttgagggaaagaggtgaggggaaaaggtgaggggaaaagacccatagctggagctccagccaccatcagcaagtgagaaggcactggatctggagttaagtgggaaggtggcaagctcccccaactcccaacagcaaatagaggagagagctaagcagaaggttgcgatgagaaactgcaaggcccagctatcagcccaaggagcttggaggacagtggaggaagggagaacggatttcctagggaaggagctggaggttaagctggaggtggctgtatatcaatgatgcagttttgactccgattcagggctgtgaactggaggcccaaccagaaataacctctcctagcagagccaagaaacactgagaccatgctgatggagggaagtttaacctgaagtctgggttaatccagctgctaaatacggtgggcccttccttctccaagctctaggttagggtgggtctggaataacatggaatttacagaaaggtgactccacctagcaccagagacaggaggagcccaggaacctcattgttgtcagggtccactgctggaagccctggccagctgagctgatggtgcagggcagggccctgtggagcaattctgggatcccatgttaccaagggtgaggagaggaccagataccttttcatcacaaggtcctgcaactggcccttcacttctcatccc

SEQ ID NO: 157314 - DNA, 164 bp, Homo sapiens
atttattctatcattaactaatacagactccagactaccctctccctcacaatttagatttcaaaatacatcccttcacaaattaatggttatctgggaatgagctaatatgggccctggagttctgtacttcaagtacccctaaaaaagggaagcctcctttt

SEQ ID NO: 157315 - DNA, 251 bp, Homo sapiens
ctaaaccttccagtgagatcgggtctgcaccacctccagcttctggaacccttgcaccgggatagggccacccctcacttactccccagagaaggctgctaacaccaagtagcatggcatggcggttatgtgctgaagccagactgccgggattcaaatcctgactccatttcctgtgtgaccttggaaaagttactcaacttttctgtgcctcggtttcctcacctgtgaaatgggcataataatggtac

SEQ ID NO: 157316 - DNA, 489 bp, Homo sapiens
aacaagctcggtatcccacaccacctgagtcctagttaactaagagatgagccttagaaactgcttggtcaagcttagaaaacttcctggcaatagtgatttaaatgcttcattagccctggataaagacacctgtggctccttaacagcaatactatcaagggtaactatggtttattgagaatttagtgtgtcaggctcagcaaccacccgtcatttgctttaatggttttatgttcacataaaaactttgaggtaggtacagttggtgtatttccattattttatggatgaatgaaaagaagcccacagagctggaggaacttacctctgttctatagttagtaagtgtggggcaggactaaacacagacatgtccaaattcaaacctcaggtttcccaccgtcatgctgaattgccttcctaaactcagagaaaaatgtgattcaggacaagaaactttgtatgggggagagagttaaggagaaa

SEQ ID NO: 157317 - DNA, 373 bp, Homo sapiens
agaaactgaggcagagagagataaagtagcccatcgaaggtcactgagctgggaagtggccacgctgggcttccaactcagtccttctagcctgaacacttattccctaccacacactgcttctccagcaacaggtctagcactgttaacggttgttacctttgcagagtagcatttcactttttactttatgctcatcaatatttgtatgtgtcatttctaatagagaatgcattgcttttgtgattaaaaataactagccaggcgcggtgactcatgcctataatcccagcactttgggaggccgagacgggtggatcacaaggtcaggagttcgagaccagcctggccaatatggtgaaaccccgtctct

SEQ ID NO: 157318 - DNA, 486 bp, Homo sapiens
atcgagctcggacccctccataatgagtgcccaagacttaccataagctaaggtgaaaggttggccaaggagcttggcacgggagcaatcaggggctgaagtaattattcatagaggtcagacttacagtccaaataaaggagaatgtctaccggaatgtaccagattccacagtgtccatgccaacaaaaagagaaggaacattttcctgggagcccactgactgtacaaagacaaaggtgtttcttgttttgtatccaaggtaaatggagaatgtctatacctgtattttttttcaaagcttaccattcttacctatggtaaaagactattacaaagggtcctactctatcatggtcttgctagtattgtagaataaataaagcagtctctacaaaaggatgcattctgcgtacctatctccaagttgatggaatgcaatgtattatgggaaacattatccctttgcacagataatcaggatta

SEQ ID NO: 157319 - DNA, 472 bp, Homo sapiens
cagaaatgtgcattcataactggcaaaacaggacccttgctggtttccatcttatgcagaacatgaactgtgaagttttgagaaagaagctaatgttccaagcatctgccacagggaacagtttattttcccttttctttttggtcacatgtcggtttaatttggagtcagtgtttaagtcaatgctggcatggggtgaagactaagaaattgttcttgcagtcagcagacatgggttctcagcccaactccactgccacccagctgcaaaactctccttggcttgtttttaatcaatggcaaagtagcagggttgaatttgatgatcttcgagatttctactatttctgttttctttggttctaattttgcccgagattttccagttcctgtggaattccccagtgaaagcattttctaattcttccaaatactttttgtggcttgaacttaaaaagacaaaaacaaaaat

SEQ ID NO: 157320 - DNA, 155 bp, Homo sapiens
tatgtcctcctcttcagctaaagtgttctacctccttcaatatccagtcctaaagccacttctcagaaccctgtgtataccggcaggtgtcattctgccttatcattatttgtttacattacactccctcctgctacactctaacggaaatcatg

SEQ ID NO: 157321 - DNA, 363 bp, Homo sapiens
accaaaaggaacacattaagctatgtgcattcccacattcattcaccaatccatcaacatacatttatttacaccttttatgccaggcacagatgattcatcagtgatcaaaataaaagtctttgtcatcatggggtttacattctactagggaaaaagcagaggaagaggggaaagcaaatatttgttagatgtgcttatgatatgtgatacatgctaaagagaaaaataaagcagaataaggaagttaggattttgatattttaaagagggtagtcaggaaacgcctctctgataggagatattcgaacacagacctgaagcaagtgagcaagctcttcacatggataactgggggaaatg

SEQ ID NO: 157322 - DNA, 170 bp, Homo sapiens
acacagagagggcaggctgcaggaacgcacagagggcaggctgcaggaatgcacggagggcaggctgcaggaatgcacggagggcaggttgcaggaacacagagagggcaggctgcaggaacacagagagggcaggctgcagaaacgcacggagggcaggctgcaggaac

SEQ ID NO: 157323 - DNA, 616 bp, Homo sapiens
ctaaatgggtaacatgattagccctatatctattaaagaaattgaatttgtagttaaaaaccttaccacaaagaaaattctagatggctagaatgtgcactagaggaaatgatgcctagatggctagatggccgcacagtgaatttcaccaagccttaaaggaacaaagaatatcaattctataagactcttccagaaaactgaagttgggaattctttgcaacttattctatatggccagcatcactctgatatcaaaaccagacaaagccattatgagaagagaaaatttcagaccaatattcctcttgaacatagatgcaaaaattcttaacaattttagcaaacctaataagacaatatataaaaaggataatacatcatgaccaagtgaattttatccaagaaatgtaaggttggtataacatttgaaaattaattgatgtaattcatcatattaataaactaaaaaagaaccacatgatcatttcaatagatatgaaaagaagtatttgacaaaattcaacacacattcatgataaaaattttcagcaaactcaggatagaaagtaacttccttaatctattaaaggtatctactataaacccacagcaa

SEQ ID NO: 157324 - DNA, 559 bp, Homo sapiens
agacagtgctgttcacctagatgagaccactcacagtccgactaagagttctctagaaccagaatgtcttagtcacctcaaagctgagagtcattttagctataattatagaaatccaagccggacgcagtggctcatgcctgtaatctcagcactttgggaggccaaggcgggcagatcacgaggtcaggagttcaagaccagcctggccaacatggtgaaaccccgtctctactaaaaatacaaaaattagccggctgtggtagcatgtgcctataatcccagctactcgggaggctgaggcaggagaattgcttcagcccgggaggcggaggttgcagtgagccaagatcatgccactgcactccggcctgtgcgaaagagcgagactcctcaaaaaaaaaaaaaaaaaaattggcggttaccttcagctcgggtttgggtagaagcagatgcccttggccttattttaactgagtcaaagatagacttagaagagtactttttactaccataagacgaacgagaccttaacaggtatcgggagtggcgtataaag

SEQ ID NO: 157325 - DNA, 664 bp, Homo sapiens
tcgagcgcggaccccaaggtccttagccgtaaaccattagttgcattacttatcatctttgctctccttagtcttcttatctctgccttgcttttacacatttcacttttctgataattcttcatttctgccaatctctcttcctcctcttttgtaatgcatttctgtatcaattcaaatttttaattcaatcttctctctttatgacactaccactttttttttcttttaacctggtacctttaaaaatgagttttctcctgtaacaatagtctgtttaaatatatcgtttcatccacttacaagcaccatgttggatctcaaaaatcttaacaatctcacataattggaagacacatctaaatatacttaaatggtattggttattcataaaaaattctcctgagttatttaagaacttgctaaatgtttttaaattcgatcttgaaacacgcaaaaatttcgaggaaatctaacctcacatctaatctctaatcattccaaaaaactagagacaaccactattctaataaagaggtaatttaggatcttactacattgatgtgagtaaatattgagtaaccaacttctctaaatcaacagaactttagcgctatttattcacatatgggcttaagggacccttggggggacctctagagtc

SEQ ID NO: 157326 - DNA, 331 bp, Homo sapiens
ccagggcacagagccgggcaaagaaaggctgcaaataaccagcaggctatgtttgtgcggcgggcccccgaggggaaattgcccaataggtgttggattctatcttatttggggtggcgagagtggcctaggtactgggagggaagcgtccagcaggccacactgggtttgccccgatcccacgtggtcggttctcccaggccctagagctgcagctcctttgctgtgtttgcactgtgcaccttgtcacctcctacccttctctattcttcagctcttctctttataagaaattccctctgcacccctcttccagctggtttaatcctac

SEQ ID NO: 157327 - DNA, 280 bp, Homo sapiens
ccaggggctggagccagatagtgcctgctccatcgcctcctcacaaacgacagataaggatgagaacagcagcaaacgctgaccccccacccgtgagagcataagtcactcaaccgtcaaggctgcatggccccccccaccccaatttaattcacctgtgagagggcaagtgcctggctcagcaatttctagtgcatgtaacagtacttgctttgtgccaatatgtattttactatatatatataaactctagatccattaaacaatgtattattacata

SEQ ID NO: 157328 - DNA, 265 bp, Homo sapiens
accaggatgagcgggccgaaaacggagtgtgcgcggcagtacggatgcgcggccagtacggctgtgctataatcccagcactttgggagtccaagacaggcgaatcatttgagcctaggagtctaggatcagcctggccaaccttgcttctactaaaaatacaaaaattagctggccatggtggtgcacgcctgtagtcccagctattcgagaggctgaggcatgggaattgcgtgaacctgggaggcagagaggttgcagtgag

SEQ ID NO: 157329 - DNA, 750 bp, Homo sapiens
ctctttggaattctttaccatttccaggaccattgcagttagggcaggaatggagtggtggtgattcctctttcctcttttggtttgaaccctcctttcaggatgcttagttacacaggcctgtcctctctggaaaaaggggatcagtagtaggtttctccactttttggagaaacctaaactaaagcttcaatggggcaataccttttaggagagtttgaactgacagtctggcttcctattcttgcggagagttatgctgctattaggcagagggcttgtttccaggttacaaatctttttagcaaagaagtgagtgtggaatagaatcggaaggacttgtgtagtccttggatataatttaatgctccacatcccagagagagtaaacattgtaaagtgtgcaagatgggttggattaatatcctgacagcatgtggcttggcatgtagggcattccttggagacccttcttaccatacacagctgcctttgccgggtggcctcttcccacaggtctttcccagcagctgtgtgcacctgggtgaatcatccgttccctgtgctttgaaaaaacccattttaactgattgaaaggcctcatacaggaggtgcataaaagacaacctgaaaatgtttttaagtacaacctaagtgctctgaattgtccaggtatcactcatagagcatggtgatctcatctggtttttgatgaatggaaaactggctttatgtgctgaacaggggagc

SEQ ID NO: 157330 - DNA, 324 bp, Homo sapiens
atagtgcccaatagagtaaacttcttacaaaagacgttgggctgcctactagtcctcaccacaggaaatggctttcccagatggatttggtgacacagtaagaggcccagagatcttttagtccagtagtatcaaatttcagtgtgtatcagaataatcaggagggcttgtcaaaacacaaatttctggcccaccctcccagagtttctcattcagtaggtgtgggctgggagtcagaatctgcgtttccaacaagttcccatgtgatgccaatgctcctgatctgggaactatgctttgagaaccatgttccagtccacattc

SEQ ID NO: 157331 - DNA, 137 bp, Homo sapiens
gacgaacctctgcctatcagacccctccatccatcccttctccaatggtctccctcctctttctcctcctttcctctgctccagccactctgaccacctctggccgggcgcggtggctctcgcctgtaatcccaaca

SEQ ID NO: 157332 - DNA, 138 bp, Homo sapiens
gatggagtgagaggaggaaagaggtgattttatacaggtaggcagtatgagcaaaggcctagagtggtccaggaggagaaatagaaactagaaataaaggggaggctgaagagatccaagtcaacattataccctgtg

SEQ ID NO: 157333 - DNA, 408 bp, Homo sapiens
aggaataatcccttcttcatggggtgagggggaggatttgtgttgaacaagcgtggggcaccaagcctggcccatcatgagcacagaatccacggcaacccctgtacttgttgtggttacttacagtcagaagcaggggctgggagaagaacgaagacctggaacatcccagctccaggcacctcagagaagccccaagagaaagggtctgggacgcgccttctctgagtaggcagagcagcactgagaaaatgccagagccacatgcaggggaggcctgggcatgatcaggacagatcttgtcccagtggagggagcccctgcagcagggttccaatactcatgttttttgtgtgtgtttttgttttttgttttttagaaatggagtctcattctattgcccagtgt

SEQ ID NO: 157334 - DNA, 480 bp, Homo sapiens
cctatttctatagagttccatctgaatgaaatcatgtagaatgtgatctttcatctgttttgaaggttcatccacgctgtagcatatgtgctttgctactttttgtgatcaaataatattccaccatgtgggtagacaacattcagtgtatctctacatctggtgatgggcatttggattaattccctctttgggttattaggaggatgctactgtaattattcatgtacaagtttttgtgtggacctgtgctttcatttttgaatatgaaaatctggcacatttccaaggaagacatacaagtggccaataagcacatgaaaagatgctcaatgaaatacatcatcagggaaacagaaatcaaaaccacaatgagatatcacatcatacccataaggttggctagaatcgaagatacagaaaattggcctggtgcggtggctcatgcctgtaatcccagaactttgggagaccaaggag

SEQ ID NO: 157335 - DNA, 241 bp, Homo sapiens
ctgaacaaaggagcaaaaggactcgggattctgaagcgctgtaaaataccatcataactttgaatagtccttgataatgcaatgtatgatacaattgtattgatgcatacaatattttatcttttcagtaaacctttatgattcttattgagttaatgaaggatgtagcacctgagctctgtctcttcatcatacttgtctttgataatgacatgaccagtaactcactccggcccatatg

SEQ ID NO: 157336 - DNA, 512 bp, Homo sapiens
acaaactactacaaggatgtcagcgctgtggagtgaagaaagcagaggcttcagagccagagagagctgcatttagatcttggatcctccacttgagagcagttccttggctatatgacttgccaagcctcatctgaaaaatgggaatatggaaaatcatcttacaggattgattaaatgaaatatcggtgttgtcctgagcatggggccttgtactttataaattatctctattgttcctgtcattagtcattaataataatcctcaattcatctattactaatgctgctaatactgtgataggtattaggaaaataggctgggtgcggtggctcacacctataatcccagcactctgggaggccaaggcgggtggatcacttgaggccaggagttcgagaccagcctggccaacaagatgaaaccccacttctactaaaaatacaaaaattagctgggtatgctagtacatgcctgtaatcccagccactcgggaagctgaggcaagaga

SEQ ID NO: 157337 - DNA, 243 bp, Homo sapiens
gagctcaagtgatccgcctgccttggcctcccaaagtgctaggattacaggcttgagccaccacgtccggcctgagcttgttttcttataagaccgctttacttacgtcctttgtgccctataattacccgattccaaagttgaaaaagtagtttcccagcttttttggtctttgtatacatgctgtcacaatgcagttcttcctttgtctctttatagccgtgtctcaaatgctgtctctag

SEQ ID NO: 157338 - DNA, 418 bp, Homo sapiens
acccatgtcagatgctgcccagaggccaaggagcatgaggactgagaaacaaaaatgggcaatgtggatgtcactggtgacctagagaggagtaaatttggtgaagttcaccgtaaaagacacagtggaggccggacgcagtggctaatgcttgtaatcccagccctttgggaggttgaggtgggtggatcatgagatcagaagttcaagaccagcctggccaagatggtgaaaccccgtctctactgaagatacaaaaattatccaggcttggtggcattcacctgtaatcccagctacttgggaggctgaggcagtgaattgcttgaacttggggtgcagaggttgcagtgagctgagatcgcaccactgcactgcagcctgggtgacagagtgagacttcatctcaaaaaaaaaa

SEQ ID NO: 157339 - DNA, 273 bp, Homo sapiens
gacaagtctaagcacttgaagatcattaccagggaataaaaagcaaggtttaaaaattgcagctgacttccaagctgctttccctccggctctgcgcagggacgggcactgaacagcctgctcctgctgtcctgacacgtgaataaaaaaggaaaggggtgtttacaaatggtacattctcctgacctatccaattcacttccttctaaagcccaagtcctgcccctccactgaaaacagcactcatactgtaaaactattccattgagcccg

SEQ ID NO: 157340 - DNA, 127 bp, Homo sapiens
tagcttacaagacagaagaatatggtttagaaactcccatgaaaagttatttttcagtgactctgttggcttcctcttaacctcagggcccccagcatccagcttctgaccatttggaacagaggga

SEQ ID NO: 157341 - DNA, 294 bp, Homo sapiens
agcaaggtttgggaggtgggatctctaggatttggtaactggctgcgtgcagggaccagatactgatgctgcccacctttctgtttggggtgacagtgggtgaagtggacctgtcaactgagataggccatcaaagggaaaaagaacatgggagggagttgctgaatctagccctgttgcgtttgcgatgtccaaggaagattcagggggatgcgcagaaggcagcctgaagtctgtatacttcacatagacatgtgatcacatttcctgagccaaaggctgttcctaaaggct

SEQ ID NO: 157342 - DNA, 530 bp, Homo sapiens
atgtttcgggaaaaacaaaaacaaacaaacaaaaaacctgtaaagccctttgaccctttgcactacatgcacttataaaatacaaagaacaaggccaggagtggtcgctcatgcctgtaatcccagcaatttaggaggctgaggcaggtggatcacctgaggtccagagttcaagacaagtctgaccaacgtggagaaaccccgtctccactaaaaatacaaaattagccaggcatgttggcatatgcctgtaatcccagctattcaggaggctgaggcaggagaatcacttgaatccgggaggcagaggttgtggtgagccgagattgtgccattgcactccagcccgggcaacaaaagtgaaactccgtctcaaaaaaataataataaaataaaatacaaagaacattgcattgagataaaaattacaatgtatcattgatttgaattttttctgcatgtaattcatcagttaattttattctgtagaaatttttccctgctatttctccatggcaaatgaaagtagt

SEQ ID NO: 157343 - DNA, 363 bp, Homo sapiens
gcgctgatggaacatgggaaatactgttgcaaaggccctcgataggagagcgtggagatgcctagaaatagacatatcacccaacaacgggttatctatgagaactgcattgttctcagtgtgactgggcagcacaggctatggcatcgggatatgaaaaatatagtaacatactctattacacatcctctttactcagagcaagaggagataaacacaggtcatgactaagccactttctccaacgttcacttccaattttgtgtgtagctctgatccagtcatcaaggtgctgacttaaggaaaaagtgtggatggaatatgtggtgtagggccaggcacagtggctcatgcctgtaatcc

SEQ ID NO: 157344 - DNA, 108 bp, Homo sapiens
ctcatgggtgatacagacaagggaagctcaaagaggaacaccaagaggaagagaagggaggggtggtgaatttaacctgtgggagcctccagcaggtgtaaaactcaa

SEQ ID NO: 157345 - DNA, 291 bp, Homo sapiens
gttgatggggatttggatcatttctagtttttgacttatgcataatgaacattcaagtacaagtctttgtgaggacatcctctttcaactttttattttgaaaaatttaaaccccacagaaagattgaagtaagtagtatagcaaacacctatttactcttcacctagattgactattaacatttgcctgctgttctttgcctttttctataaatataccttttccagaaccatttgtagatattatactttatctcttatgtatttcagcatgaatttcctaagaatgag

SEQ ID NO: 157346 - DNA, 508 bp, Homo sapiens
cagatccttcgcatgcacagttcataatagggatcatgagactctaatgccaccactgatctgaaaggaggcagagctcaggcaataatgcttgctcacccaccgctcacctcctgctgtgcagcccagttcctaacaggtcaccagctggtaccagtctgccacctggaggtcgggaatccctgtctgaagtgatttaaaacccttcagtaatctctattgctcttcatataaaggctgctctttcctcatcagggcctatactaccctgcatggtattgtctctgtcacccctttgggctcatctttctcagtcattctttcctggtgttcaagcatgcttttttttagagagagagggggcctcattctgtcactcaggctacagtgcagtggtgcagtggtgcaattatagctcactgcagtcttgacctcctgagttcaagcaatcttcccacttcagcctcccaaagtattaggattataggcatgagccaccatgcccagc

SEQ ID NO: 157347 - DNA, 233 bp, Homo sapiens
ctctagaccaactgggtggcttaaacgtggatccagatagtgtcagtacacagaaattacctgtgtgtggttctcagccctgctgctcattggagtccctgggagctcttcaaattagagacgctagggatgctcagtccctgccccctccccctgagtttttaaaaatagctttattgcgatacaattcaaataaaatacaatctacccatttaaagtatacatttcagtgg

SEQ ID NO: 157348 - DNA, 354 bp, Homo sapiens
ggtgaattagtaaaagagggagcctcttgcagctgagatagaggaaggccactgtctcctgcctgcccctgggaactgaatgtctcggtataaaaccggattgtacatttgttcaattctgagataggagaaaaaccgcccgatggtgggaggcgagacatgtttgcagcaatgctgccttgttattctttacaccactgtgatgtttcggtggagagaaacaaatctggcttacgtgcacgtccagtcatagtaccttcccttgaacttaattatgacatagattctattgctcacatgtttttctccttattatcaccatgccctcctacattcctttttgctgcaataatg

SEQ ID NO: 157349 - DNA, 411 bp, Homo sapiens
catcgcgaattcaccatcgcggattcaccattcgcgaacccaccacttcgtagcccagcagacaaggttctccttccccccagccaggattctttcagctctggtcccatccttattctgatgctacagtcaatagtgtaaatcctttccccagtataggactctgaaatccccacattgttttgtgccgattattacatgtacccaatgtaacatagataaccttcttccctcttctccattccccgggactgagggtctgcactcctgactctcagagttcctcttgagtgttggggctctgtctcctgttaagagaagctttcttccctaggtccctcctcctctccccctttcaccgggagatgccaatcaaagtgcaccctgccctggaggtgggctgcctcgagt

SEQ ID NO: 157350 - DNA, 136 bp, Homo sapiens
gatgcagtccgttcgactgagcctaaaatttgtatgcgctcgccaagttgcactaagcatcttgactcagtccgcaggcttctgcagacttcacgctctgaaaagctgatctgagctgctgtctttcatgccagca

SEQ ID NO: 157351 - DNA, 296 bp, Homo sapiens
gggatgcagcagctactgcccacagaaaagccatctccccgtggccttgatactcccttttaagaagtggtaaactggccgggtgcaatggctcatgcctgtaatcccaaaactttgggagtcccaggcgggcggatcacctgaggtcgggagttcaagaccagcctgaccaacatggagaaaccccatctctactaaaaatacaaaactagccaggcgcggtggtgcatgcctgtaatcccagctactcgggaggttgaggcaggagaatcacttgaacctgggaggcagatgtt

SEQ ID NO: 157352 - DNA, 1306 bp, Homo sapiens
gcataatgaggaaaaaataattcctcagaaagttaaaaagtgaaataaaatgtaaagctgtcagtgaaagaaggaaagaataacccaccacaccacaattcagaaaaccagagtttatgagacacacattgtgttttcctggatatgcaaatgttgttttattaaagagagagggatatggtatatattttcatctaactaccacatcttaagtaatcagttcaggctcttatgatgaaatctttaattactagaagtgtgtcattagttagatgtagaatgaatgatagtaccgtgttttattgcctcacatgatatagccatttgtgccataaattcattgacctcatcttaaatgatgagtcctgtaagacagacttgattcattatttcttaagtgacagtttttcctctaataattttttgcttcaccagaaagattgcttttctgtatttttagatcagtattctgaattgaaatttaataaggcaaggacacacacacacacacacactctgtctctctctctctctctctctctctctctctctcacgttaccgaaaacaagatagtcatgaactgtcacactactacttgaacactttgggatgctgctgaaaatcaagcagctaaccataggcctttgctttaatgggaaagtttgatgaaataggattttgcttctaactttgatgtctgtaattctttttatgtcaaaatcgatgagatatggtggagaattctcatttgacaattgggatagatctatgagcattccttattcatcattggattactgaaagtgaaggaagggaagggagaacatataaattatatttagattattattattttttactccatttgaaaatatttatttggcttgaggaaacaggaatcctttggaggcaaataattcaatctggcaatttaaaaaccaattaaggatttcagaaaacccttctcccttatggctaaaaaataagatccaaaaaaatatgccagaaaatgggtatattattttaattagcttaattcattgataattttttttagtcaatgattaaagaagctatttttgatccttcacttcaagcttgtaaatttgcactgcaggcttccagtgatgctagttggcaccgcaccggtattacttctcatggaattatgcccgtatatacttagttataaagcaccggtttataaaaccacagcgtaggtctcacgtgcagtacctgtgtatagggcttgtgcggcgcacccaggcagcgataacgggcacgatctagagaggctgccttttg

SEQ ID NO: 157353 - DNA, 349 bp, Homo sapiens
tctaggtgtccaaaactaatttgacttcctgtttcaagggcacctactttttctctccttgcaaacttgagcacagtgaagatgagcatttctggacctgaaggagcatttggggaacagttccatggagggagatgcttgctggagcagtattttgtggattcatttcggcttgtctgtggcagccgaacagcggtttccaacaaaggctttcactgactcagctccaagcatgactcgtaaatctccttttcccctcttgctgatttttctaggcatctattgtccacaccctgaccacacactgtcacccatcagagtccccagttgactcaggtttacactgtgc

SEQ ID NO: 157354 - DNA, 123 bp, Homo sapiens
atgacaaactcagctttctgggtgacatagatggttgtatgtaggtaacagggtggtttcacggatggcagattcattttagaaattgtaaaatggctagcagttttcagaacaagagattag

SEQ ID NO: 157355 - DNA, 493 bp, Homo sapiens
agaattcctccatagagcaggggtccctaaccctcgggctgctgaccgataccagtctatggcctgttaggagctgggccacacagcaggaggtgggcagtgggcaagcgggtgagcattaccacctgagctccgcctcctgtcagatcagcggtgacatcagattctcataggagcatgaaccctgttgtgaacggcgcacgcgagggatctaggttgcgcactccttatgagaatcgaatgccgatgatctgagatggaacagtttcattctgaaaccttgggtccgtgggaaaaactgtcttccatgaaacttgtccctggtgataaaaagcttggggaacactgccccagagcattcagaaggagcatgccagccggctgcagtggccacgcctataatcccaacgttgtggaaggccatggcaggaggacggcttgaggccagacttttaagactagcctgagcaacacagtgagaccctatctctac

SEQ ID NO: 157356 - DNA, 415 bp, Homo sapiens
gtgtggggctcaataaattcctgttaataactgattgataattatcagctacatttcagaaaaagtataactctcttttctcctgaattccgagtacaggggcactacagattttaaccttgttgtaaaaataacgacacaaaaacacagagatgaattaactgacttcttagggtgatgcacttgctcatgagtggggcaaggattaaaatggttacagcttctttcctggactgaggtgctaggggaattcattcagattgattcgggttcatatttcatttaaatgctctcatttcacttctgctacatgcaccttctctgacttatatttcaggacctgcagtctgaattggtttacttccacttcagatgctgtcaagataaattagacaccaagggtccatgataccat

SEQ ID NO: 157357 - DNA, 136 bp, Homo sapiens
ttagtaacatgcaggaaagtcggagagggagagttctaattcaagccccgtgggtgacaccctactgaacgtttaacacaggcatggaattccagagttgtagcgtccatagaacggcagtgccgtccaacctcta

SEQ ID NO: 157358 - DNA, 254 bp, Homo sapiens
agcccactgcactccatgggaaacgcagcaggtgttagtctgggcgcaggaccctggcatttgtcccacgtccccgcttttgcatgtgtctgcagcatttcagccgaggccatggttctgtgcagatgctgagcaattctcccggacaaggagcgtcttcatctcccatcagcaattctaggtcccttccacccacacagagcgcagctcagagcccagcctggagacaggctgtgtaagatctcaggacaggc

SEQ ID NO: 157359 - DNA, 503 bp, Homo sapiens
ggacagtggttgccaagttatcctcccctacagctttgtccattgacatgtctgcagagcacaatgacagtgactgttccccagaccttaccatcggggctattaccaaacttttcagtccttgcttataagacttttttatttttttgcttgaatttgcaagtttttaattatcagtgaggttgagtatgtctcatatgcttgtgaccaagtgtattctttttttctgaagtaacattcatatccttcatcatttttccacttttttttatctcattgattgaaaagtttctttgataaggtcctttgcatattgagaacaaaggtcaccattgtttctatgggtgaagaggcctcaagcttagtggggtgggcacttaagaagtgtgaacatttatgcgctttgacccacttgcaataatttattctccaaaaacaactgaaagttcaacagaaggcaagagctgtgtgtccagtggtattcatttaaaaaaaaaaaaaaa

SEQ ID NO: 157360 - DNA, 648 bp, Homo sapiens
gcacgatctcggctcactgcaacctctgcttcccgggttcaagcgattctcctgcctcaggctcctgagtagttgggattacaggaaagctcagtggcccccaagccaggatgtcccaagcttgggtccccggcctcgcgcccaccttgctgttcagcctgctggctggcccccaaaagattgcagccaaatgtggtctcatccttgcctgccccaaaggattcaaatgctgtggtgacagctgctgccaggagaacgagctcttccctggccccgtgaggatcttcgtcatcatcttcctggtcatcctgtccgtcttttgcatctgtggcctggctaagtgcttctgtcgcaactgcagagagccggagccagacagcccagtggattgccgggggcccctggaactgccctccatcatccccccagagagggtcagagtatccctttctgcgcccccacccccctacagtgaggtgattctgaagcccagcctgggcccaactcccacagagccaccccctccctacagcttcaggcctgaagaatataccggggatcagaggggcattgacaacccggccttctgagtcacctcctgcctggaatcttgccatcagcaacctcctccccagtgcctcctggatc

SEQ ID NO: 157361 - DNA, 483 bp, Homo sapiens
acaaaaaaccagctcctttgccttcctagccatgtttcagatgctcagtaactgtgtgtggctgtggaactggacagctcagccgtagagtgtttccctttcttgttaatctttttttagaaatgctaacggtggagactaaggcatacaagtatgactagaattgccagctacacattagaaggtttaggttcaaaactgggagtaaagacttaactcttggagcttgggatagtgctacaactagtcctggcctgagccttttcttcattcatgttttatcctttttttctttatttttggacactgataagaacctgtatgagattgtttccttttttccccccgcgttgtaggtatcttgtcttgctattttgcacaggctgatctctaagtcctggcctcaagtgatcttcctgtttcagtccccaaggtgttgggattatgggcatgaactgctgcacccagccctttatactcaaa

SEQ ID NO: 157362 - DNA, 450 bp, Homo sapiens
aggtttaggttcaaaactgggagtaaagacttaactcttggagcttgggatagtgctacaactagtcctggcctgagccttttcttcattcatgttttatcctttttttctttatttttggacactgataagaacctgtatgagatcgtttccttttttccccccgcgttgtaggtatctcgtttcgccagcaacctaataaaaatcccacccttaggcttgagttctcctgtgctcaagcaattttcttaccttggcttcctgaatagctgggactataggcatgcaccaccacgcctggctaatttttatatttttagtagagacggggtcttgctattttgcacaggctgatctctaagtcctggcctcaagtgatcttcctgtttcagtccccaaggtgttgggattatgggcatgaactgctgcacccagccctttatactcaaa

SEQ ID NO: 157363 - DNA, 1090 bp, Homo sapiens
tctcggcctcccaaagtgctgggattacaggtgtgagccaccttgcccggccaaggctcccacttcaatggactcatttactagaaacaaactaggtctttgataatgtgtgtgctggcccgtgtgaaccaccagcttcttggaaggggaaaataagagtgccttgttttcaaaccaaaaagaactagaaaagaagggaaggcctgtcttcctctggctgtggtagtccatcatggaaaagagcgttacactgcccttcccttggggtgctgtgtgacatacctgctggagagggcacatgtcacaggagggcaggcaggggaagcaggcaggagatgcaagaggaaaggagaaagaaggggactttccaattcatcaggacatggctgatagcaggaactccattttttaaccatcacttccccacctcccccagaaaagctggtggtgggataagcaatcccctctcagcacacctccccaccagagccttgtcttggccctccagcagccctctggatgaggccaactccccacccaaggtagacccctcagagttgctgaagcagaggccgctaccctgcttcattcccagagtgtgggttcaggcttagagcttgtgaccagggaagacacaggaacggaaaggacttgttcaggtgacagcttgtaggtggcagagtcaaaagtaaacccaggacggaggccaagattatttccctacacctcatactgctattttgtgtgggagtttactggaggggcagggaggcgggaggggtcagtggcgggcgcctatcatctttcccagcattgttcccttaagaaaaccgtcaatcaaccactcacgacagagcttggggcaatcgtcccatcctacattaggagtgacccatactccaccagtaatagggaagagaatcataagtgtcccttctttttatttgcataaaatctccagaaagaactggtagtattttttaccttcaatggggagcactagataactcatggagtgacttttgtaccatttgaatatcgagtcatgtgaacatatagtctactaagaatatcctttaaaaaaaaaaac

SEQ ID NO: 157364 - DNA, 431 bp, Homo sapiens
agctgggcatttggggatggaaagattatgagaatgacacagcactgcccttcaggtgatcctaagagagaaacatctcaatgtagaattccagtagaatatagtagagagtgccacagtatatgctgagcactttattcacagaatttaaaaatatctcatatttttatattttttggacactgtgctctagcctggcgacagggcaagactctgtctccaaaaaaaaaaaaaaaagaggagatgagaggatatggatggtcatgtcatgttgtcagaggcataaaaaccagagcaatcccatcttgagtaggggctgggtaaaataaggctgagacctactaggctgcattcccaaagagttaggcattctaagtcaccggatgagataggaggtcagcacaagatacgagtcctaaagaccttgctaa

SEQ ID NO: 157365 - DNA, 373 bp, Homo sapiens
tgttaacatgccttttttacaataaatactaaaggaaatctttaaagttaaaaagatgactccagataactggaatccataggaagaaatagcactgaaaatggcaaatatgtgggttcatataagtgactatataattatatttatcttatttttataccttctttaaaagacatgaaatgatataaagtaataattttaacactctactattaagtctatagcaaatgtagatgtatatgacatataatatatatcacagtaacagcacaaagagggtgggagggaatggagctctattggagcaaattttctatattttactgaaattaagttcgtgttaatctgcaatagattgtgataagttaaggtg

SEQ ID NO: 157366 - DNA, 376 bp, Homo sapiens
tacaggtatgtgtcaccacatccaacttagttcttttgagtacatacctaggagtgagatttctgggtcacagagtaattctatgttcagctttttaaggaatggccaaactattttccacagtggctgcaccattttaaacttctatcaacattgcatgcaggttccagtttctccatgtcctcaccaacactgttatcttgttattttccttttcccattattttaatttttgtaatagccatcccagtgaatatgaagtggtaactcagtgtgatttaggtttgtatttccctagtgactgatgatgttgggcatcttttcatgtgcttgttgtctatttgtatatcttctttggagaaacgtctatgcaaat

SEQ ID NO: 157367 - DNA, 490 bp, Homo sapiens
ccacccaggaagcagctcctatggccgatccccaagtgcaggggtctctgggcttctgtcttccctgataagcccacacatgggagacagagagctcagggtgggacttgggcttctttcagaatgagtctgtccatgaggctgcacctcagccttaaggacatgctcaaaatgcccatctctatatgttgaatcaaggacctctggggcagactgactgactgaagtgagggtcatgcttgtaagtcttgaagacttttcatcaaactttctgttaaaatctaagatcaaaagcaactactatccaaaatatcagggtttgctgccaatgaacggaatgacttggaggaagaacaactcattactgctgggcctgaggaacaggctggaagggagcggacttcaccagggactttccacaggtgaccctggttctgcagtgatagaagctcctataccctaagctgtaaaattattcagaaagatcaag

SEQ ID NO: 157368 - DNA, 644 bp, Homo sapiens
ccacccaggaagcagctcctatggccgatccccaagtgcaggggtctctgggcttctgtcttccctgataagcccacacatgggagacagagagctcagggtgggacttgggcttctttcagaatgagtctgtccatgaggctgcacctcagccttaaggacatgctcaaaatgcccatctctatatgttgaatcaaggacctctggggcagactgactgactgaagtgagggtcatgcttgtaagtcttgaagacttttcatcaaactttctgttaaaatctaagatcaaaagcaactactatccaaaatatcagggtttgctgccaatgaacggaatgacttggaggaagaacaactcattactgctgggcctgaggaacaggctggaagggagcggacttcaccagggactttccacagttcttgtccttcttcttgtaagttttttgaacatgccagtgaaaaagcagttcagccatttggtgaaagaaatttccatttaccaacataggaagagttcatattcacagactccaaacatagatagagtcagccctcctcattcacggtttctgcaatcctggattcaaaagatgtaaatcaaaaatatttcttataaagcatctctactaaacatgtaca

SEQ ID NO: 157369 - DNA, 303 bp, Homo sapiens
gctggcgtctccaaggagctgggtcccaaccctgtgcttccctcccccatcgtggagcagcgacttggacatggtgctgacatggtccctccccccgaccaggaggagtggaatgttgtgatgtcacagtccacctagtaactgccgttactgcaagactggcctttgaccttacgacccagtcccctaagcgttctcaccccgtttctggttcctctggtcacagcacaaatttccagctggaaggggaatggagactatgggacctaggagcaagaggttccaggctgcctcactccctta

SEQ ID NO: 157370 - DNA, 250 bp, Homo sapiens
attcccccttgcaaactgtaccattccgtagttttaatgtgctcacagaattttataatcatcaccacaatcaattttgaacatttttattacccccaaaagaaaccctatgcctattagcagtcatccccaatccctccatcctcccagccctaggcaagcactgactttgtctttatagatttgtctgttctggacagttcatggaatggaatcaaatgtagaatcataaattgaatcacacaatata

SEQ ID NO: 157371 - DNA, 295 bp, Homo sapiens
atcacaatattttttccccacagttaaaatcatcatacttcattatttcccaaatcttaccagtacctccttgatgccttcttttttccatatctctttatgaaagcatagagtttggcataccctaaatcatcggctagcctaagcaaagatctactgttaactatttccaaaaagcccctctggagaatcggtagagtactagctgctcttcttgagaaagtaaggtaaggctggacgtggtggctcacgcctgtaatcccagcactttgggaggccaaggcaggtggatcac

SEQ ID NO: 157372 - DNA, 355 bp, Homo sapiens
gtttgcatttcttactcctaccgaactacagcacctcaaagacaggcactgggtgttattcttttgcacctgttgctgtccctaggacaccggacacactcagcctgtgcttgccaagggtatgtgtatgtactcaaatacacacatcctgtaaacagctgtggtggaaacccaagaccagacttgcagagaacgggatctattttgcaggccacagtgaagggctgtgtgagcttgagtcctctctgagcctcacattttacatcgaagacatgaagggctggtccgactggtttccaaaagtccttccaactgggacagcctgtgaatctgccggtgttccaactgcaccagc

SEQ ID NO: 157373 - DNA, 408 bp, Homo sapiens
tttttttttttttttttttttgagatgggagtttcactcttgttgcccaggctggagtgcaatggggtgatctcggctcactgcaatctccgcctcccgggttcaagcaattctcctctcacatcctctcgagtagctaggattacaggtgcatgccaccacgtctggctaattattgtatttttagtaaagatggggtttcattatattggtcaggctggtctcgaactcctgacctcaggtgatctacctgccttggcctcccaaagtgctgggattacaggcatgagccactgcactggctcctggccagccagttggcatctctttaaggtctccactatccacctatattaagtagcacagaaacacaccaagttaatgatactagcattcatctccccccac

SEQ ID NO: 157374 - DNA, 106 bp, Homo sapiens
tatggggaactacagaatttttcaggcctgtttaagtgctgttctctgctttgtgacaagttcaactttctggagttttcaagttggaagggatgttttctagccc

SEQ ID NO: 157375 - DNA, 543 bp, Homo sapiens
ttgggaagtttgctaatttaataaacaggtatctcagaggaatcaaaggtctacgtataaagctgtaactgaaagacgccttattagggatttcttcctgtggtgtggtggcacaaatgtagtcccagctacttgggacaccgaggcaggaggattgcttgagcccaggagttcaagatcagcctgggcaacatactgggatcacatgtctttaaaaaaaaaaaaaaaaaaaatggtgttgagagtatctacggctacatttacatttacattcctgatattctgctgatgagtcaagaaaacacaacactctagtgttcgagaccatacagctaaggctgaatgtataaatataaatggacttgttaaagcttttgattctgtctcatgcagttttcttaacaagcatgacattgcctaccagaaaacgacataactgactggcagaaatgataaaaagaaagggtttattgtcaaccaaggaagcgtctcaagtgccctgtctccagctcacagctctgttgccgcagtgtgctccctctg

SEQ ID NO: 157376 - DNA, 219 bp, Homo sapiens
ggcagacagcagtcactctggcagctaagaacataacagctgcttttggaaatcttttgcaaaggtaaaatatctttctaagaatctggatattcaccaggaaagagcgagggaaactgtccgtgtgttctcttccaggggcataatactatttcaactatacaggtagtaacacagctctccccatatagtttcttcaagtcagtactacacaagcat

SEQ ID NO: 157377 - DNA, 1039 bp, Homo sapiens
gtatttccatctcactcaatatttcagttgttccactatttcattattcttgcagccagctctttgtgtacatggaccaggtttgttaatcaaggttacaattgttggctcagtctcttttgagtgtggggtgctggaaatagcgctgagtaggaataacagccttaggttccaataaatggtgctcacctgtcttgtgtccctggataattcactatgtgtctgtagacctccctggcacctgtggcagcatggtattatggggggtcaaagtcatgctgggactgacaccagcaaggaagccagggccatcacagagcagccctcctctggagccgtgacattacgcaccccatggcagctggtgtaactcagagacctgtggacaaattcattgtcagagtcaggtgaagactgggcacacggcagatctggccagacctgctctttctaatcagtgagatgtatagtttagggaaaaagagatgggacttctgggacagggtaatgattgaccttgactatgaacatcttactggtttgggtttccatttttcttctagcacatagacagtagttgcacttctgtctccactaacttgtttcccatttgtgattgtgatttccaggtgatggctttggaggaggcgggcgtggggtgtgtgtgtgtgtgtgtgtgtgtgtgtgtgtgtgtgtgtcagagagagaggggagactaagtgactgaaataggctgttagtttcctgaatgatggctcctcatggctgaggctgacttgatgccaagtgttagcaagattgagaatgggaaggttggattctacagctgtctccattaccacaaacaggcactgagacactccctggggaagaaagcaccatttgtccacttgacattggcttctgtcttagccctgtgcatgtcctctaggccttgagtagtgttggctgtgtggtgctgcacctgtgcccaaggccttcttgtgaatcagaagaacccttgaggtcacagacaaagtacttcttaaaacagtagaca

SEQ ID NO: 157378 - DNA, 501 bp, Homo sapiens
gttgcagtgagccgagatcacaccactgcactccagcctgggtgacagagcaagactctgtctcaagaaaaaaaaaagaaaaaattctgcataccacagaactattgtaggatagggaagaaagcacacaaacttgagtgagttattctccaattaattttatttgcttattccttctcaaataacctatttaactgtataaagaatgcaggtagcctctattccactccttgatgacggctttagggttctagtctcatttgtttttgagtcttaagtctgtttgtaaagaacaggagaatctatttatcgcccttagcttcctgtagaaaaaaaactagaatatataatcaagttttaaaacttcttagtttagcaactgtttgactactaccatactaaatgatatgccaggtgttctctctgctgagcagttgctaaactcaccattagagtttttgctaagtgaaagtgatgctgtcaggcttagataataattcc

SEQ ID NO: 157379 - DNA, 183 bp, Homo sapiens
aaggtagatgagaaaacccaagtgacaaagaatgtttagtttattattagaaccaactatgagttgtgacccttatcttctgcactgggaattacagattttttcagggtttttctaacgtgaaaagagtttattggtgtaggaaaacatctggttccaaaatatagatcatccttcttgagc

SEQ ID NO: 157380 - DNA, 354 bp, Homo sapiens
agcagcctctcacacagcagccatgtttcttgaacaaactggaccccactccaggggaacagaatgagtacttagacatgtaagtgggcatttacccgcagcagctggcagggcctcaccattcagtacatcctaacaatccagcctttcagccaccaacctaatgggcttttcttggcacggacagttctggcttggcaaaacactcattttcacatcttaaattggtacatgtcacaactgaatggagcttcaggatctgctgtctgtctgacatgctgcacaaggcttctcttggtcagggactcaggtgtccacactcatctcagactcctttctccataaagatccatg

SEQ ID NO: 157381 - DNA, 526 bp, Homo sapiens
actggttccatgtatcagtgtattatagtgatctttttatattaggacatacagatctgcctcattcccttgaaaatcttaaaggttacagaatattccattgtgtgtatcctttatggataccacataatttatgtaacctgtccccaacaggtaaacatttagtttttttccagtctttgctattctcgagtaaacatccttgttgtgtatattttatctacatgtatgagtgtatctgtctctaggataaattttcaggagtaggattgccacatcaatggattttaattttgatagagatttaccaaattctactcctgtcactagtgagaaacttgaatttacatttcttcaacagtttgcatgcaagataatacaaaacacaaatcctttgttaaatttatatgatctgaataattaccaatattgaaacaggaatctgttttccattgccaggtacatgtacatgataaaaagatgaggtataattctagctataatcatgaattcaacctatattttg

SEQ ID NO: 157382 - DNA, 453 bp, Homo sapiens
gccctcgcctgctaaaaatagcctgtcccattatcacgccagtgctatagagcaccacgcgcgtgaacataacacctgcaagggtgtccacctgggacacagctgcacagagggacaggagctgggcacgctgtgctatgtggcgcgagggaatgcaggcatgagcacttactaggcggcacatggctggactgcggagacgtgtgcaacgtgcagagccatgtgtctggggcctgggggacactgtgatgtcatggggaggacccagaggaaccactaacacagccacagggaagccaagctcccgcctcacccccccaccgtttgatttcagccccctcctgccctcagtggcctcagaggaaggaagaaggcagggccaagaccttaagggcacctcatgatggctttttgagccatgtttgtgagtctcgcaggtagggttaagggctc

SEQ ID NO: 157383 - DNA, 200 bp, Homo sapiens
ttatttcattgacatcttgtgaggaaggggaagtagattggggtattcaatccattaacttggactggaagtgtaagtcatgcatacttttttttctctctctctctctctatctttgtcttccggtttttttttttttttttaggaggtgggcgttgggccctggtcccccgggcgagagtgcaaggggcccgttgtca

SEQ ID NO: 157384 - DNA, 435 bp, Homo sapiens
tgctctgtattctttggctgaagatatcctccactcttggggctcaagtgcatttctctaagtcaatgcagcctttacactttgaagttattagtaattcttctctgacccctcatttttgtcagtttagtaatttttctttaatttctgcttgttgatttgtgaccccaatctctagaaaactcttgtcaggtatcttgaaatgtacattttgtacattgtatttccactttcctgtgtccccaaacagttacccatttcccatgttaaagttctaactgcgtatcctggcattcaaagtatctttacattacttattacctacctctccctgttagttttcactaccttcttacatagaatgtctacgttggccaaacctgactaaccagcattccccaaatccaagcccattctttttgttactttactgtg

SEQ ID NO: 157385 - DNA, 343 bp, Homo sapiens
ggaagcagaggcagagggcagggagggtgggaacggttcgggcaaaatatgtcacagtcaggactcaaaggagtgagtcagtgtttcatctgcagtatgcatcattcgatagatgcacactctaagggctgaaccatgcatggattgaagacatctgggaaaagtcacccagttaattctcttggcccttagcctatggaaacagcatatattcttggctcttcctctgtatctccagtgttcagaactggacactgcttttgttgaggtgctcaacaaaagttgggcaaattggatagtaaaataaaagagattttcagctcttcattgtttttccaaattg

SEQ ID NO: 157386 - DNA, 1000 bp, Homo sapiens
gttactcgtgtgggaggaacgcgctttgcagcagcagttagattattaatggactcctatattgaagtgttcacatttttgaaaggctaattacaatataattttaggtttaaaatattgctttgccaagggtagaagttgtgtcatgtattattaagtggtactttactttttcagtcttgagggaaatatgggtttggttatggtaatctttaatatccagttatttccctcacttccccacttgacgcttctaactcctggaaaaggaaaatacgctccgtggctgtcaagtaccaaaaagttacactggagttatcttggattcttctgatttttttaaataaagaaagccaacctgcttataggttgagtaaaaaaaaaaaaaaaaaaaaaaaaaacaaaaaacaacaaaagggggggcgcccgccccccgaatcataaacattactgtcaccatttgtggcgcccgggccgtggagttaaaccccacacattcgcgacaagaattctagagaggggtggccactagttgggcctccaccccttggtggcgggcaagaccgtttattcccacgctcgggcaccgggggacacctcccttctggggccccagcgggtcccctctcggagacccacccaggcccagagccggcgccccctcaatccatccaacaacgcgggaggggaacccccctgggttcttgtcgcaacacgagaacacactcatctcgtcgcaccaaccaacttgccaccacacaaccacggttccctcccgggtatcacacttcaaacgaaccttaaagtggaatccccatcttaaagccctctgcagacatcaacggtcactctcttcgggccccaccgctgctccaacccctggacgccgcgctaaacgcgggggttgtcgctacaaaggactcaggacgctactctttgtgtcccaaggattccggggacatttagggccataacacacctcccggccgaaacttgcccg

SEQ ID NO: 157387 - DNA, 202 bp, Homo sapiens
tctaggaatttcatgaaaaagccagtggatgagagagtggagggggactattcacagcatggttaggggctgtttgcacaaatcctacttctggtagctattctaataaggcaaggatgagtccctgttggtactgtgtgtcctgtgctgacatcagaaatgataaatgtgcctgatgcaggagccacggagttcatcaccc

SEQ ID NO: 157388 - DNA, 518 bp, Homo sapiens
gtgagtccaaaataacagtccactatttaggtggtataaataaaaatggtagatcccttcctctctcctctattccaacaattctaaggaaaataatatcaagccaagtggcaattaagttcaaactagaaatgcatttcattaagctgtgtatttattagaaataaattacactaggctatttatacaaagtattttatgactggctatgcacatttcagaaataactctaagaaggcaaagaaaagtccagacagctaaaataatgtatcttgccaaaatgagatgctatgtttaaactgagagatactatctttccaaatcatttaaatatagtcagacgcagttcaaaagatttctgactatccattaatggaaaacataaacgtaacaaaattcacagcatacctgaaatcttactaatttacctaaagataacatatctctagaatttcacagaagatagaatcagttcaaaatgatgtattactgaacctataacgatttatggactagat

SEQ ID NO: 157389 - DNA, 421 bp, Homo sapiens
taagaacattgggccagaaattctctactttctcttctctttcatccataatcaatttttcttcttctatggataatatcctttaagtgtttcttggaatatcttttattttaaaaatcactttatcccacatactctttcagctgttgctctatttatctgctcctttttagagcaaaatccataagtacctgtactccaatttctgtgcccatttcaatgaaatgggcacagaaattgataggaaatgcaaacagttttaaaaagaaagttgatgcctctcttgtatatcgggagctctggattaaagcttcccagccaccctttgcttccttatctttttcctgtcttatgctatttagcaggctttttggatttactgtcttggaaaggcttcttgtcattgtattctattcaacat

SEQ ID NO: 157390 - DNA, 461 bp, Homo sapiens
gcatcaatactgtcatgggtgtgaatgtgtgcccagactccagcagcttcacgcctcccaaaatgctggtgccaacacctgagaggaggctggcagcccagggactgctagcaccctgtcccagctgaggggcatgcacccaaccatgtggctatttctactgtcacataaactgaatacaaatctctctgccactgcctgaaaaattgtctcactggctggcatcgctctttggaaggttgtggtcagtggtctgggaatacttcaagccctctagtgaagcaggttaccaacattgagaggggagagaacaaagccagaggcccagtaccagccccccagaattagtgtacacaacccaggaatgctgagctgggccttgccctaacaaaaaaaaaattcaccagaaacaaatccaattgactaaactcaccttataccataatcaaacccccaaggac

SEQ ID NO: 157391 - DNA, 360 bp, Homo sapiens
ttgtttatccgttcatctgttggtgtgtattcaggctgtttctgccttcgggctgttgtgaagaatgccgctatcaacatgggtgtgagaatatctgttcaagtccctggctatatttaaattcttttggatatttagccagaagtggaattactggatcatctggtaattctatttttgattttttgaggaaccaccaatactatttttcacagcagccgcagcattttacactcccaccagcaatgcacaagggttccatgaaatcactaattttataacatttttcctgattacatgttcactgtagaacatttagaaaatgcaagaaataaaatttagaaaattaaaattcccctt

SEQ ID NO: 157392 - DNA, 388 bp, Homo sapiens
ctataggaggcggagatttctggaaatctgagatccgaaggttctacactttcttttttctttctttcttttttaattttaaatggatgttctattttttcccaggtttattattttgaaatttttcaaagctactgaaatgttgaaaaaatagtacagtgagcacccacgtatgcatcaccagattctctgtcaacatcttgccacgttagctggctctatctgtctatctatctatctatctgtatatctatccatctatctatctatctatctatccatctatctatctatcatcttcctgaattgcctgaataacctgctgacatcatgacactgtaccccacatccttcagtgtgtggcccctgagaacaaggacatcatctc

SEQ ID NO: 157393 - DNA, 759 bp, Homo sapiens
tttgtctctttacttatggaatttgttatttctccttcattttctaaaggttttttcaaggctttaacagaagtttgggtataattattaagaatcactatagtataagcacagtctagaaaccaattaaattttctctgtgttacatatcaatttggtaaggactatgtaattcctgccatgaggtggaaatactggattcttctcttggccctaagtttcgtttattgacctgttgttggtccatctctctagaactctcggctgagcttcaggccttacattcatatctgacttcagcgatttgtcttcttgtctcaataagtgtaagaagtgggtagaggatggaaagggagaagaaaggattaaagttaagcctgaatgtttcattctccaccttaacatgaccgcatctactaatagccaataaaatgaattggcctctctactgggctgcttgaccttcctcatgacatggcagttggtttttcccagagcagacaggaacaaccatgattcaatatgtgagtaggctatacaggagacaggaaccattgggagccattttgaacactctctactacaggatcaaaagcaaataattacaaaacagtacatcaatgcaacaatggcattatatgtaagcattaatatagaattttggagggaaatcacgagaaaactgaagacatctgtccaccaagaaaagcacaaaagctataaactgaagatagatatattttcaactaactgcagtct

SEQ ID NO: 157394 - DNA, 737 bp, Homo sapiens
caggctgctgtcagaggtctgaagcagccacgtgccctggagaggaggcggtgtctgcggaggttggtcaagagtctgtatcctgggctttgatggaaatgagccctgaggcatgttcttggtgcgcctgttttcatctctaaagtgagcctgttaaacacatgggtttttccttccaacttttaacttttgctttcaccagttaggaatcagatgacgctttccagaatttgtcaagttagaccatccccaccccacacagaattgatggcaggtccatgtacctgatgcttgccgcttcccaactggaactttaaatgtttaccatattttaatctgatttttaaattacagtttaccacttacctgttgtaagaaatcttttcagccgggcatggtggctcacacctgtaatcccagcactttgggaggctgaggcaagcagatcacatcacctgaggtcaggagttcgagaccagcctgaccaacatggagaaacccagtctctactaaaaatacaaaattagctgggtgtggtggtgcatgcctgtaatcccaactactcggaaggctgaggcaggagaatcgcttgaacccgggaggcggagattgcagtgagccaagatcacgccattgcactccagcctagacaacaagagtgaaactccgtctcaaaaaaaacaaatcttttcaagatacaaaaaacagaccaggcccagtggctcacacctataatg

SEQ ID NO: 157395 - DNA, 378 bp, Homo sapiens
tcacaaagacagaaaggagttatcaaatgaccacaataactctaaaaacagaaagtgaggtgatctttcttattcacagtcccacttattcatttagaaatgctgagcaccaaaacaaaaccttatcacaagttcagtatttcgttaataactgccaagtataatggaatactccccaaagtactgcagcattagaacatgaccactccactaaattaaaaattcagcgaaagcttttctaacaaggctggatggagcactaactcaacggccaaacggctgcacttcctgtatatgcacgttcaaaacacctcgaattaacatgctagggaccttgaagaattgtactaggccttgctcaagaggaaggctttgtaa

SEQ ID NO: 157396 - DNA, 190 bp, Homo sapiens
acagttccctgattaggagatggggaccgggaggtggatcaggcatcagaggtcaggctgcacatcggatcagagcaagtctgtgcccccctgatgctccttggggagaatccagtgtgtaaggtgtcacgtggcagtgccagcactcccttcatcctcctgatctagatgctgattggccataggtcca

SEQ ID NO: 157397 - DNA, 539 bp, Homo sapiens
tttttggtatggtatattcacagcatcctgtagccatcagcacagtccccttagaacattttcctcggctcagagggaaaccctgcaccacttagccctcatccgagacccctccccagcccctttttgcagccacaaacctactttctgtcttgatttgcctgttctggatatttaatggaaatgaaatggcatgtggccttctgtgtctggctttgttcactcagcagttttcaaggctcctctgcgtggttctgtgtctggcttcgtccgctgagcatgttttcacggctcctctgtgtggtggcctgtgtctgttcttcatgccttttcatggccacataatattccattgtggggatggacctgttatgtttatccattcgtccatcgatggacttgttggctgttccaccttttggctgttatggataacgtgctacgcgcgtcctggacgaggttttctgtgagcttttgtgtcttcatttctcgtgggtatctgcatgcgtacatgtggaactgctgggccccgtggtgat

SEQ ID NO: 157398 - DNA, 417 bp, Homo sapiens
gatcactagagtaatggccaggactagaagtcaaaagacctgcacttaggttactggtctttttctttgtgtgggattatagctatgttgccatctccataggcaagagtattctcatttttaaaatggagaatgcttttgatttaccaaggtattttaggaattgagaaaagtgctctgtaaatgtccaagtgctataaagtattagatgaaattattcacactctggccctcttatgtgtctgtccccaagctgtttccaacttaatgctattgattgcccaatttgcacgaaccttttacttcaggttggctagtcttttccctgatgcttccaaaccacatgcactcttatgatggcttacatttgttttacccgctttctcccttttgactgctaagtctgcccgtcaaatc

SEQ ID NO: 157399 - DNA, 278 bp, Homo sapiens
tttctctgtttgggacctgactatctggatgaatgaggaagacccggaagaagtaaacttggaggagggaaaggcaagcattcccttggaggatgtaactgttgagatgaccttgcatttcaacatggagctttccttctcactcccaactccattagtgtctccatctatggcgatctctccaatgatattgggagagcttccatttagggctccctggccacgaggtcatcagtggcatcacaggaggtcctaccaggaggtataaatttaagtaa

SEQ ID NO: 157400 - DNA, 858 bp, Homo sapiens
aaatgtttaatctagcacactgggtaaagagaaaatagctgggtaaggcaccacattagtggcaggggaccagcacactcatatgtggctagtgtgtgaaggcaattaggcgataccctctcaaaatttaaagaacatttaacctttcacccaacaatcccacttagcaattcccttagcattccactgtgtagatgttcaatcttccatgagtataaataatgctgcaatgaacactctcagtacccggtatttccaactgcaaatatccatcaacagggacaggttaaatacattatggaacatctaaacagtggagcccagaaaactgcaaaaatgagggtgctctatttggatggagatggaaagatatggtcagtattttaatactagtttacatttgtgtgacatgagggcacacacacacacacacacacacacctgaatatgtgtctgacgagggaactgggtggcccaggacaggagtgggagaaagactttcactgagagtccttttgcaccttttgaacttcctgtcaggtgcatacattttttaaccaaaagataaatttaaaaaaatgctacctgcctactttgctactttgttaaaacaggtattggtatttgctttctaacgcctagctgacgttttaggtaatggccacgtccacctcaaagcatcaagaaaaactccctgccgtctcccactgtaggactcatctgctgaattgttgagggtttaatctaaacagaaaaatatataattcagtaacagttggtaaattaaagaatgatcacaatgtaattttttggatagaggtccatcatattaaaatcctaagtaatttctttctaaaa

SEQ ID NO: 157401 - DNA, 211 bp, Homo sapiens
cagagatttctgtctctaaggaagtgtaaacatcttggggtacttgttaaaataaacagctttctgaatcccttggggagagtggattctgtaggtctgaggtggaaactagttttaatgcactcccaggggttgtggagtgggcccctctgctctggatctacttggatcaacaggctcaagtggtctctttggacaactgattcacgca

SEQ ID NO: 157402 - DNA, 561 bp, Homo sapiens
tcaacctggagccagccatctgaacaagccttcctccatctcttttaggatggtaagctggggcatgatgtttaagacttcttggctctttggcagggctctggaggggaagtgagtaagccattgggatgtcactgtggtaatgtggacagggttttctggttttgtctccttccctgtggcctttttccatgtccccccaacccctggacttccacggctgggccagacatttcccttcttagacaaatagactcgcttcatcccctccatagctgcagaggagaaatccttggtttgggtcccagtttttccatataggctattcttgtgctttatgcagacagaaacattagtacagtatgtacagaattagcagtatagtaataagtcattttaaccaacagatgtaaaaaatgcttcagcatacctttgtaatactaggcctgattacagaatgggagtggtctgtataagtgagctgtggtagaaaatacaacccttcagaataagttaaatgtaattaacttcactttaccagagtcatttttgttcccacag

SEQ ID NO: 157403 - DNA, 348 bp, Homo sapiens
ttgggtctaccttgttttgaaggcctcagaagccttagagtgctaaggcaaatgaaggaagttagggatgtgctcccctacagcaggagtgcaaagctgaatctctgtgattcctacagaaaacaactctcctgctgatagaatctgtgaaaggaaaatcttgtggcctcaaaattactaagctaaagggaaaagtcaatctgggaactgctcagggcaaacttgcctcccattctattcagtcattgctctcctcactgagataggtgcatagtctgattgcctcctttggaaacacttatcagaaactaaaaagaatccaactatttgtctctcacctacatgtga

SEQ ID NO: 157404 - DNA, 279 bp, Homo sapiens
cgcttttgaggcctttgctttccccaaaggacctgacgttgaaggagcagatccttatggccagggcgctgtggatggagaggaggaggaagaggagaaagaaacagagaaggaaggagaaaaataggtgctctacagtatttcagtaaactagttatttttattttattttattatttttttttgagacaggatcttgctttgttgcccaggctgtagtgcggtggtgcaatcaccactcactgtagcctccacctccctggatcaagacctccctgg

SEQ ID NO: 157405 - DNA, 181 bp, Homo sapiens
gtgagctttttatctatttatctgtgagaggtttaagctgatgctttgtaagtagaacagaaatgcagaaacaaattggatttcaaggttgatgtaatgctccatcccaatttccagttactgttttgttcatcaaacagcctcgtcgtttcctttgattgtctttttaataagaaatggg

SEQ ID NO: 157406 - DNA, 1071 bp, Homo sapiens
  misc_feature (907)..(907): n is a, c, g, or t
  misc_feature (918)..(918): n is a, c, g, or t
  misc_feature (920)..(921): n is a, c, g, or t
  misc_feature (924)..(924): n is a, c, g, or t
  misc_feature (938)..(938): n is a, c, g, or t
  misc_feature (947)..(947): n is a, c, g, or t
  misc_feature (953)..(953): n is a, c, g, or t
  misc_feature (960)..(960): n is a, c, g, or t
  misc_feature (973)..(973): n is a, c, g, or t
  misc_feature (1006)..(1006): n is a, c, g, or t
  misc_feature (1008)..(1008): n is a, c, g, or t
  misc_feature (1037)..(1037): n is a, c, g, or t
gaggctgcggaagggggtcgagtagaaggaccgccgctccggcctcccgcgacttctcgaaggtgggcaggtcccaccttgtggaggatggaggtgaccggggacgccggggtaccagaatctggcgagatccggactctaaagccgtgtctgctgcgccgcaactacagccgcgaacagcacggcgtggccgcctcctgcctcgaagacctgaggagcaaggcctgtgacattctggccattgataagtccctgacaccagtcaccctggtcctggcagaggatggcaccatagtggatgatgacgattactttctgtgtctaccttccaatactaagtttgtggcattggctagtaatgagaaatgggcatacaacaattcagatggaggtacagcttggatttcccaagagtcctttgatgtagatgaaacagacagcggggcagggttgaagtggaagaatgtggccaggcagctgaaagaagatctgtccagcatcatcctcctatcagaggaggacctccagatgcttgttgacgctccctgctcagacctggctcaggaacttacgtcagagttgtgccaccggtccagcggctgcagcacacacctccaacaggtgcttgaccaaagagaggaagtgcgtcagtccaagcagctcctgcagctgtacctccaggctttggagaaagagggcagctcttgtcaaagcaggaagagtccaaagctgcctttggtgaggaggtggatgccgtagacacgggtatcagcagaagagacctccctcggacgttgcgctgagcgagccacatcctttacttgcacttgatgggagaagcaggctccagagcttgagcttatctatgtcagggattttggagggtgggcggaaaccaggtgtcacntgagctacatnanngangacactgcccttgngaatgtagnagtaanaatgcanaaggtgtgttggncccttttgttcacctcctcagactgttaaaccnancctgcaagtttgccaataaaatgcaatgnaaatgcaaaaacacaaaaaaccaaaacaaaaagc

SEQ ID NO: 157407 - DNA, 351 bp, Homo sapiens
cccgactgtgtggagatcttccgccatgaagactgtgccagtgccagcctggccaacctcacttgtgaccagcttgctgaccgccagtcccctgtcatcgagttctgggagaacaaagtcttgaggctgtctgggggactggaggtgccaggggccctcaactgggaggtgaccctttgtctgctggcctgctgggtgctggtctacttctgtgtctgaaagggggtcaaatccatgggaaaggtaccactagaggcatgcaggggggagggtggctcagccctgggagctggatgtctgtgccaggcacacccgtagcaacgggaggtgaccagacagagtctagcccta

SEQ ID NO: 157408 - DNA, 567 bp, Homo sapiens
gtattatccttatcttttctattatcccatctcttcccgtaatagacaggaaatgttgactgtctagtaagagctcctttaatttatttccccttgcccctcaagtatcatatctacttctctctttatttgctgccctgtgtcttacaaaagagtccctcccctgctcaaggctaatgctctcacctaggctctgatgccatctctttctcctccggttcttcctcctcctcttcctctttctctccatcatctccatcagcagcaacctcactatcatcatctcattgccatcatcctacctatcttcctccctttactctttcttcgggatgtcacccccatcaataccctccttcctctttcctgtctctttggctgactctcttatggctccttctgttccccataaacatgctcaatggtatcccacgcctaggaaacagagcaccttcctccaaccttctctcctcccttttccagaaactactgctgtatttctcttcaggtcttcactatcaaaattctttttatttttgttttttactttggtagagacatggtctc

SEQ ID NO: 157409 - DNA, 210 bp, Homo sapiens
cccagcaggacagcaccgttctccccctgcctttgcaaccactctttcactagaccagaggatctcgtccccacaggctcactgctggtcctggccatgctcccacaccggtcctgagctgtaccaacatccaccagccactgttcttgccataacctaggcgccaacccattgctcgtccacagctccccctgctggcgcatgctgccc

SEQ ID NO: 157410 - DNA, 289 bp, Homo sapiens
tccactgataggaacagttctcagctctactagagagatgtccaccaacagcaggcagttagcatattgggggcttccgttgttgtggcacttgggggtaattgggtagctgactgcttaagtcagggagtatgtattagaatcgtgtattagagtatgtatctgttaatctggatagttggtttaatggattgcttaagagagtttctattctattaaataccttccactaaccactttttggtctctcaggcccctagaattgcataaatactgaagcgctccctca

SEQ ID NO: 157411 - DNA, 594 bp, Homo sapiens
agtcctgcagctgcaaacacacctggcttacatcatgtagcattcttccctacaccaccacttaatctcaccctcatattgcctcatctacccagattccctctcatttgtgaggcaacattaaaaaagcatcataaggttctgtcaggtcactgtcacattattagcttctctaattacttaagtaagagataacagtctctgtggcagattaaattttccaaaaatgaccacagcagtatttctggccccacatcttcttcagaagcctcctatgccccatcaaaaggtggcgcctatttcccttccccttgtaactgccttgacaaacagtatggtagaagagatgctgcatggcttccaagactgtgtcatcaaaggtggggtggcttatgcctgtctctccctctcgacaactgtccttggaatgtggccaccacattttgaggaagcgcagaccaaatattggagaggctacatagaagtgctctggccacaggtctagtgaaagtctccgccaacagccaccagacctgtaagggagggagccatcagctagttccacctctccagtggcactgagctgagtagagc

SEQ ID NO: 157412 - DNA, 350 bp, Homo sapiens
gctctgggggcaaaaatgagtatttctgatttgaaatcaggttttctgaaagaatccataagtaaattttaaaattgcttttgtttatatttgtgcttattaaaacactccctgttctggaccaatcttaatcttctaggcagaatttatttagtgttaagaaaatggcaactctttggacatctgttacatgggataatacaaaaataattttgaaaattttttaaaggcaaatgtgactggagtgtgggcatgagtgtgatatgaggatgatggcttgaagaagagccttttaagaagcaatttggccacctaagtgcatcccatcttaggaagaaaggatgggaata

SEQ ID NO: 157413 - DNA, 201 bp, Homo sapiens
ttttccatttccatccagtgcaaacacaattacatgcagaaaacaacacaaaatacaaaacatcaaagcagtaactcacagcatctggcgtggcttcaaatggcatgtctgggaaattccagatgccaggagtggcccagatgaccctaaacccacagtaacacacctgtttctcattcactgtcctaagctaccccatcc

SEQ ID NO: 157414 - DNA, 474 bp, Homo sapiens
atccactttgtcagatactctttttcccaatcttaaccctaactttattcaagtaaattatttttccctcccatcactgtctttcagtgcccctttttcatgaattttcaacatgtaacaacattctatgattctgcagtcttctaattaaccctaaccctaactctaaccttaatgcttattttatatttatttgtcaatacattgctaaagacctttgcctttcattattctggtaaaaatacattcctcagtacttctgctaatttcctaagagctaagattcatggacttggtttctcagcagcattttgtttgtgcttaatataacacgtcatttatacattaaactcttgacttctagagatgcagtcatttttgtggcatattaaagaccttggattttctgtaatatgttttcctgttgccttttccttttttttctgaaactcactttgcttctttaacactaat

SEQ ID NO: 157415 - DNA, 248 bp, Homo sapiens
attggtaccgccgggagccaatcgagttctaggagcgtgaggttagagcccgggtctgggcgctgggtgtgcctgttgtacagggctgcctcagcctctgggccctccagctcttccttgttgaaacatctgctttcgagcatcaccgaggccagctccccgtctcctgtccacctcttccttgttgaaatacctgctatcaagcgtcacctaggccagctccccttcttctgcctccttccacgcgg

SEQ ID NO: 157416 - DNA, 402 bp, Homo sapiens
ttgttgggattttattttgtctgtgcctgctggaattcctgggttgctgatttatttggcttcaggtctagtacacatgaggcaaaggaaaacccagggaattctccaccagcttgctcctcaagtcctgaggcccttagctatcctgacttcttctctcctcctgtcagagtcatcttccaggaagtgtccagggtttccaactgtacttagtgggaagaatagggaaatacatgcctagtccatcttcctggaagagaagaaggatgcataacacatgcacctccaggatgtaatcaaaagagatagtatttgatggcatagacacacacacagacacacaatgcaaacacacatacacaccacacataacacacacacaccacacacacacacacacac

SEQ ID NO: 157417 - DNA, 442 bp, Homo sapiens
atctctactaaaagtacaaaaattagccaggcatggtggcaggcgtctgtaatctcagctacttgggaggcttaggcaggagaattacttgaatccaggaggccgaagttgcagtgagccaagattgcaccactgcactccagcctagatgcaggggaacctgcaataaaggctagaagaaaaatcaaaccattctaaggcatatcgggtaggttaggggagatgaagagtcctaaaacagggggtcaaagaaggtagatgactcaccctttctctcattccctgatttttctataagatggtcatttagaagaaaacatatttcaaaaaaatgagggtgctgagtttctatgaacctctctcccaaccaaaatccagacaaatgtccaaggtccttgtgtgccctaatgcagcagtcccctacctttttggcaccagcgac

SEQ ID NO: 157418 - DNA, 612 bp, Homo sapiens
aagaagaagtcgaacttctcttttcactgatgatatgattgtatacctagaaaaccctaaagcctcctggaactgataaatgacttccataaagtttcagagtacaaaatcaatgtccaaaaatcagtaacatttctgtgcaccagtaatattcaagctgagggcccaagcaagaacacaatcccatttacaatagccacacaccaaaacaaaaacaaacaaaaactaaaaaaaaaaaaaaacacctaaaaatacacccaaccaaggcgatagaagatctctacaaggagaactataaaacactgctaaaagaaatgagagatgacacaaacaaatggaaaaacatcctatgctcattgattggaagaattaatatcctgaaaataccgtactgcccaaagcaatttacagattcagtattattcctatcaaactaccaatatcatttttcacagaatcagaaaaatctattttaaaattcgtatggaaacagaaaaagagcccgaatagccaaaacaatcccaagctgtaagaacaaagtcagacgcatcacattacctgacttcaaactagtaatgtaagtccacagtaaccaaaagagcatggtactag

SEQ ID NO: 157419 - DNA, 159 bp, Homo sapiens
caccttttcccagggatccctgtgtaggttgggtaacatcaagtttggtgatattctgccccagctttttatttcctgtgtctcccctgtgtatgtgcgagcactcacatgcaatcagggatgtgtggatagcccgggcccttccttgttttccctgtg

SEQ ID NO: 157420 - DNA, 147 bp, Homo sapiens
gtattttacaaaaattcatataacttcatgtacaacatagtgctttctgttttggtgcatcttgattcctcttatcctacctaccctcacactcttatgatatttccatcatacctacattcctgacacttttattgaaggtgataa

SEQ ID NO: 157421 - DNA, 355 bp, Homo sapiens
gcgggggccgggcggccagggggactatcggagttggagccccgggccgcagcggcggcggcggcgcggccccagggcccggtgagggcctgcacacaggtcccgtggccgcgggcggcggccagttgcagcgcggtgagccccgcacggttggtgcggtcgaggcgcaggcctaggcggcggaaggaccgcaccaggaactcgagcaccgccccgtggccgcaggccgccgcccacatcaccgggctgttgcccgcagagtcggccgcctcggggtcaccgctgaactgcaccagcagctgcacggcgtccaggtggcctcgctcgcacgccaggctgagtgcggtgcggccgc

SEQ ID NO: 157422 - DNA, 655 bp, Homo sapiens
caactcctgacctcatgatctgtccggttcaaatgtgattgattagctatccaaaaaaaatatgcatgcaaaccaaaagtaagggggcagtcccagatatacccagtctgtacaaaacccagagtaaaggaacaatcccactgtcactgtcacagaaaggccacgcttcagggccagccctagcaaggaggcagcactaggtccagatccctctcctgccatgtatgtgacttggagaaatgtgtcagcttgagtgcctcagcttcagcctctgcacaatgagaataatgccacctaatttgcagggatcccgtgaagattaaatgaggtaaggtgtgtgaaagagaccaccctcctatgtagcgggcattcaaaaaaagctagctataatgaaatcgaagaacttcagagtgtcttaaagcaaacaggaaattcaagaagaaatcatcaaggaaggatggggaaagaagaaggtgaggagggaatgatatgaagaagaagtgcataggtaaagattaacaataaccttttggccgggcgtggtggctcatgcctgtaatcccagcactttaggaggccgaggtgggtggatcacgaggtcaggagatcgagactatcctggctaacacggtgacacccagtctctactaaaaat

SEQ ID NO: 157423 - DNA, 303 bp, Homo sapiens
gaaaaaaatatcttagaaaatactctggtcaatgaaacaataaatgaaaatttcaaatgaaaaaatggggaaaccacagttgaaaagaatcttgtaacttcccagagtcactttagcctcccaagtcagactcagctcccaagtcgcacccagtgcgagcctgtgctggcctcttggggctagatatcccggtgagccaggcatgactgcctcggtgcagcttttcggcttagcttttcttggcactgagacataagcttgtgcagccacaatcgactccccacaactagtatgaactctcct

SEQ ID NO: 157424 - DNA, 374 bp, Homo sapiens
cagtggcaatttcaagcttctcctttttccccaagccccataatctccccctgatgcccttagaaagcttccctggtcagtcctcctcaccacctccagctccccctagaaactgaccatttatcccatcccggctgactcaagctgttatttcaaagtataccatcatttctttcagcacattttgtcattggagacagaaacaagtctctgtaaaagtgcccagaagccagaagtaaaaatacacgagccagtttttattctttttctatattgaggaagatgccaggcattgcagtttacttctaaaagtgccatgctgcattatggaggagtacaggtgttgggcaaatgtaacaaacttttctatccat

SEQ ID NO: 157425 - DNA, 393 bp, Homo sapiens
cagtggcaatttcaagcttctcctttttccccaagccccataatctccccctgatgcccttagaaagcttccctggtcagtcctcctcaccacctccagctccccctagaaactgaccatttatcccatcccggctgacttcttcccttttacaagaagatgtctctctttgaattcaactcagaggtcagcttcactgcctgccctgtggagtcgactctgtgtcccacccttcaggaatacggcttaataataagatgataaggattcgtaccagggattggcaaatgacagtcattttctgtttccttaagtaaaattttattaaaatacagctccactcattcatttatatattgttcatatctaattattttcacactgcaatggtgc

SEQ ID NO: 157426 - DNA, 260 bp, Homo sapiens
ttagtagagatggggtttcaccatgttggccaggctggtctagaactcctgacgtcatgatctgcccgcctacgcctcccaaagttctgggattacaggcatgagccaccgcgcccggccaaggccagtgttttgacacttttcctttagtaggttccatgcaagtcctcccatctcaccagccagactgctgtagttgaaagaattttggaattggagtctgaagacttctttactcctggagatttggctttccatgt

SEQ ID NO: 157427 - DNA, 423 bp, Homo sapiens
gagagcaggtgaagtgttttctaactggctgaaagttcttatcagtattattgtgagttaatggtactctatatcccaagtacgtgttaaaattagaagcataccttctatttgaaatataacaacatggaacatcctttaccaccaaaagcatggcaaagctccaggcaataaatgaaaaatggagagagcataggtacagaaaacacacacacaaagtctttggatcagaaaaaaactgagtttgttactacctttaaaaagcttctatatgaacaatttttttctctatgattacaaaggaagtgtttgtcccgtgacttttttgaactgcatcagtgttgccttttgctctgacttgctatgacaagggtaaagttgcttatgcaacaacttaattttaagattctgttttctcacctg

SEQ ID NO: 157428 - DNA, 199 bp, Homo sapiens
cccttggccccacttgtctccagggctgctaccatccagaggctgggtattggtcactcagcacccaaggatctgagtagttccataactggtgacatgagtcaccccagttaaccggctggtgttacttccatctccagtcagggtccagcacgtgattacgcttttccttttcccacttcatgtggaaaagagacct

SEQ ID NO: 157429 - DNA, 434 bp, Homo sapiens
attttatgttttccaaaattaaaatcaaaatacatgttttgaattgatggtcggaacagatgcagtgaactcatatgtgaaaaatgatgaaagatatgagatcaggctatctttatgcctccaaagcagaccattctattctatacattgtgcttatcaaagtttgaaatagaagttatgtacaaaaagaaatgacccctgttccccaaagtttgaagtctgagatgtaagagaaaaaaaattccctgaattccaaggcttagaaatatatttctatcaccttatttatattaggccacaagtagaaaccttgattttgattaatgagttatcgtccccaagtttgattacttgtactttgagagaatttccaatattcaattccctggattttaaaatctgttttctactaataacttgatttataaagatta

SEQ ID NO: 157430 - DNA, 488 bp, Homo sapiens
tgcctatccctcaactaaggacgcatcactgtatgtcctggggcctctatgtgcactgctttcgtatttctgatgcccagatctataggctgtagctgcttcagttgccttgaactctgttttcaactctgtcccatagccaatgactgactgatgtatgactacaaacatccagctcctttacctagagacagaacaaactctgggttgtaatttatgtcccagagctccctgagggtccaggctgtgctgggatttcacttggaatcactcctcagcttggctctccctcttttctcttttgctgccactcctcagcttggctctccctcttttctcttttgctgccattgctcctggtaactcctgacagcacagcttcaataaatcacttgaccttgaatcctcaattgaaagcactggaacttgcttcagagcctttgcatgtcttattatctcttcctagaatgttctaccctccccttgcc

SEQ ID NO: 157431 - DNA, 605 bp, Homo sapiens
cccgaggtcacctctgcttgctctttgtctaaggtccacagcatgtctggatctcaccatccacatgtgccttgacttgcacagacctgcctgggattaagctgtaaccggatagtttagaccctgttggtatttagatctggagtcctggagatctgggggcatccgtggcttgctgatttccaatgactaggaaataaggagcaatgacacaaaaaggacgggacaatggttacagatgaaagccaaaagcagagaagggatctgaaaccgggagtggctaaagactgaaaacagaagttgatgaaaatggtgaatacagtctatgtccgaatgaagagtaattttgctaaaataaaccggctaggatctggttaacagggcagagaggatgagaagcaaagaccagatgtggccaggcgtggtggcacatgcctgtaaacccagctactcaggaggctgaggcaggagaatctcttgaacctgggaggcagaggttgcaatgagccgagatcactccactgcactctagcctgggcaacaagagcgaaactccatctcaaaacaaaacaaaacaaaacagacaaagggaaacaccgggtacc

SEQ ID NO: 157432 - DNA, 432 bp, Homo sapiens
caaaaatgggaagaaattgatagagaaaaactaaattgttatactcaggctcccccaaaggtcatgtagagaataaaaagtatataaaaattagtatctacaaaaagggcagttgagaatgtaaataggcactgattacaccaagttgcttggggccacataaactcaaagctaaaaaattactgtgctttggcttcattcatgtcatgcatggaggaaagccacacatgaggccccttgttccatcccgtctttccctttcactctcctccggctgacctaagaaaacatgaatgccagctgatgacactcatgaactgccctgcctctcaaaagcgcaatccaggggccagcatcatcctcacctggaggtgcactgtcagatatgcagattctggctgggcgcggtggctcacgcctgtaatcctagca

SEQ ID NO: 157433 - DNA, 632 bp, Homo sapiens
agctgtatccattgctttaagtgtcccactgctactacttgctccagatttcaattgttttctgttatatcagtagcctaaaacctggtctttgcaaatctaccatggctccattctaacccattctcaatattgctatctcaatgacctgtttcaaaaacagaaatatgtctacattgttgtctggttaaaaaccctcaatgcttccctattgtctttttaagaaagtcaaaactccttatataaggcccttcctttattccctgttctgtctacatgtccagagccatctctctatggttctcagcttagatataatttcccctgtgagcctgttgagtgtatctgttattagcttctagcatccattttatccttccttgatgagaccagaatgtttcgctcactcggtacttgtgctattaggaaggagcatgtgattcggccctaggtcacccagaataacccacttctctgagccatgtgattatttatgtatgatggacacatgacccaagccaatccattcagaggatatctcagtgctttgcttgagctgtctgcaaagactcagagagttgggtttggcctgatgtgatgatgcaaacctgaagacactgtgcaaccatgtg

SEQ ID NO: 157434 - DNA, 586 bp, Homo sapiens
caggcgtgcaaggttggatcaggtacgtcgttatacagacgtctgggactttgtaacatgctgtccattctaacccattctcaatattgctatctcaatgacctgtttcaaaaacagaaatatgtctacattgttgtctggttaaaaaccctcaatgcttccctattgtctttttaagaaagtcaaaactccttatataaggcccttcctttattccctgttctgtctacatgtccagagccatctctctatggttctcagcttagatataatttcccctgtgagcctgttgagtgtatctgttattagcttctagcatccattttatccttccttgatgagaccagaatgtttcgctcactcggtacttgtgctattaggaaggagcatgtgattcggccctaggtcacccagaataacccacttctctgagccatgtgattatttatgtatgatggacacatgacccaagccaatccattcagaggatatctcagtgctttgcttgagctgtctgcaaagactcagagagttgggtttggcctgatgtgatgatgcaaacctgaagacactgtgcaaccatgtg

SEQ ID NO: 157435 - DNA, 332 bp, Homo sapiens
gagctcgttgggagtggtagcgtgtggaggagtctggtcggagctagccaggtgtagcctgcctgggtatgagagccagcagtgttggcgtgcatcgcgtggatctggggggtcgatgggaggaagggagctatgggtatggcggcctcgattgccccagaataacccacttctctgagccatgtgattatttatgtatgatggacacatgacccaagccaatccattcagaggatatctcagtgctttgcttgagctgtctgcaaagactcagagagttgggtttggcctgatgtgatgatgcaaacctgaagacactgtgcaaccatgtg

SEQ ID NO: 157436 - DNA, 390 bp, Homo sapiens
tgtaactctttgacttgctttataatgaatactcattgacaaaatgaatcctgatttccagatgttttcaatgcatttatccattttgaaatttattctacctatctttgtttttcaaccaataatttattaataattttctcctgactagcagaataattgtcagctaacagctcaattgttattataccttgtttcatggaaaaaaacctattactttgttttcatgttaagatgccaaacacagacagttaaaaccatttgctttccttttgttctcaaagggataaatgaattgtgtcaaaatattctcaagaaaattacaaatatgacagtcatcttttattacatatctatggaggcagagttttttctttgtgacaaggtctt

SEQ ID NO: 157437 - DNA, 542 bp, Homo sapiens
ggcggctccaagatggcgcaggcgatctttgaggccctggagggaatggacaatcagaccgttctggctgtccagtcattattggatggccaaggagcagtccctgatccgacaggccagagtgtcaatgcgccccctgctatccagccattggatgacgaggatgtatttctctgcgggaagtgtaagaagcaattcaactcgctgccagcgtttatgacccacaagcgggaacagtgccaggggaatgcccccgccctggccacagtctcactggccaccaacagcatctacccaccttcggcagcacccacagcggtccagcaggccccaactcctgccaatcgccagatctccacatacatcacagtgcccccgtccccactgatccagaccctggtgcaggggaacatcttggtgagcgatgatgtgctcatgtctgccatgtcagccttcacatccctggaccagcccatgccccagggccccccacctgtgcagagcagcctgaacatgcattccgtgcccagctacctcaccca

SEQ ID NO: 157438 - DNA, 477 bp, Homo sapiens
tgcgtacctgggcgtatgagaaaaggcatcgggtatgccagggtgtgtgggaaaaggcatcgggtaatcccacgggcatgtgggaaaaggtggtaagaggctggtctcaaactcctgaactcgtgatccgcccacctcggcctcccaaagtattgggattacaggcatgagccaccatgcctggtccctggagactttttctttcctttttggggggattatggttggttggggagaaagatttttttttttctgtgtgtatttaaaagtgtcctgtggtttgctctgatgaatgggtaagtgtcctttagcagtcactgatgggaggttggctgctgaggcctctgggactctgaaggagaagatatgcagcttcactggaccctggttgtgtatctccttgattttgctcctcaaaggttacggatgctgatctatctagctccgttagatacgcccacggttagcagttacgac

SEQ ID NO: 157439 - DNA, 834 bp, Homo sapiens
aggcaccccagcttgctcaccttctcctgcatggctggttcggggttgggcgtagatgctggaccagtttcctgtaaacccagcatggaagtgttcagcacctgtcttccaaacacatggatattcctcactcacgattctcagctttgaagtgctagacaaaagctctatttagcttcctactgtgtgcccattcatggcatcctcttggggaatactagcaagtctttctgggcacaatgtgtctctcaggctgaaactgccaaggggtgcggaaaaccagatagaagtggggaaagggccatttcccagctaaaggcagtttcctcctctaagatatggacacttgctccctttaagacggaatgattgtcattcccaggaagagacctgaatggccaagactggctaatttttgtatttttggtagagatggggttttgccaagttggccaggctggtctcaaactcctgaactcgtgatccgcccacctcggcctcccaaagtattgggattacaggcatgagccaccatgcctggtccctggagactttttctttcctttttggggggattatggttggttggggagaaagatttttttttttctgtgtgtatttaaaagtgtcctgtggtttgctctgatgaatgggtaagtgtcctttagcagtcactgatgggaggttggctgctgaggcctctgggactctgaaggagaagatatgcagcttcactggaccctggttgtgtatctccttgattttgctcctcaaaggttacggatgctgatctatctagctccgttagatacgcccacggttagcagttacgac

SEQ ID NO: 157440 - DNA, 216 bp, Homo sapiens
acacagtaaatttcacctaagttatttcatatcacagaaaatttaataggggttgatgattaaggaagtagatttaaaatatataggaattttgagactgaactgtcaattgtttcaatagacaaatccaatttagaactcatgctgattttttaaaattccaaatacgagtcaaagaactttcaaaataacgaagtgattttattcattcaagca

SEQ ID NO: 157441 - DNA, 627 bp, Homo sapiens
attttaaattaattattagcaaagcaattgtatttatagaaagacaaagttcacaggaatttaacctcaattttattaatgttccctactttcacttagtatttaatcgtgctcttgttgaaataatttcctaagtactaatgtatcctataatcagcacttaagtttattttttgttgaaataatttcctgggacaattatatattttatataataataaaagcacacacttttaaaagttgtcacttttaaaaacatcatcagtcttacagcccattcttggctctttcattttattttgctttatttgagatatatcatcaaatgccttgaaaaactttataatgtttagccatctctgtgtttttatttttctcttcaatccagcatgtatcttgaatacctactctgtttaaaaaactactaggtctacatggaatctactataaatgtaggtaaattacagagtaattctagtcttaatgctaaaatgaaggtaccactgtaatcattattcccaatgttatgattacattgacagataactccagttttgctaacctgaactgatgttatggccataatatgttgttgattcatggcaaatggtgatgtgtgagttatga

SEQ ID NO: 157442 - DNA, 303 bp, Homo sapiens
atcataatcttttatttccaaaactcagacaggtttttatcatcatgctctttggactcttaaccatcttcttctacttttaaattctacttctttctcaatacatttttaaacagcatcttgtgatcatttcccagtcttgagtgcctggcactgggaggtgacctgcccacattgctgtcagaattcgctgctggacccctgcacaggtcccaggctgttggttacgtgtttcaatctgcacatcagccatcctcaccagccttcctttgtgcatctggaaataaaaatgctcttgataaa

SEQ ID NO: 157443 - DNA, 831 bp, Homo sapiens
cgtccaggagccaacagcctctctgtgcaaaccagacaaccctgcaggaactgtgcttgaagaaaccgtggaaactgcccccaaccctcccgtctctatttctttctctgttttattatctcattcttggctgtgaggtaaacaggagaaaatgagaaggtggttctggaggacccgaccgaatttgctttcgtgacagggtcaagcgccctttcctcgccggccgcagccctcaccaaaggggatttgggggcctccggacaggggtcctgaaggttttgaattgttcaatctctgggggtacaggaacccctgcaggaggtttcaaaggcaagagtttcgcagagagaaaaaaaccatgaactttgcaggttggtggcggaatctggtgatttaagaaaacgtgtttaagcctcggccgggccgcgcctgggctgtctgcggtgctcttccggaattctctacaatatctggaagtgaccaagaaaattccagaacccggaggctgcgccgtggagataaacatgggcacctggggcctgtgttccccctgcacgtccccaggaaggaactgctggaccagcagaatgaggggccaacgccaggggcagcactgcccggccacagaggactgtggccccacagatgacaccctcagctaccagctcctgcatctggaagatgaccaggaggaggaaggacggtctgcaagtgttcaaagtgatgtttccaggccgggcgcgcttgtaataccagcatttgggaggctgaggcaggcggatcacctgaggtcgggagttcgagaccagcctgaccaacgtggagaaaccc

SEQ ID NO: 157444 - DNA, 476 bp, Homo sapiens
gtttcttcaaccaacaaattgcaaagaaacaaagtgggggagattttaaaaatctaaagagacacatcaatcaaatgcaacatgtcaactttgtttggatcctaaacacttatgagagaagaaaacttgaacactgaccaaatacttgatgatactgaggaattaccgtttattttctaaggtgtgatgatagtattgtggggttaagaattcttaattttctggccagacgtgatggctcacacctgtaatcccagcactttgggaggccaaggcaacggatcccgtctctactaaaaatacaaaaattagctggatgtagtagcacacacctgtggtttcagctacctgggaggctgaggtgggaggcttgcttgaacccaggaggcagaggttgcagtaagctgagatcacaccactgcactccagcctaggtgacagagtgagactctgtctcaaaaaaaaaaacaaaaaag

SEQ ID NO: 157445 - DNA, 510 bp, Homo sapiens
aatacaaaaaatttagccgggcatggtggtgcgtgcctgtaatcccagctcctcgggaggctgaggcaggagaattgcttgaacccgagaggcggacgttgcagtgagccaagatcatgccattgtactccagcctgggcaacaagagcaaaactctgtcaaaaaaaaaaagggcggggggcgcttagagattcatgtttgagtgaagatttgcagaatgggacccaaatggatatacagcacaatcaagatgcagggaattaagaacttaacatgtgcttgtaggtttgggtttgggggctatgtgggagtataaaaaataggctatgtctagactcccgaggggaactcgttttaaatgcctattctcagcattcagtttcaagaattctgaatatttaggttggagcccaggaatatgcattttcttagccaaaactcccatggttattaatgatgcagttgtccatgcagctgatgtctgtagggggaggagaaacacagatggga

SEQ ID NO: 157446 - DNA, 489 bp, Homo sapiens
atgcacttgtaaattcctgaaactccacacacaatttctctgtgcctggtatactattacccttcttgtatgccacataaactcatattcatccttcaaatcccttcaatcatctgtgaagtctgataattttctacgaaccccaaatagaaaaaaaaatcactattttctattaacttacgtaatacttcgcacatacatgttatatatacatatgtgtgtatatacacagacacatacttcacgctgtattgcagcatgcagatacttgcacatctgtctcttctagaatgtaagttcttagaaacagaaactatctgacttagctcagggtagagagaacttgcctcataatgggctcttatgacattaatattttatattcttatgtgcctcataatttccaaaaaatattcatagcagagagtctccaaagatggccatcaccaagaccttctcccactgtatgtatatggtgctccatctagc

SEQ ID NO: 157447 - DNA, 289 bp, Homo sapiens
gcttatcctaatttcccccccaaatctccatgattgggagtttttcaaacttaaaaaactgtgacatttaaaatttctggtaatttgttctcttttttcttttctttttttttttacagccaaatatttaacaaaaattttaagtataatgtaacattttattatgaaagaaacaactactggaaactaacttgcaacaaaaaccattctagtatctttgcagtacccttaggagatacctaattctttaaagagatgtttatattaatgaactgattttagaagacag

SEQ ID NO: 157448 - DNA, 576 bp, Homo sapiens
tgaaactctcaactgggcatggtggctcacacctgtaatcccagcactttgggaggccaaggtgggtggatcatctgcggtcaggagttccagaccagcctgggcaacatggtgaaaccccgtctctactaaaaatacaaaaaattagctgggtgtggtggtgtgtgcctgtaatcccaactactcgggagactgaggcaggagaattgcttgaacccgggaggtggaggatgcagcgtcgccctctaacctgggaacctgggcgacagagtgagactccatctcaaaacataaaaaagaaactctatacccattatacaattactcctcttttcccctccccccagcgtctagcaactaccattctactatctgtctctatgatttagactactctaaatacctcatttaaatgaaatcatacagtatttgtctttttattattggcttatttcattcagcaaaatgttctcaagattcatccatttttttgtggcagcatattgcagatttccttcaattttttaaggcggaataagattccattgtacgtatgtactacattttacttatcca

SEQ ID NO: 157449 - DNA, 484 bp, Homo sapiens
ccctcactagtcagctaaaacatccccatcttacccccaagactaggtctgcacctctgctgtgtggcccccactctatgcttccctgtcacagaacacatcacactttacttaattctggtggaattctgattgaattcctgacttaattctgatggaataatctgtctcgtctatgagacatattccctgccctcacagaacccacagtctatctcgtgaatcattatgtcccatgcatctagcacaatatttagttcaatattttcttgaattgagaatccatgaattagcctacacatacaatgataaaataatgactacaacttataaacctacagggaagaaatagcctaaccctcaatccttggggcaatcaaaagacaaatctcatctcatctctgctgaggacttctgatttccatctgcagccctgacatctcccactgtgggctctagtctcacagactgctgccagctgatt

SEQ ID NO: 157450 - DNA, 143 bp, Homo sapiens
gaattagggtccatttatttagtcatcaggaatgggtgtttcctcagtggcaaggttcttgccttttgggagttcatagcctatttgggagacataatgatgatgcctgatgataatctaatatgaagaggaggcatgttaga

SEQ ID NO: 157451 - DNA, 327 bp, Homo sapiens
ggcactgatccaggcgagttctcagtaagtgggaactcacaggttcagaagatgctgtgggcctcaggggcttccacctccagggaggtgctctcagaagaagggcccgatgggctcactgcatcgtggagaagataccctggctcagtctcagtcacttctccaagcgcataggtgttcgggaagtggcctgcagacagctcctccatgccttgaaagcagaagtagccccctcctgtttccctgtcccagttgggtgaagcatggggggctgctgagacagtcccaggcgtgccgtcacgcaggggcaggccgtccgtcggtctc

SEQ ID NO: 157452 - DNA, 108 bp, Homo sapiens
gtctactggtgcagtagcaaagaatggatgacaaggattctcgcccagtctagaggacaaggaccacacactataaatatttgttaagttaacctatgctgaggaccc

SEQ ID NO: 157453 - DNA, 267 bp, Homo sapiens
agagactggctaggggaatggtgatgtcttacagcaagcctcatttgctttttacacgtggtttctacagactactcaattttgtccaaaatctaatgctcacctttctttacagtgccatctgctgctgcctctgactactgcattttcccccgtttgcttagtccacgcccagtgtggtaaaagatgggaaagagaaagccatcctctcattaaagtaattggtccggcatatactaagcgtcaggcacttttttttcagacact

SEQ ID NO: 157454 - DNA, 411 bp, Homo sapiens
agccttgtggtgctttcctgtcatgactcatcgagcctctggtgtgttggttgggggttggggggcatcagggtggcatcagtgtgattacagcagcagagtgcaccgggagactggacctgggtcagactgaccccagcccagctcccaacctgtcccctgctaggacttggctgggacacttgcttcctccataaacagaggcttcccctaccttgttggttgggaaggtcacgtgaaagccccttctggtttctttttttctttttttaagccactagaccaccaggaagaaaggagacctttccaaactgccttattctggaaatgcaatggcagtgttgatggtagggggagctgtggcaggcaagggggtctctgctgtcaatggccctggaggcccccggtacc

SEQ ID NO: 157455 - DNA, 229 bp, Homo sapiens
attataatttgactctattccctactttaaaataagtaaaatgtaaaaacgtatgcattctgtatttatagaaaaaaattatgatgtctgtgacttgcttgaaataatacaggccacagaagtgagtgggagcatacattaaaacaacattccccatgggttggtgcctatttaaatgatgtaacggatacactggggttaagcatatcattttgtcagcttttatgaa

SEQ ID NO: 157456 - DNA, 386 bp, Homo sapiens
agaatacactttctactgcagtgttccttcagcacctttactggcaaagcttaatattctgcattttggcaaaggagaaatgtttataagggccagttccagtatcacaaagcaagacagagaaggatagatttggaagaaagaagtactgcattgataacagaggggttaggtaaggtagatcacacggattctcggatattttctaaatctttaccctttggaaaattatttctagtgcatattagatttgttaattcaggaagtagatgtaaattacatattcctgggcacaaattgcaaattagccatcctcatactgtccagccagtataaattcctgggtcttgccagcattgcttcagagaatggactcagctgcttgt

SEQ ID NO: 157457 - DNA, 181 bp, Homo sapiens
ctgggctgagaagaagacttactctgctttggatacctttttgtgctattttgaatttccaactgaaagcatgtgttattttcataataagtcgatgagccaatagagacagagtgatgagcgcaccattgcttaggaatttttataagctaatctcttttgttcatgttgcaattagtgt

SEQ ID NO: 157458 - DNA, 118 bp, Homo sapiens
gaagcatagtgaaagttaatgttgctgtgtggggagggacactgcagagaatttgctatgcagctcactttgcagccggctgtgtgctactttctggcatttattttcatatcctctt

SEQ ID NO: 157459 - DNA, 526 bp, Homo sapiens
catttatatgaatggtaataggtacagcttttcaggtgctcttattttgtaaggtacatttctcaactctttttttttttgcgttttatttgcagtatctatgtatggacaaatgtgcctaagttttaaaatgttgtaaacacagtgtacagtagaatctctctgaactgactctgacagatttttcttttttccccctatagaagtgccaagaatgagaaggctattttctaatatgcccacatgtgcatttgttgcatgtgtatgaagagggaatacagcttctttgcttagcaaaccactggttgtatgggatgtaaacccatgcttattaatgtaattacataatattacataaactgacaaaatatgaatgtgaaagctatttcaatgaaactaagtcaatgccaactaactaaaggttaagtttctaaaagaaaaaaaactcactcatattaggtatgtgtgacagttttaaaagattaaataataaaaataaaaatctagaagtattctgaattaagac

SEQ ID NO: 157460 - DNA, 419 bp, Homo sapiens
attatagagtacaggattttagcaaaatgccagatgttggcatttctgttttggaggtctttagtggtccatgtaaactatttccttgcaagtaaccatccatggtaggaaaacagaaaaaaatgattctaaaagagcatttgtctagttagaaactgtgtcacttgtatcgtttaccgtgaggcatccttgagaggtacatgatttccaaacagccacctaaatcataggtactgcttttggaacagatgtaaataggaaaagcgccagtccagtacccccactaaagaccatcgttagaaagctctcgcagtgctttccagcttagaggagtgtagttcccttcaggtacttaagccagtgttcggtaaagcagcacccaaaatgccttttgttaaatgtgttctaactcgttcctc

SEQ ID NO: 157461 - DNA, 186 bp, Homo sapiens
gtgtggtcactggattcttcactgccaaacactcacataaaaaaaaaaaagtcagttttacaacaggatgtctttgatgaatcatgaaaaattattactttattaaatctcagcccttgagtacacatgcttaatgcttgtatgactagatactcaaagcatttatgtgctacaccaaacaacaat

SEQ ID NO: 157462 - DNA, 230 bp, Homo sapiens
cagccaccgcgcccggccaaaataaggatttttaattgcaaaaatcagttcaggttcgaatggtcttacaccttaaggttaggtggtgtcctggatggggaaggggtttgcatcacagatccattaacgctgtatgctgaaaacacacacatgcagccaaactcattaaatagcgtggaagatttgttctggaaatgactagggaccttccttcccgcgtcccctcctct

SEQ ID NO: 157463 - DNA, 626 bp, Homo sapiens
aaaaagatgtatacattgcactgaccatattatgattaggaacttctatttgtttaaaaaatgtgattatgagagtaagagcaagctacagattggcagaaaacatgtgcatcttaatgaacaacaaagggctcatgccgagaatatataaagaaaaacaaaccattcagaaacagacatccctatgaaaaagtgggcaagagaactgaagaggcacttcacaaaagaagatatctaaatggccaataaccatatgaaaaggtactgaacccttgtagtaatcagaaaacaatgcatattaaagccataacacggtattactgcataacatcagaatggctaaaatgaaaaagactgacaataccaagagctggaaaaaatgtggaacaactagtactctccagtacttaatgtggaagcataagtttttacaactgctcatgaaaataatttgatgttatctactaatgttgaatatcctcataccctatggcctagtagttccactcctagatataatcccaatagaacagtttatatgcatcagagtgtatatacaagaatgtgtacagcaacattagttggaatagccccaaactgaaatgaatgcaaatgcccgtatataa

SEQ ID NO: 157464 - DNA, 468 bp, Homo sapiens
atatatggctataaaatcagtttacacaacagttaaatctagctgcttttcacattcacttcatgttgtaccataaaataaagacataatttccatagtacagacaagaatgaagacaagcaaatttaaatgtcttgcctgcaatgacacgtcacagaagtggcattgtatgaacactccattccttatttttactttctacacttaatcttatgacctctacctctccataggcgaaggataacagaagaatgatagatttatttcttcccggcctctgttccattttggatatgtgagggtgaatagaagggagtaatccaaaatccatgacctatgctgtaatgccagctgagctatgttcacaaacagaaaagagaatgagagatggctcctggccaggaaagtctgactcactaatgatacaagtactcttttgtgtaacctgattgggatcctctagacagc

SEQ ID NO: 157465 - DNA, 342 bp, Homo sapiens
agtttgtaatttctataataggtttacacagcctgagtaagagtacaaaagaggccaatagttggagtttcgcccagcaggggagtgggggattagcaggagactggtatttggccatgatgtctaaaatgtatagcgaaggaagcagaattaaaggtgactaacagagatcaaagtagaggatttagggactgagtacccctgtggtaaaaaaaaaaaaaatgcaacacagggcaaaaatacggagtgagagaaaagaagctgggattacagtaaaatgcttaaatataaaataatagataaatcacttctacgccatgagcccttccttgtgtagctgtg

SEQ ID NO: 157466 - DNA, 424 bp, Homo sapiens
ctgttctagaggataccctccagtaaggtgtgccacggactccatcgacacatcccaaagattccaatcaaagtttgaggttggctctcccaaactttcctctgcagagccattcctgcaggctccctcatgctggcaagcaccctccaccctgcccggtccgtgcaaccccttctcctgtcctccactcctccaagagggagaggaagagaggagagtggagaaggccctgacactttggccaagggcctggaactccacatcactgcgcccaccacataaggctccaatggcgttctggagaagagggcaacctccctgtcaaaagaagtaatgcaagcaaggctgagcttgcactcagcaggacttatggaggaaggagttcgagggcttgcactagagaccttgaaaggtccctttccag

SEQ ID NO: 157467 - DNA, 280 bp, Homo sapiens
tccaagcttcaggaggtcggtctcctttttgtattgttttgtattcacaagtggacccttcatggtgcctggcatgtagtaggcaccacaggaatgaatgaatgaatgcatgagcgtatgaatgaaggaatgaatgaaggtgggtagtgttagaagcaccctccaaaatggtgtgtcagaaacatcaaaagctattgtttcaagatcaccaacacacacccagctccccactccatttcgttttcagtttttgtcttgttttaatatctcatcagcttta

SEQ ID NO: 157468 - DNA, 595 bp, Homo sapiens
aactttattacacaacaaaattatctaaaaagaagcatagcacatatatatatccttgttacaaatgctcccaatttacacatttagaataactcacaacataacctggtccacttaaacattagtgagtggccacctgttgatgcaaaagaatatagcagagaccctcagaaggtctgcttagatatggctaatgcttccattattctacttacggggtttgctcttcatggtggaacatttttaagggtaatggttaataataatattaagccttcagtcggaaggatttcttctccagagccctcacagagaaacttccctcctggttaactggacccaggcatgagtcttcgttgaaaccgtgggaggaagaagagttttaccaatcaccagtgctgaagaaatctctcctttctgggcaggatgagggaatcactaaatgacgagtaagtgctgagactccacaaaatgacatgtcataaattggtatatatttttgggtctttcaattttcttcttcttcttttttttttttttttttttttggaaggggggggaaggggggggaccctaaaagagacaccggggggga

SEQ ID NO: 157469 - DNA, 275 bp, Homo sapiens
cggaatacacagcgcggaatacaccagcgtgctttacctaaggtactaaatctttcttggccatctgttaacatgaggtgccgtggcataaaggtctgtctgtctattattcaacaaatatttatgggtctgtgatgttttttcctcctaacataattctgccatattatcctatgatgttttatatgttatgtaagagccttctggggcataatagagcagcagcacagaacgtaacgtgattgtttgcttttcccgctgcgctgtgtattccg

SEQ ID NO: 157470 - DNA, 296 bp, Homo sapiens
gccaggcccccttattcagtgcacaaacccacttttctatcttctgggagaaccagcctccagtgcagcatcttctgacccatgctactctcctgagaagatagcataatgctcctcccagatttagacaggctccacatggatctgctgcttactccctgtgtggcctttgaaaggtcacttaacctctctgggtcccgatgtctcacttgacaaacaggcataatcccggcctgttcccatcgttgggtagttgtgagaattaaaaggagttatggtgtaaaagacattatggg

SEQ ID NO: 157471 - DNA, 695 bp, Homo sapiens
ctgtcggggtccccttcatgaagccactcccaggactgcagggggccgtttgggtttaccccccatgaaactgcctttgcaaaaattataactgaggaaatgatgacagtgaaagaaatcagacctaaccgactccacattccttctaacctttaagctgtccttattcatccctgggcgtaggccgaactaactttgggaagtaattcagttcatggtttgactctgaaacaaaattggtaacagccctttcccgaatagacccccttcttgcctgaggaccagtcggcctttgtaggactaacaaattagctgcaaggttagaaattatggtttaggggtcttgtggcctccggctgtgagagtctgaacctccccaaattgcttctggggatcacctcactattgtaaaacctgagatcagtgctggggatattctgcagaccccgcactcatggatcagctgacaccacctagaccagtcatctggctcaaccagttccgccatcccacccaggaacagaagacagcaagaaaaactcactttgaccccctatgagtccatctccaaacggaccaaccagtattccccactttctgagcccctacctgccaaattatctttaaaaactctgatccccaaatgctcggggagacccttttgagtaataataataaaactctggtctcccgca

SEQ ID NO: 157472 - DNA, 222 bp, Homo sapiens
ctttagcctcccaaagtgctgggattacaggcgtgagccactgtgcctagcctaatttttttgatttaaaatatttttaatttattttttcgagacagagtctacttctgtcacccaggcagaatgcagtgatctgagtgaagtggtacaatcctagctcactataaccttgaattcctgatcagcttgctgagtagcaaggactacaaggatgcatctacc

SEQ ID NO: 157473 - DNA, 357 bp, Homo sapiens
ggagagggccctgtctctgcttcaaggatggtatcttgaatgctgcgtccccactgggcagaaggggtgagccagcttcctctggcctctttttaaggtccctgatcccattcccaagggcaaagcctcacgccctgctcacctcccaaaggccccatctcttgaagctaccacgctggaaatgaagcttcaacctccgaattgcaggggacacaaaccttcccgccacagcaggacacatgcagcaatatcgggtggggctgccctgggtagaggcagacaaacactgtctgccccagggaatgtgcacatggccaggacccctcaccacagcctgaggcctgcccacctcgtcag

SEQ ID NO: 157474 - DNA, 442 bp, Homo sapiens
ccttttctccagcttggaatgcagatatgcagatgtgatagctggatttgagagagtccccttgtccccagaactaccctgcccagactagaagggctgagttctctgggtccaacagctgtcttaaggccatggcggcaagagggtcagagcagtgctggtgttgacctgtcagccactgaacctgccagcctctctctccagacattgttatatgacacaaaggaccgcctatgtgttgaggtgacaatgtctcttgtgaattctgctagctgcggctgaatcattcctaactgaaacacctgctgcagccgggggccacgtgctgtgccaccaccctggagagtctgcagagagccaccaacatggacctgaaggggtctcagaaagactcagctaaaagccgggcacggtggctcacgcctgtaatcccagcactttg

SEQ ID NO: 157475 - DNA, 295 bp, Homo sapiens
tcccctccctcttcctttcactctagactcttggtgagcctgtccctggaaggctgagtttgacgtgtttcaggactggtgcagtcctcacttcggagtctttgtggggtggggagaagcggtagagctaatgcaggctgttagggaaaagtggtcagaatgaaagtcttgatggtgaattagaatctggtggagcaccacgaagtcctggcgaaggaggcagtagtcagacccttttgggtgacgggttaaggaagacagagactgatgtggaaggggttatatataggaagat

SEQ ID NO: 157476 - DNA, 488 bp, Homo sapiens
gagagaacaattggaaggtggtgagagaaaaacgagtcttcctgcacaaggaaaccccaataaaaattaaccgctgacttctcatcagaaacattgaggccagaaggcagtaggacaacatattcaaagtgctggggttgggggacagacatgacaaccaagaattttacattcagcagcacagtctttaaaatctgaaggcaagctgaagatattcccagataaacaaagactgagagaatttgttgctctaagacttggcttacaagacaccctaaaggaagtaattaggcccaaaacaagtgacatcagacagagtgttccgaatttgcaggaaaaaaatacttgaatactataaaccagcagtccccaacctttttggcactagggactggttttgtggaagacagtttttccacggactggggggtggggggctcacctcctgctgtgcagccccgtttctaacaggccacagacctgacaga

SEQ ID NO: 157477 - DNA, 614 bp, Homo sapiens
atcccagcaactttgggaggtcgaggcaagcggatcacctgcggtcgggagttcaaaaccagcctagccaacatggagaaaccctgtctctactaaaaaatacaaaattagccaggcgtggtggcgtatgcctgtaatcccagccactcgggaggctgaggcaggagaattgcttgaaggctctggcgggcgtcgccatgctgggctaatttataacatttttgtagagacggcatcaaaatatgttgctcaggctcactttgttttcccaactctcaaatgaaggctctggccgggcgctgtggctcacgcctgcaatcccagcaactttgggaggtcgaggcaagcggatcacctgcggtcgggagttcaaaaccagcctagccaacatggagaaaccctgtctctactaaaaaatacaaaattagccaggcgtggtggcgtatgcctgtaatcccagctactcgggaggctgaggccacaggcgggcgtcgccatgctgggcaatttataacatttttgtagagacggatcaaaatatgttgttcaggctcacttgttttcccaaatctcaaatgaaggtctggcgggcgctgtggtcagcctgcaatcca

SEQ ID NO: 157478 - DNA, 248 bp, Homo sapiens
ggcagcccgatgacagaagacagggctcataactgtttctcaaacaaagtgtctacggagcatggaagatgcgagcagaaaccgtgtggcgcagaaaaccggaggaaagagtgcattcgaatcaccttctaaaagctgttcggaatttttatccaacaaataaacttttgtttcaaataaacgaaacagtaaagatcaataagacagagaaaacaggcagacagcgacagagcggggctttaggcatt

SEQ ID NO: 157479 - DNA, 411 bp, Homo sapiens
attctacagaatatattaactaaatatagtttgaacttttttggaaagttgatcatagtttgaaacacccataatgctatgcattatgtacatgagtataaggtttccatgaaattaattattcagttcctcagtccaactagctattaatatatttcaagtgctcaatagcctatgtggcaccgctctggacattgcagatttacaacattttcatcatcccagaaagttccgatggacactgctggtctaggattgtatatgtttcccatgtaatttatggaacaacagactcatatttatagtctgttgttctaaaatgtagaggcaaatatagcacttgctgtgttaatcctcactcaacaaatttaataatttacaggagtgacagcttctatagtcaccatttgt

SEQ ID NO: 157480 - DNA, 270 bp, Homo sapiens
caattagaaagggaaatggcagccagtaataaaactcttcctactatgatcaactatatatatacaatcaatgagattcttctaagctttataaattttcttttgttttcattagagcacatcaaaaatcgaagagacatcacagatttgtggagatcttattattgataactttttataatttcacatggacatatctgcatttgttgccttatttcatctgcaaatctcaccacagcaaataaataccattggtcactttgttgcctc

SEQ ID NO: 157481 - DNA, 497 bp, Homo sapiens
gtacaagattacatttcagagtcagaaccagaaactaaacctgccagaagctctgggttgaagcataagaacatgggattggaagtaaagatttaaaacagtaggatggtggcattcatggagtgacactagaggagcattctgagcatgtctatattccgagtagggaagtgagtcagcccttttgcagtggttcaactcaccttcccggaggagttcactcagagcgaaggcaaattgactgtcaacaagctgtagttcttgtgtggcagagtctgcttgttgctacccatatcaattttcccttgctttgttaaattttatttagggttgctgttcactctgatcgaagactatattttctacccttttttggtgtggtcttggactaagttctggctaaagaggctttatggaaatgtgtgagacctctgagaaggttttttttttaatttttttttaatcaaagaggagtatgtctcttttgcccttccctc

SEQ ID NO: 157482 - DNA, 646 bp, Homo sapiens
gtgaaaccccgtctctactaaaaatacaaaaatttagcctggcgtggtggtgggcacctgtagtcccagctactcgggaggctgaggcaggagaatggcgtgaacccgggaggcggagcttgcagtgagtcgagatctcgccactgcactccagcttgggcgacagagcaagactccgtctcaaacaacaacaacaacaaactttaattaaacagagggattttgcttgcttctagggctgtttcaaggaaatctattaaagagaaacgaaatacaaaattaatttctgaaattaaaagtttaagatctcttttatcttagaatatctgcatttcactaattatgctttgggtgaatgaaaatctatctaggtattcctaaaattattactgtgaaagtgaaatatagctaccctataatttatgctgaattatttttatctcatcaggaattttgtgttggatgaaatgagtcaccctgtaatcacattgtttatcttaaccagtgtttgctttagatagagtcatatttctatgtaattacagtattacgtttaaaggtatgaagaatgcacacttgtttctactcacatctgctttatttttattgtccagtacatactttttatgattttatcataatagga

SEQ ID NO: 157483 - DNA, 447 bp, Homo sapiens
cactggtgttcagctagcgatgttacatgaatcgacttggctattctgaaaattattattgttttaaaatatgtaggaatgagcctcaacatgtatcgcattctgtagaacatattagaattttctcttcagaaattgcttttgaaggcacatgaagtcatacgaaatacacacagcacaaatatatatttgtcacttttaagattcataaatcacagtccttggactttagaaagagtagcacacatgatgtgggccgggcgcggtggttcatgcctggaatcccagcactgtgggaggccaaggtgggcggatcacctgaggtcacgagttcaagactagcctgagcaacatggcaaaatcccatctctactaaaaattaaaaaattagctgggtgtggtggcgcacacccatggtcccagctactcaggaggctgaggtgggag

SEQ ID NO: 157484 - DNA, 653 bp, Homo sapiens
taatgtttgttcatgagagttgtttatttttatcaattcttatttatctttgaatcttataagagacactttaaaatgtttagctaaatcaaaatagtccttacccaatgaaatcacaacatgatagagtcatgagaagtatggataataaactgtggcaatgggtgaggggtagggagataaggagactgattgtaaaacatctgagctttatcaatatatattaatcatataataatttacaaataatgtacagtacaatgaaaggtaaaagtaatgctctcagaggaaatgtttccattctagttctatttggaagtccttgggacaatttgtgttttgattatatttagaaatcttcagtattttgtcttggccaggtgtagttgctcaggcttgtaatcgcagcactttgggaggctaaggcgggtggattacctgaggtcaggagtttgaatcaccctggccaaaatggtgaaaccctgtctctactaaaaatacagaaattagctggatgtggtggtgggtgcctgtagtccaagctacttaggaagctgaagcaagagaatcgcttggacctaggaggcgaaggttgcagtgagtcttgattgcgccactgcactccagcctggtgacaaagagaaactccgtct

SEQ ID NO: 157485 - DNA, 140 bp, Homo sapiens
gatttccgttcgggatcagaaagcattattggaacaggccacacttgcgagggaagtccctgcctcagaaagattcagaaaagctagacagtcactggaagaacaattacaaccgcaagacggtcaaacactaaacaccg

SEQ ID NO: 157486 - DNA, 433 bp, Homo sapiens
ggtttgcagccagagaggtaggagggaaaccaggagagtgggtgacctggaagtcaggggagaagagaggttctccaggccacaatggctgtcagtgccaagtgctgctgagaaaccagccagaaagactgaaaagtgtcccgtggatttactaccagggaagccatgggtgactttagcaagagctattgtagaaagcagtgggtctgaacctgaggcaattttgcagcccagcctcctgtccccggacattgggcaatgtctggagaccttttggttgtcacagctcagcataggggtaagctgctggcatctagcagttggagaccaggattactgtaaacattttacaatggacagaatagtccctcataacaaagagttatctgcagaaaccctgctggagagtgatgggggtggaacctgattagca

SEQ ID NO: 157487 - DNA, 308 bp, Homo sapiens
tatggccttccacactcacatatacaaccttctccctgttccaccactcgtaaatcctagtagtgccacccaaattgaagtgactctgtcctgcccaggtttaaggtgtcttggaaacataatttaaaagagtaacttgtgttcctattcttctccacttccctgatactccaaggttttgatacaagttattaaatgtgagacatcataaaaaatatagttgtaatatggaatgttatcacttcggatacagagttaaaaataataaattaaagataacaaaaataaactgtataaatgaagcattt

SEQ ID NO: 157488 - DNA, 188 bp, Homo sapiens
aatcaccaccccaaggctatttggaaattaggcattcaaaactgactttaaaaatctccttaccagcacttgtattagttctgaaagaatgtttagaggataatttttgtttaagttttaaacagaattgggttaggttgttctctttccaaagtacaggttgatcagaaaatgtttatctgaaagga

SEQ ID NO: 157489 - DNA, 340 bp, Homo sapiens
ctgtggtgactctcagatttgggggtgacttggctggcctcagacctggagtggtgcccaggcctcgcttgtgcccagcaaggggtgtgttctgcaggtggagcagagtagtgggcttccagcctggctttggggctctcttcacctgggctctctgaagcttaagtctggcagtgtcctctgtgggacaacgtttatgtcaccatgcacaggctctggggagactcccgtggccagcagtcaccacacggggcgggggccaagcaagtcatggtctgcatgagctggcccaagtcacttagcttttccaagtgtaaagtaatgcccaccacaacagagt

SEQ ID NO: 157490 - DNA, 199 bp, Homo sapiens
gtctcaaaaaaaaaaaaaaggacatgaaatttttaaatatttcacttgtgttatcagttttatgtaatttaagtgggtttaacagtctttatattattttgcctcaactgttaaatcatatgtgtttatttctacatcttctcttttatagctttatttagttttatagatttaaccactttttttttatactttatgt

SEQ ID NO: 157491 - DNA, 544 bp, Homo sapiens
ttataaaggaatatgtagctgttttatttagttattttattattgatgcacatttgagtttttttcagtttggaaaagtaccaaataatgctgcttagagcatttttctgcattggaaaatatgctggcatttctattgggtgtatatacctagtagcagagtttctgggtcctagagtgtgcttatgtacatcgtgtatgtaaggagttactactcaagaggttttgaatgccgttataacagtttgcacacagaatggtataagaaagttccagttgcttgacatcatcactagtacttaattttgtcagttttcaaaaatgttaatgattgcatagtggtattcaattgtagttttcatatgcattgctctgatgcataaggatgtggatgtgttcatctacttgttggcccttcggttctgtatgtggaactcctagtcacatgtttgccaattttgttcaatgtatgcatctttgtttattaattgatgggatttagttaaataaactagataaaagtcttttgccacataaatatatg

SEQ ID NO: 157492 - DNA, 460 bp, Homo sapiens
gtatgggcagcgtggagggggacccaggtacagaaggaggctggcatggtgggtaatcgccatgcctaggatcccacagtccctcagagggaaaactttggcctgatcattttgcttgagtctcagttggaaagggcctcatactccagtctgcacctgtgagtgaatcttgctgatagcatccttaccaagtgactttatcgcctctgtttgaatatgtccagtgatggagaggttagtacctctcatagcaggcctcctgtgtttggacatctccttattgaggagaaatcttttctcctgttaatgccactccttgttcttgggtctgcccctgcattcacactgagcgagttattcccttctccccaggggcactgtgccacctcaatacccacccacttgtctactcttactccacccacatggtttctccttgtttatctctcatggtttcccc

SEQ ID NO: 157493 - DNA, 310 bp, Homo sapiens
ctggcaattggcttggttgtggtggaggaagagtcagagaggagagggagtgatgtaattctgggcaaagatatcctcagtccaggcaaggcagtggctacagaaggcagatggtgcaggaagaggttagcagattgattggaaaacaggaaacctgggctcttcatttgcttctgcctaagagaacacagtagcagatgatataagcaaaaagcagcatccaagaatattcaactcattaattcagcaaacaggtatgaagtggcaccatgctaggaaatacttaaaaaaaaaaaggataaactctgct

SEQ ID NO: 157494 - DNA, 498 bp, Homo sapiens
agctataatgttctgtaggttaggtgtattaaatacattttccacttaaacaacgggtttattgagacataatcccatcgtaagtcgaggagcatacaagtctgcacacagataggcagatatacagatagacagacggatagataaatctacagatatactgaaggaaaggcatagaatattatgaattagggacctagtttagattagaggggacagtgcagaactctcagagagggtgatatttatttttatttttatttttatttttcagacagagtctcactctgtcgcccaggctagagtgcagtggcctgatcttggctcactgcaacctctgcctcccaggttcaagcaattctcctgcctcagcattcaagtacctgggactacaggtgcatgccaccaagcctggctaatttttgtacttttagtagagatggggtttcacccttgttggtcagcctggtcttgaactcctgacctgaagcaatccac

SEQ ID NO: 157495 - DNA, 414 bp, Homo sapiens
ctctgtctatactgcgttgtctgaacttcacaggtgatggtggcaaatgaaggtggcatgacatctttttgttgcttggtctttacaagcatctcagatcaaattaatattaaagagggaaatagacaaatgaaataagactactaagatgatattcttcacaaaggaataaaaacacatattcctcaaaaaggaggggaaaaccacttttggaaactctctggacatttttttccaagaagggacccagggagccatttttacattgtacttcctcaatcctcattcttgaagctctaaatcttcttgttttccatctcccttgagattaggaaggagggagagatattttttctctctatcctctgagttggccaaatctggatgactcctacatgcctctacggtaatttc

SEQ ID NO: 157496 - DNA, 597 bp, Homo sapiens
  misc_feature (541)..(541): n is a, c, g, or t
  misc_feature (544)..(544): n is a, c, g, or t
  misc_feature (546)..(546): n is a, c, g, or t
  misc_feature (549)..(549): n is a, c, g, or t
  misc_feature (555)..(555): n is a, c, g, or t
  misc_feature (563)..(563): n is a, c, g, or t
  misc_feature (565)..(566): n is a, c, g, or t
  misc_feature (568)..(568): n is a, c, g, or t
ctacacgacagtggatcctcgagaaatcgaggctgaggagtgtgcatgcatgaaacaggccgtcagttatcaaaagagaaatgagaacaggccttgagagggttgctatctgatggacaaatagaaaatctacccagaagtcagactgttagaaagctctcagtaaacatttattgaataaataaatgaaattactaggtgatcttaaatcaactattagagccatagttgatcaataaatatcatgctaggccaggtgcagtggctcacgcctctaatcccagcaatttggaaggcgaaggcaggtggatcacttaagcccaggagtctgagactagcctgggcaacatagcaggaccctgtctctaaaaaaaaaaattagccaggtgtgggagcgggtgcccgtaatcccagctacttgggaggctgaggcaggagaatggcttgaacccgggagaccgaggttgcagtgagctgagatcgcaccactgcactccagcctgggccacagagtgagactccatctcaaaaaaaagaaganagnangtngcaggnggccgacnanntngcacagagatggcaaatgtgtgcggataa

SEQ ID NO: 157497 - DNA, 470 bp, Homo sapiens
ggtgcttcccagctgaaaactgcctagggagggtgctgttgagaccgtgagcacctgagagccctggtctttcactcaggcctctcctctcacctccacctgggaggctaagctcagggtaggtgtcctggcccacaggcaggtgcatgggctggtcccgccagcacctgcaaccttcttgtgcgcagctagcccaacctggggtcaggtggaggtgggtaagtggggcccccagcattaaagagcttcataggctgtcaattaaggggaggcctagtgggctctacaggccacagctacccagggagccttcttaggggaggagttcctaggtgggtctcagagactccaaagtcagcatttcccaaaggaggtctcattagggattcagtgcaaatagagtctcattaacaaaaggatggggaaatgttcagctgtgtttaattcagcaggcttctttcctgcaggac

SEQ ID NO: 157498 - DNA, 457 bp, Homo sapiens
ggtgcttcccagctgaaaactgcctagggagggtgctgttgagaccgtgagcacctgagagccctggtctttcactcaggcctctcctctcacctccacctgggaggctaagctcagggtaggtgtcctggcccacaggcaggtgcatgggctggtcccgccagcacctgcaaccttcttgtgcgcagctagcccaacctggggtcaggtggaggtgggtaagtggggcccccagcattaaagagcttcataggctgtcaattaaggggaggcctagtgggctctacaggccacagctacccagggagccttcttaggggaggagttcctaggtgggtctcagagactccaaagtcagcatttcccaaaggaggtctcattagggattcagcgcgtgttgagtctcaaaaaccccaggagggtttccccttcagcagtgataaaacttgttctcctt

SEQ ID NO: 157499 - DNA, 193 bp, Homo sapiens
ggagcttagctgagctatgttttatatggaagccaaaaattttgctctccaagaaaaataagtgagaaagagaaaagactggtctcagcactctgcagtgggaggattgtgaggtgagatatggtgactagggatcaaggagagagactggaaaggagatgtgtttaatggggatttttctgagtgaaactct

SEQ ID NO: 157500 - DNA, 457 bp, Homo sapiens
ttttaggtttttaaggctgattttagagtatttcttctgataggagtagatgagccctactttggaagctgactttcctgagttcttatttaaacgctgggagttgcttagtgagtcttttcacttcggctagttgaaactctaatggctctcaacattgttgaaccagtgaaatcctcattcagctcattgcctctcagaaactgttctctgtgtggccttctgaaatcttactctgtacatgcgtaatatgttgttcactcaaaaaattcaagaagacttcatttgtagatttttagatctctttctcaggttgactctctcttctctggaatcttcttcataaattccagccacctcagctgcatcctacaatctgtttctccattcagaaaaaatgctgctatctatttaggctcctctttccttctctgcagttttggaagtagccttatat

SEQ ID NO: 157501 - DNA, 469 bp, Homo sapiens
agagtgatgaaacctcaaagccttttcttagaaaataaattaataggtcacagatttgaggtgtgcagacaggagccagagaacatcaaagcatttcataggcatatggctaacaaaatcatcagtttaaacagttgtttcatgcttgacacatataatgatggctgtgggttatgtgtaaattttggtgtacaatatactacttgcaactctttctctcctgctcaagaaagcttatcaggagatgagtgactgagagtgaattttaaagagaattcactctacaggtatgttttatctcaaaattactttgtactgctgctactgaattatctgtgtcatgcctcccaagtggagccacatcctagctaagagaaatgctcctctcctgtagccacgtggcagattacctctgtgcagtgttgtatacagtttccgagagggaggtgatggggagatttgcagcaaa

SEQ ID NO: 157502 - DNA, 403 bp, Homo sapiens
gcatctgctttgtgggacaggcgccccaggtggggaagggattgttctgggtcctgtccacccccagttccattctcaaagtcttggaactcagggacagggagaatgctgccagcagctgaaggaggggaacagatgtttgagtgcccactctcggaagcccaccagctgtctaattgggggccgcctctggcactgatcagcaactctctggccagggttaggggacaggaagtatcccacagcagctgctggggcagaagaagacggcccagaggacagcaactctgccctacgtttctgcccaaactgggtcttgccatcttctggtggatcaaggagggttcacagcttgctgggcaaagctgggcgggtccctgtgcctctctgggcctcatcaggg

SEQ ID NO: 157503 - DNA, 457 bp, Homo sapiens
gacctctccagtttcttctgcaagattctggactcatggtccaagtcatctacagtttctcatttttctttatttttttaacttctgaaactgttaggaccatagagcataaaacatatgcaataagcaaagatagtacaaaagtagcctttatttatcttcatacttctgctcttcccatgctgtttcagaaattctagtaccatcactgagtctagctttcatgaactagtttaattttcactccttcaaacagtgtcttagataatttgaaagtttgacacacagctcacaggtgcagcatttaagcttcccctgttctgaaaactttagtactgtgtaagtgaagagaaccaagacatcagtccatataacattttaagttcatcttataaacaactgatttactctacccctgctcaaagcacttagcaatgaatgatgcattattttagaa

SEQ ID NO: 157504 - DNA, 292 bp, Homo sapiens
atagcgtaagaacaagagtgaagagagcagggtgggaaagagaagcaggtagaatgagaagctaacgggcagccatagctcagcaaaccctgagtccctgttgggggttacaggaaatgcccaaggcccgccagagaccactacactccaaagtggtatgactgcccttcccattgctgtgaggcccaactgagaggctggtgagactgcgttcttacctcttaaacttagagtcttcaggatgcaaggaatagagaaagctaacataactacttacgacttatgtattata

SEQ ID NO: 157505 - DNA, 131 bp, Homo sapiens
caaataaaagacttgcttttctgaaatctgaattgtcatctttaaaaaaatgtttctatctctcatgctaaagtatatctgtatataatcagggtacacttccatctgaccaatttaagaatttttatcct

SEQ ID NO: 157506 - DNA, 300 bp, Homo sapiens
agtcaggcatttggtgggtaggggatgataaattagtttgcttctagataagatgagtagaacatctaagtagaaaatccagattgcagaaaactcacagttgaatggtggagtggtagatgttcttgcttgggtataaagggagagagagcaccagcagttagttgggtgaaggggctgacagtcaagagcagagatttttctgggtaggtgctacaccgaacatatttgtaggaagaggggaagtgactggggcactgggaggtgacatgcaattatttccattttacaaatgagaaa

SEQ ID NO: 157507 - DNA, 106 bp, Homo sapiens
taggattacaacccagacagtctcacacaaagccacttaaccactaagccatattgttttccacacttctcgaagtcagagttcaagtgaattggagagccaatgg

SEQ ID NO: 157508 - DNA, 331 bp, Homo sapiens
gaggaacaaggggagagatgaggggccatgggagtggtgagggataaggtggggaagaggtgagggacaagaggagtggtgggagataacgctcttgaatgggcaggaaccagataatggagcaccttgagcaccctctgcatgagtccacactcactgaattgttcttctgctcctttgtccccttgaggggcatatctctgttcctgattcagtggcttattctagaggactttgctgcataaccttgaggaaagcatgaaggtcatcttttcctttatctcttaatagcagatctcatagtcagctcccgtttttcccccttggtctt

SEQ ID NO: 157509 - DNA, 225 bp, Homo sapiens
atttgtgttatttttaagcctagaaagagaaattaacaagctgtagcaagaaatctacaggttagagacagaagatgaacaaagataaataactagatattttcacctagataaataactaaggaagatacaaaattacttttaccaaataagtggcaccaccctgactccctccaaccccaccctaccctgatctactctaatcagcctggagtcttgagaata

SEQ ID NO: 157510 - DNA, 240 bp, Homo sapiens
cttccacactcagctgctgggaaaacttcccagaatggaggaggaagccaaaaaaatggcccagtcccacacaggtgcttcacgtgagctatgggctcccagacagcagccgctgagctcttaggaggtttgcgccgggtcccaccccatctccaggcatggcagaggtgtgatcctgagcctgcctaggcacctgctcctttcagaatggtgaagagacaacagattttagacatccct

SEQ ID NO: 157511 - DNA, 411 bp, Homo sapiens
cttccccaagaatattccttcccaaagaatattaaaattgtagattattagagcatagaattgcacaatgttaaaaaaaaaaaaattctggaatcccaagaaaaaagacccttagaaatcagctatcccaggccgggccaatggctcatgcctgtagtcacaatactttgggaggctgaggcaggaggatcacgaggccaggagtttgagaccagcctggccaacatggtgaaaccctgtctctactaaaaatacaaaaaaattatttgggcgtggtggctggcacctgtaatcccagctacccgggcgcctgaggcaggagaatcatttgaacccgggaggcggaggttgcaatgagccaagatcaggccattgcactccagcctgggcgacagagcgagattcagtctc

SEQ ID NO: 157512 - DNA, 436 bp, Homo sapiens
tgcataaggtgattgatgagattgaaaaccagttttcataatttagcaagtgcagccaatgatatacttctacttcgctatatgtatctttgagtgggacctttttcagcaaagactgccagtaaaactgactctctaaataattgaatttagagtactcctaagatctggttttaacacaaagtattcaaccaagatttttaaaataatgaggtacaatcatattgatctccataagtttttttgtcatgatttttggtgacacaacaagttttgtgttgttattaaaaagtatgtgagaagatgattttattttcatctcattgtatgtttttatattttgtgtatttttttaatgaacataaattacattcattaactgctgcagagtgccttctgcgttaccagtaggagttacagggtgatctcaaaagcc

SEQ ID NO: 157513 - DNA, 574 bp, Homo sapiens
ttttacagttgaggaaaccaagacacaaagaggttgagcaaactgccccaatgtcatacagtaagaatgcagtggagcaagaaaactcaggcagtttggctccagctttgatacgttgatctactaatacacaaaaaaatgtacttagcttgttcagagtgcctcactgatagtaggtgctcaacaaatgtaactgccttcctgctttcactcaaatgcagccagggcattacagctgagttttttaaagaaagtgttttggttggttgtttgtttttggactagatagtcttttaatctataatccaggagtatacaaccatgcagcactgaccacttagccagatgtaaaataaactagcttcttaccacaactaccctataaacattgcaactaggccaggcacggtggctcatacctgtaatcctagcactttgggaggccaaggcgggcggatcacttgaggtcaggagcttgagaccagtctggccaacatagtgaaaccccatctgtactaaaaatacaaaaattagccaggtgtggtggtggcgggtgcctgtagtcccagctact

SEQ ID NO: 157514 - DNA, 985 bp, Homo sapiens
tgaaagaataattaatgttcctacttcctcccttaactattcattccttaacccactcttggtattggtctgtcctcgctacttcactgaattacttcactgaaactactcttgccatgttgcaacgtttagcatttaatgtaggtattggcttctgtgtaaaaggaaagttttttcttgaatacaacactctcctgcttgttctgtctcacctcatgcaacctccatctcccgggtttaagcaattctcctgcctcagcctcctgagtagctgggattacaggcacgctcccccatgcccggctaatttttgtatttttagtagagacgaggtttcgccatgttggccaggctggtcacgaactcctgacctcaggtgattcacccacctcggcctcccaaagtgctgggattacaggcgtgagccgccatgcccggccggttgtgtttttaaatgaagaaatttaagtttccggggtcccttgatttctcttatctcctgcatctgtttcatcagcaagctctgtcttctccaaaatatagcctatggagttttgctcttgttgcccaggctggagtgcaatggcacgatctcggcttactgcaacttccgcctcccgggttcaagcggttcttctgcctcagcctcctgagtagctgggattgcaggcatgcaccaccaagcctggctaattgttttgtatttttagtagagacggggtttctccatgttggtcaggctggtctcgaactcccgacctcaggttatccacccgcctcgacctcccaaagtgctgggattacgggtgtgagccaccatgcctggcgtctgtccttgtgtttataacatgtcaagattgttcttactgtctagaatgctctgcccccagatttttacatgatgtgatatccttatcagtaacacaggctctggaaagttgataattctccatctggaggtggcttaccagattctgtaagtggt

SEQ ID NO: 157515 - DNA, 233 bp, Homo sapiens
tgtccatacaactattgttgttgttcttacttttagctcttttcttagaagcccacttgtacccaggtttgatcacaccccctactctcctgccctggaagtaactactattctggttatagtctcttaatatctatatctatatatatgcatccacagataatgtgtagtattgtcttgaaaaaaatatacataaatggtatactttgtctccctctgcgattattttcact

SEQ ID NO: 157516 - DNA, 457 bp, Homo sapiens
catgaatctttttttctgcaatgtctagccgtccactaattacatccagtgcatttttaatcccagacattatagcatttgatttggatctcataacatttgatttttatcttttaaaaaatatcttccgtgttttgtttaatattttgtacatatacagttatattaactcttttaatgttcttctctgctaaatttaacatctgtgtctgttctttggcagtttttgtttttgagacagagtctccctctcttgcccaggctggagtgcagtagctcactgcaaccttcgcctcccaggttcaagcaattctcgtgcctcagcctcccgagtagctgggactacaggcacgcaccaccacgcctggctaatttttgtatttttagtagacatgggatttcatcatgttggccaggctggtcttgaacacctgacctcgtcacccacctgcctcag

SEQ ID NO: 157517 - DNA, 156 bp, Homo sapiens
acaacaagagtttcaccattaatttcatagtaagattttttgtctcttctatgtttgacagtttttattttaaaaaatcaacaggaaaacatatttgctgatcacttctgtattatggcgtattatggtggtaaataggtgaagtgaactacagtg

SEQ ID NO: 157518 - DNA, 1233 bp, Homo sapiens
gatgttgcatcagaacgtggcagttgtaacaatgcagtgggtatcataaccttgaggaggcctttgtggtgctatatgcccttttcctaaagattcaactccaagtatagatccctctgttctgccaaggagaatggtattatttaaattacgttgtacctcactataaatttgtccacttggtctagggcacaggaatatagttgaaggtctgcttgggccagacatcattgttctgagtccctgcatccctgctgattcttgttgtcatatacaagcagggaagtgctgaggtttcttcacttcttcctggaagtctttcaggaaagctgggaggtattatggtgaggctgtaatgtctttattctcaggaccgttagtttggaaagtgtatgtaatatttcctgaatatttcacatggcctttatctaaagaatggaaagatggtgactaggagttggtccctgagaaacaaggatgagggtaggagacgtggagcatattttagcaagattcttaatagtcagagtagatattgggtagctaattctggttttgggtttgggttttttactcttccactttatggtaggagaaaattcatggtgcatgagagaaatgaaataagtgacagaatgtcaaaatcaaactttaaaacataaactcttgagggcagagctgatgacttaatggtatgtgagtagaactggtactgtcatggttgtggatttgggagtttgaggaaacttgagcaaagaagtggcagatgatgaaaataaatcagttttaattctgataaaactggttttggaaaatgtggtttagatttaaatgtggcacaattttttcaatactaaactctagaattagtcagacttgcccacccagtaacaggtagcttttgacctccttaagcctccttatgtgagggtcttgtactataaaactccagggattgaggactagagcctcattctaaaagatgggaagaaagggaaaagagatgagtgaggcataccattcctctctcctcctccccactaagagaagcctcaccttctccccagggggagttggggagagaaggcagaaatgttataccggactggcactccccccatgcagaaggaaacctcatgagtgggaagcagcattcctctcccaccgtaagtgacggtgatatgctgcccttgctattataacgatcgagactatgggatcctctagaatgat

SEQ ID NO: 157519 - DNA, 270 bp, Homo sapiens
tgatttatatcatgtattcaccttcaacatgaattagttgtttcttttcttccttgatttgggacttgttccaaacttcccaacaccatcaaactgaacttggctgagccggcaaatgcttaccaagtgatcaccactgtgagcactttacagaagaaaactgggcctctgccatgcagatgtttataaacttactacagtagaacataagtattccttattatccaaatctgttcagaaagccagtgcccagagagtcagggacatatg

SEQ ID NO: 157520 - DNA, 289 bp, Homo sapiens
gttttagcaatggggggagggtctctccaatagctccttgccttttgtgacacctgcagaaagcagggccaaaggaatttggctttgctagttaaaccagcctcacttttttgtgctagaagtttgtggggaaagagagtgacgaggtgattcagcgcagtctccccattttcccaacagtgagactgaagctcagaagggccaatttagctccagccacctgtagtagagccacagccagaactgctgctgtggatggccaggcccctttaaccctccccaggaactc

SEQ ID NO: 157521 - DNA, 488 bp, Homo sapiens
tggaacaagttgtggcccatgatattaacagagtcaactgccccaatttatagctactacttaacagaaaacactttattatttgcatgatagagttaaaactgaaagccaaacttgctaaatattcttctttgaaaccaatcagataaactacagttaacttatttaaagtaacaattcatcacagtagaatttgctgtttaaaggtcttaaccttaatgtgctcattcaaaggacatgaacagaaaagatacaagggatctctctaaagtatctcaatgtgcattaaatattaattattagccaaaataatacaatctcctttttcacaaggtatacggcatgatagtagcttacaggcaagattatcgccaaaataatctatttgctaagaaattaaaacgatggttaactggcccaccgtaaggtgttctgtgtaagtggtactaaaaatatttagatcccactatattcttaaaaacgtactg

SEQ ID NO: 157522 - DNA, 398 bp, Homo sapiens
tggacgataaggaggagaagaacccaggagcagtgacggcccggcgacctcagcatccgcgcacttcagcacggtatgagcatgcccccaccggaatgtctaaatacagcatgaaatgcaataatgcttatttctatgaaatatatgaaatattagctgaaaggcaaagacgactagacagaggagatgagatgaaaggactctctggaggaaaggactctctggcctgctcattccctctgagtcacaaaatgcaatgaaaatcagaaccatttcagtctatgccgcactgaggatcttacagagaatcactgtcagaagcatcacaaacaaaactgaacttctggtgtcaccgaggttgcctctaacccgtgtacctttctcctgctgacaaggcc

SEQ ID NO: 157523 - DNA, 328 bp, Homo sapiens
cctctatcttcagcagaaatttattcctcagaaaattgtcccaatgtaaaggatgttgaataaggaaattgaggactgggtcatgatcttaatggcagactttgccagtaaaaatgctgaaaactctctcccctttaaaaaaaaatctagtatttctacttagccacacaaaagaatgaaatcatgtcctttgcagcagtgtgaatggaactggaggttgattatcctaagtgaaataacttagtcaaataccacgttttcacttacaagttggagctagacaatgggtacctatggacatagagtggaatgatagacattggagact

SEQ ID NO: 157524 - DNA, 432 bp, Homo sapiens
gctgtcatgagaaggaagagaacggcactgggtgggtccccacttttcagtggccattagtgagaaggcaggcgccagtgttactggcttgaataaccagagaaatgagtttggagcaattatagctagcaaaaaggtaatcggaaaaaagtgaagggagaaatcccagaatgaagacaggcagagaaggagtgcttcaaattctgagtatatattctgcacacatctctgctgatcctagaatcatgcacacacagtgcagactccaagcagcccagctaaggctaaaataatggaacagagatttgcactgctgctcacagcggaaagaggctctgctacctacccatcagccacaatgtctaggatataatctaacattccttgatatacaaaaaaaaaaaaaacccataaaaatgtgacccattctca

SEQ ID NO: 157525 - DNA, 402 bp, Homo sapiens
ggtaaaatgaactccaattgcctgaattcaccttcagctctgctttcttaggcaagttaactctttttgctggttttcttatcttcaaaataaatggctttgaaggttatatgagataatccatgtaaagttaaacaatttaacatactgtttagttcatagtaaatgcccagtaaatgttagctacatttactgttgcaaggacccagcatttttaccgaagcaggtgggaggtaaaaaactttctctgtgttatttgtgtggactggaaaagagtcttgtatattaaattgtactatgaaatttaaacttcatttagacatgaaaaggaatcttgaattctttttgactttgtcacattttcagtctagtccatctctggaaaaacgtgaatctttattt

SEQ ID NO: 157526 - DNA, 535 bp, Homo sapiens
tttttgctaggcttgagttgcttactattaaaaaaaattatacttacatttttataataaaacctaatcttaggctcagatgcacatacaactaaagagcagtgcttgtcttttgcttaatgttcatattacaaggttaacttttatttataattaatatatgaacgtgttttttttttaaaaaatacacaatgtgatggataaatctaatgtcctttttgataatcaccctggttttaagaatataactgtctagagaaactaactaatagagctcattgtgtattatctagaagtcattgtatgccaggcaattttctgacaatctgatggggttggcactatttttaatccctattttacagatgaggaaactgatgcagagagaggttttcatatagctcaccaagtcactagccagtaagtagtagagccaggattcaaattaaggacaaaaagcacctgagaagcttcatgctgctttctgatcacctccttactccctaagggtaaccaccatcctgctttctaactg

SEQ ID NO: 157527 - DNA, 211 bp, Homo sapiens
acaggaccctccgtaacgagcgcatagttgaaagtatgacatgaatgtagagtgacatttattgtaacacccaggtgttgatgattgtagttaaaggatgatagatgcaacctgaaagattgcaactttcagactggagcaactttgggttccatacctttttagataaaggggggtgctgattggatagacagtgtgggtcagtcttgga

SEQ ID NO: 157528 - DNA, 387 bp, Homo sapiens
gaaagagagagaaactacacctgaagcctgcttccaaagatccaacatgataacacaggactatcgttcccctttattgctctgaagctgtttccacactgcttcaggaaccaaggaaaaaagaacaaatattgtaacaaaagatctgcttattgctatagtcactgaggaaataacaagggtgatgggaattatgagccaggcatggtggaggaaaaccaatgcataaatatcatcatctcacagggtctttgcagatgatgaggtgaagatgaatcaccaggatgggctctaatccaacatgactgtgtccctgtaaagtctagactcacacacacacacacacacacacacacacacacacacacacacacacacacacacaca

SEQ ID NO: 157529 - DNA, 456 bp, Homo sapiens
cctggctatttgggtagaaatacaggcaacagaatattaaatcacacagtcatatcatgctggagggctcccggtatttgtggccctcaggttttaattgtagaatgcatctttgttctttccctgacctgcagagtgacatcactgcctctcttcctgtgcgctggctttgacataagccagatggccaccgtggttggtaggcgcccaggctgcctggtacaggagttgatgaaacagaataggaagacgttttatggtcagctgtggaagcacagtgagactgcagctttgctaagtaattacatttactgtgtgtgctttattcctcacagagaagggtcacagggaaaaaatacatttttatttatagtgttgtgaggtatagacctttgatcttttattagtcagtagtctgctccaaaggaatgctctcttttccctgctctgcagtca

SEQ ID NO: 157530 - DNA, 424 bp, Homo sapiens
ccccttcttaaagggataattctgtgggagtacgtattaattgtgatctgaggccctgtgcagctagaaatgaggaggagagagttggtttctcattactggcattcaggaattagtggctggtgatgctcacaatctctacagtttttcaaagagaaacaagatgtcacgctctgtttaaatgggcaacccctcacttatgacacaacttgaaagcactggcaaccctatttctctgaggaaaatcttccaacacgaagaacctcactacgtttaactcccaaaacctaggcaagtctgatactcccccagtacaatgagaatcttcctttttatttttggagaaacctgtgtaaaacatccccttacaatgggatgagggaagtcaacaaagacgcagggaaacaaagaaagaacatctgag

SEQ ID NO: 157531 - DNA, 202 bp, Homo sapiens
ttatgtgactcaggaatctggtactaagaagttgcaacatgttttttgtatgttcacttttacttcatttttctcttcttttttaatacagaccactcgaacaaacgcttcacatttacagcaaaacaaaaaataaattagttaaaactagatagaaacatagcctcccaagatgatacaaaagcaatttctgaggatagat

SEQ ID NO: 157532 - DNA, 237 bp, Homo sapiens
ctgagatggctccactgcactccagcctgggggacagagcgagactccatctcaaaacaaaaacaaaaacaaaaacttttctagagtgtctggattttatttacagtaatcatactgtttttctaagagaaaatacaagaacgctattttaatttagggaaaaaagatgtacaattcaagagatgtactgtgggcacgtttcaaagaaaataataatcagagtaatcttgctttatt

SEQ ID NO: 157533 - DNA, 226 bp, Homo sapiens
ccggccctcttagggtggtcttatttatttaacttcacctagagttcctctgggtttctaagcagttatggtgatgacttagcgtcaagacatttgctgaactcagcacattcgggaccaatatatagtgggtacatcaagtccatctgacccatcccacttgttcttcatagctttgtccatccatcatccatgcatccatccatccatccatcctctcatctat

SEQ ID NO: 157534 - DNA, 453 bp, Homo sapiens
gccacactatgctgactcatggggctgtatgggtggacaggcttcactagcaatgcacaggaatagcttgttagcctggtaaatcccacagtcatggactcgctacattctagacatcaacaaagtatcctgctgtcttacatttataaccagtcagaaatatgcaagcaatagactgaccatgcagctgatttttggaatgtaagaaaaagaacatcaaatcatattatttgggggactcatgctcaaaaccacaagccatacccaggaaactcaatatgaactagatcaggggtcagcacacattttctgtaaagagctagacagtaaatattttaggctttgaaggccacgggttctctgctgcaacgaactctggcactgctgcacaaaagcagctgcagacaatacatgaacaagtgggcaaggttggtttctaacaaaacattattt

SEQ ID NO: 157535 - DNA, 146 bp, Homo sapiens
gtgtgtcagggtggagcctgcatgggttgggctggagggtgaggctggggccacaggagtctgatggcatctgaagccaagacttgagcaggtcaccctgggggtgtgtgtggccagagaggaagacacagaggactgcgttcaga

SEQ ID NO: 157536 - DNA, 209 bp, Homo sapiens
tcttttttattatacaagtgacacatttagttatagaaaatatgtaaaagtcagaaaacgcagatgataaaaaataggaagataaattcagccataaacacacaacccagaaataatcactattatcatcttggtgtatatactttttcttcatccattcacacatatgtaagtatatatatatatatatatatatatatatatatata

SEQ ID NO: 157537 - DNA, 459 bp, Homo sapiens
tcgtgccctgcagtctttccccagctagctgatttgtttgttcattcattcattcatcctcacactattctgtgatcatctctgaggacagattttgggaaattccttctgagagagccttaaaagttggcatttttagatcattttaaatgctattttaaagatttcagattatatatagttaatctcttgctaaaaagcggatggaagtgtttactacataaaatgatagaacctcaggtttgaaggagactttcaagccactgagtctttaaggataaagtggaaagcagattttttttggattcgtgaaaacagaggaaattctggcctctgaatatacaagggctgtgcctccttttcctgttttgtactctggcagaaagggagactgaagcctgtgaggaatccttcagcagtgaacagggcagtagggggacaaacagctctgcccaccat

SEQ ID NO: 157538 - DNA, 279 bp, Homo sapiens
cctctgccatttttgagaatatgcttgaacattcgagactttcttctcccttttgcttctgtcattctacatgttggcttatctgacattctagtttaaatttttctcctacctaattttcttaaatgttctttatccatctgtctttcctctgatactatttaaagccgtttgccctgaagtaggcctaccctctcttgtttctttagtaggagctgtcttcccactctgtgtttctgagtgacagtttactcctgttttcctttcccttttctctcc

SEQ ID NO: 157539 - DNA, 534 bp, Homo sapiens
gagttcaaaagcctcaaaagtggggaagctgacagtgcaccctgcagtctgtagctgaaggcccaagagctcccggcaaaaccactggcataagtcccagagtccaaaggctgaagaacctggagtttgatgtccaaggtcaagaggaacagatggaaccatccagcaagggagaaagataaaagccagaatactcaccaagccagcttatttcaccatcttccgcctgctttgttctagccacactggcagccaactggatggtgcccatccacattgagggtgggtctttctctcctagtgtgctaactcaaatgctaatctcctctggcaacaccctcacagagacccaaaaacaatactttaatcagctacctaggcatctttcaatccaatcaagttgacacctaataataaccatcacactactctactcaagtatctttttttttccaagacattattttcctccacctctctgttgttgttgttgttgttttgagacagggcctccctctgtctctcaggctggag

SEQ ID NO: 157540 - DNA, 228 bp, Homo sapiens
tagaaattaacaggataagaaaagttgcaagaaagctctttaatctggaagagaacttacagctcattttacaagaaaaaattgaagaggctaattggaaagtgatataacttgccaatcataaaaataacttttcatttcaagagtctcataccataactaacaatatctcaaaatccttatttactcatggccttgacactgagttatccagttaacatgttatta

SEQ ID NO: 157541 - DNA, 115 bp, Homo sapiens
aggtgagaggccaaaggaggaggctgaggctggcatcagctccaaggtgctgtggcaaaggcaataggcgtggtgatgtggggtcaggaatagggaggaggagcaaagaggtctg

SEQ ID NO: 157542 - DNA, 308 bp, Homo sapiens
ggggagggtcgggcgtgtccgcctgttggaatatgcttctcaggtcttctgggaaacagatgttttgtggaagtggaagattttggaagtagtgccttatcatgtgaaaccacagggcagctgatctcttcaggctttcttgatgtgaatgacagctttgtttcatccactttggtgggtaaaagaaggcaaattcccctgtggtacttttggtgccaggtttagccatatgacgaagctttacataaaacagtacaagtatctccattgtcctttatgatcctccatgagtgttttcacttagtctg

SEQ ID NO: 157543 - DNA, 284 bp, Homo sapiens
ggcgttctagaggatcccagggagtccatcatgccggtgacagaatcttggctgtcttgctcaatgctgcaccccagcccagggtagagtgccaggcccacagtgagtgttcacacacttgtcgaagaaaagcgtgaactgaaggggagaggttctgatggatgagggctgaaatgatgaggtcgtcttcatgtggtggtggaagggagaggaaaagggatgggttcaagaaaggtaaaggacaggtagaagtgatgggccctactggtttactggaggttgtg

SEQ ID NO: 157544 - DNA, 357 bp, Homo sapiens
caatttaacttcctgagtggctaggactacaggctctttggaaattttagtttagtttttatttttttgagacaaagtctcactctgtcgcccagattggagtacagtggcacaatctcggctcactgcaacttccacctcccaggttcaagagattctcatgcctcagcctcctgagtagctgggattacaggcatgcgccaccacgcctggctgattctgtgtatttttagtagagacaggatttcactgtgttggccaggctggtctccaactcctggcctcaagtgatctgcctgccttggcctctcaaagcgctgggattacaggtgtgagccactgcgctagcccttcaat

SEQ ID NO: 157545 - DNA, 429 bp, Homo sapiens
atgtctctggcaatcaccaatctatattctgataatatttggcacctattctagatatttcatataaatggaatcatataatacatagtctgttgtgactagctttctttcacttagcacgttttcttggtttacccaaatagtagcatgtattacttcatctcgtttaatttttttaaattgtggcgaaatacacacaacataatcttaaccattttaaaatgtacagttcagtggcattagcatattcatactgttgtgcaaccatgactaccacccctctccacaactcttttaatcttgcaaaactgaaactcattaaacagtaactccccattcctctctctcttaagcccctagtaaccatcattctactttctgtccctatgaatttgactactgtaggtacctcacataagtagaatcaca

SEQ ID NO: 157546 - DNA, 793 bp, Homo sapiens
ctcttctgctagggatttattattagttgttattgttattatttccattttacagataagaaaactaaggtatagataaattacataacctgcccaaaataatgcggtttttaagtcatggagccagaattcaaattgacagagaccaactccagagtttgctctaatcattattcacttaataatcaaatgataaatgaataaatgatgataaacatcttttaccccaaagctaatgcagaactctaattttaaaaacacatggtccttttgccttaaggaccaaatgagtttctgctcccaaacatcaatcttataattagtaaccctgttgaaataaaaagccatacccatccctactatcccagaccttgtctccctagggcgatagccccagttctgtatgccccagctgaaagaaaaaggaatgttagggatcttgaatttaccttactagtttcctgtcataggaggatgccagaagaaagcaacaaccacagtagataaagaaaagctcttacctctttctaaagtttcatccctagaatatgttgctcagttactatcccagaatccagtttcagatctgcactcctcctcctttgagagaaatgaaaaggggttaggggaagagaagaaaagaacttcacagctttcttctagagcccagcagtggtggtccttttcatgtagaagtccaggaacagttccaatcagtaaacctggtggagaaattaaccaattttatatttgtcttaattcaggaagtcacaatattttttttatttatgta

SEQ ID NO: 157547 - DNA, 175 bp, Homo sapiens
cttgaagagtagaatcagagtattaagaaaatcctgaaacatgaaacatatgatctggatgcttctctttctaccctcattttttattacctgaattgtctttttgagtgtttacttatatgtgcttatcatgccacagtctccctgtgagtctgcttgtccctccaccttatat

SEQ ID NO: 157548 - DNA, 406 bp, Homo sapiens
acaagtacaattattaccccattttataactgagacagagaaaagctcagtagcattgctgttgagtggtaggtagagcttgaatttgttgcaagctggctgactccaaggccaaaagatcatggggaatatgtatattgtttccaagaagacaaagtttccaagagcatcctacaaggtgccgttcattcttgccccaaattctccagatgtcatgagatatagaagagaaacatctttcgatgttgttctagtcagaggagacttctaataggcagagaacaagttatggaagctgttcctgaaagatgcagttgtcattgtggaaccagtcttggatattgtgtggcagctggaccacacagccattgttataaaggagagcaatatgccttgtgacccttgt

SEQ ID NO: 157549 - DNA, 1043 bp, Homo sapiens
ccatctttctttatgatttattcttagtctgatacgcatcagcctggtaagccttcctgtctctctgcttacttaccaatcactccaaatgtcatgtctttgggcaggcattaaattcttgggttttgggttttgttggatggactgcagtctgtgtgagcctatatgggtgtgtcaaatccagtctttggggtgtcatggaaacttagcatgatagacttgattttatccccaagttgacttggtaatttcattagatttcatcagtcacaacctgcattttatcttgtatgtgctgtctattggtcacaaaatcagaaaaccttcttgtccattcataacattagctgttttttcaggtggctagagggacatgtcattgcttcatctgcatgaatttgaaagattaaatgcataaaggaattttcttagagtagagtaggccttcaccatctctttaactgggaaagaagttttgggagtaacatactcatcactcacacccccctcccctcaaacacacacactcacccattagaatgtaagggccttgaggcaggccttgtgtttgcttttcgtgttcactgtcagcatttagaatagtgatagtcatatagatggatagtgctcaatcaattattgtcaaataaagtaatctacttgttccttgatttagactagcaaaaggggctggtacattgtaggtacacagtaaatatttgtagaacagatgaatgaaccaacccaacagatttcttagaagtagcctgcttttggttactaattattttatagaacatataaaagaaaattttagaatacctaatttgttcacaaaaatgttatattgtctcccctgatacttggtattcctgtgtcaggctgagcactaaggttatacattttttgttaagcatgtaattactgttatttctcatgtactttattttgtgtattgatttcagtagttgtagctgagggtaatccttaagagcatgcagattttaaaaattacatagattgccttgccaagccgtctgaaa

SEQ ID NO: 157550 - DNA, 138 bp, Homo sapiens
acatatggctcaatgatagcctatagatgtgcctcacagaatctttcaggcatagaactctttcttcaagcaaaatactaagcaaaagcccaacgtatacaaacaaaagtggagctacacttgttaaaatggaggagg

SEQ ID NO: 157551 - DNA, 340 bp, Homo sapiens
cataccaactgagtcaggtgagagcagagaaataaaagtgtatggtaatgttatggtaatagcattttgattattcaaagagcattatttttccccaaggctatgaacaaaggttgttaatttatatgatgggtagtactctgtcagaatatagttatttattttaattttataatggcaacttctagggttaagtcatcttagggcacaattacagaggaataacaattagttaattgaaatatgtgactagtataaaattaccagttttaaaatcagtaaaacatatgacgatctttcttaacttatacaaatgaagactgaaaggttgtgttgtctt

SEQ ID NO: 157552 - DNA, 409 bp, Homo sapiens
tgaagttatgatcttcaagtgagagatggagggactgcttctgcccaagattacatgtttgtaatctggacttcgatgtcactgatatgtttcaactatcttaaacatcctgaattaactgctgtgacatggctgaggtacatacattaggaagaccgtctaccgaatacctacctatcagccattttgcagtctgtagttcttctcttgaccatgggagaaggcaaatcactaatagccaccgttcttattttttcaagtcaggtttttttataaaatataacaaacagggacccttaactgtctcagctgggtttttttttaatgatttcttctggaaaggtgatagttttagtgtttccatgccttcttttgtccatgttcattataacttgtgactgtcgcatta

SEQ ID NO: 157553 - DNA, 469 bp, Homo sapiens
tcttgaaatcacccaacacaaccccaaatcctttaaaaagcccttcccagcactctcatactgaggcaccccatggttccccatggtgtgtgatctctcttgtgtaaaagtgtgttgataaacccaactcgattcaaccgcagatctgttcctcatgatctctgacgggtggacgttgacaataattttttgagcttagattataactccattttatatttttgttgtagatctgcagtacttgatttgctaaaaaatgcaattaccagttaagtgagggaaggttgtagtctttgttcagtacgtaaccaagagttttctatcattttaaaaactatcactagtggcaacattgctcatggcatttgagttccaggtcaaaactactgcagtagtctgcatttgtagtgggtacattaatggtaattatatgtacatatgcaagcatctaatgattgtgtcatcagga

SEQ ID NO: 157554 - DNA, 714 bp, Homo sapiens
ccctgctgtgtcagtggttcacactcaatcatgatggttgatgaggttcggggctcttaacgtgcaaaaagttctctaataaacaggtaggaggaaaaggagatgagtgtggtgttaagaagcctcatgaagaaagtgtttcatagaggatggattggctagctgtgtcatgctgctaataggacaggaaagatgaggtctgatgagtgatcattgagtggctattgatttggcaactggtccagtcattggtgatcttgataagacggatggtgggagtgaaaacagtgaaataggtttaggagtaattgagaggaaatcaattataatgaatatagataatagttttaaagaaatttactataaagagaagaaaaaagatggaatggtagctggaaagggaagtggggtcaagagaacatttattgttctcattgggttgttttattttttaaacttttttgaagtaattttagatttacagaagagttgcaaagacagcgttcctctatatccttcatccagcttccccaaatgtttaacgtagttgtggtatatttatcaaaactagggaatgaacagtacagctaaattggtacagtactattaaagcacagtttgttctgtttttttaagaggagtgaaataacagcctgattgtatgaaaaaccatggaagagtaattcagtgggactcagttagggaagtgacacc

SEQ ID NO: 157555 - DNA, 314 bp, Homo sapiens
actgacttaacaaggaggagatggatgtttcagtctcttaacactgaaggggagggatggaggaggctctgaaaatttcttgggacactaggaaattaagggaattcctttctacagcccttactcccttctgccccatccacatcaaagcaagactttggatgtggtacaagtcgggaagaatagattgagtaaattatgcagctgttggtgggaggaggaggcctgatcagatagggtaaagtgactttgagatctcaactgagattgcataaaatgaatgcatgtttgtacattttttttttcccagcagg

SEQ ID NO: 157556 - DNA, 331 bp, Homo sapiens
ggagttgaaggctacaataagctctgatcataccactgcactccagcctaggtaacagagccagaccctacctctaaaaataaataataataataaacgtatggctttctatctagagtgccctttcatctggccaagctgaggatatgctacttctcaacccccaagtacctgacaacattactgggataaatagaataagccatttctaagaaaggaggacgcacagcaggggtttcctaatggtaagagcagagaaaggaggtcgaaactctgtgggaagaacaatgctagccccataatgggaatgattttctcatccaacctgcct

SEQ ID NO: 157557 - DNA, 383 bp, Homo sapiens
agagggagatggaactttctggtgacattatcctcaccggaaattaagaaaggaaagcaacaggaaaccatgtatgtttcattactggtgtaaccaaactcttcaggatgtgacttcagacccagggataaaaagttggaggtcgcttatctgttttctgttgaactcaggcctggtacacgagagatgctcttttggtcagtttcctctggttgggtctttcaggaagaaagcaggttacggattggaccacataaactgacctggaaaccagcagtttcagcttttctgtatggcaagtacggcagagagctggttaagctgttagactgaatgtcacatgcactgggcccctttgtgggcaattacacaggtatttaaga

SEQ ID NO: 157558 - DNA, 211 bp, Homo sapiens
atcatcatcatcatcatcatcatcatcatcatcatcaaaaacaaaagacagacctgtaaccgtcttgtgtgcctggctctcatcttagttcaaaatatagaagtaaattctatggccagcgaacaatgaccaaaatagctctcatcactcttgtctgccaccatgtaagacattccttttgccttccaccatgatttcgagacttcttcag

SEQ ID NO: 157559 - DNA, 212 bp, Homo sapiens
atgacttttatggtgatgacattttctcgacttgggtacgacgtgttaatttatttttttgctgtgcgaatggcagtcttggtggtcagcagcttaaggtaggtttcttcctaggctggcttgcatttttcttttttttacatctttcgataaggacgtggttttcaagctggtgctggtgtactggaaatgttaggggtggtacctgtgct

SEQ ID NO: 157560 - DNA, 503 bp, Homo sapiens
gatgcaatatgctttgacattgttctgcctgctatctcatggatcttgtaatttgtcacaacaaatgcttttaacaacatgggcagaggagtgtaagcctattaattttactattttatttttattaagcactcacacacaggatcttaatgctgccctgagttaccaataaaatgaggattattcctctctggaagctgcaaaatttgaaatcagaaacaaaactcatgtagatccttttcttgaaagcagaagcctggcctaggattgatttatcattgtcaattacatgtgaggatctgaattgacccaacttttcagaagtcaggaatatgtgaactcctgcagggtagcttttattttttttttttttttagagacacagcacaagatgaagctgttacctccctccatcaacccagattgcaaaattctacattgaatgcgataagtcacatttaattttccccacttgagtcacaaagtagattctatccagactg

SEQ ID NO: 157561 - DNA, 602 bp, Homo sapiens
aacggtgtcctggtgtgttgttctgtttgtttcttttgaggcaggctctcgcttctgtcacccaggctagagcactcactgcagcccgaaactcctggactcaaagtattcttccacctcagcctcctgaatagctgggtctacaggcacaccccaccatgcctgcccaaatctttatatttttttgtagagacaaggtctccccatgttgcccaggctggtgttgaactcctggcctcaagcaatcctctcacctcaacctcccaaagtgccgggattacaggcatgagccaccacgcctggcctaatttttgtagttttagtagagacggggttttgccatgttgaccaggctggtctcgaactcctgaccttgggtgatctgcccgccttgacctcccaaagtgctagaattacagatgtgagccactgcgcctggccaacataggcctatttcactggtagacttggaatgaaaattatagtagggatgcagtggcacaaaacattagtaaattagatatttgatgattattggagatagcaataagaactaggtttttgttctttttgtttttttaaacttctgttagttcagaacg

SEQ ID NO: 157562 - DNA, 424 bp, Homo sapiens
tcacgccgcacgtcggctcaaacaaagccctacatctgaggtccacccagtgcctgccctgggtctctgcatgtcagctctgacatcaattattccagggttctgcttactcctcagggttgtgttttattattgtggtaacatacacatagcataaaatttaccactgcaaccattttcaggcgtacaattcagtagcattaagtacattcacaatgttgtgcaaccatcaccactattttcaaaactttttcatcaccccaacacaaactctataaccattaagcaataatttccatttcccctcaccctcagtccccagcatccacgattctactctctgtctctatgaacttgcctattctggatatttcatacaagaagaatcacacagttatttgtccttttgaaccggcgtgcgcct

SEQ ID NO: 157563 - DNA, 1091 bp, Homo sapiens
tcaggtaaccctccttcctccactgcacaatcacttagaaactgtaactcttcttgggcccaggtgcacaggtaaattcggatctttcccaaggtaagtgccatgtttaccttcgtgtttatgcatttcctatgcatttaacgtgtgtaaaatggtgctatcattttattcagcttctgtctttgttttcaatgttactggtaatattttgagtgttgtgctcctaaccccattcttgccacaggccctgcatgctaccgtgatttttaggaaccctatgtcacctcacagatctgagcatatatgagttgggctcgtcacccggccttctgggagtctcagtttccctatttgtaaaatggacatagtaaacccatctccatctcacagaggatagtaaaaagagccctggccttggagtctgggggctgggccacaggtcaggcttcaagaccccctgggccacgttggggacttgggttcctgagatccaatctctgagcatcagcttcactgtctgtcgcagaagcaccatttccccaccttgtccacctcacagaacagccaggtggcttagaggtgagctctcaaatgtcaacaggctttgcaaactccagtggtcagcattatgtgagtagttcagtctttccacagggatctctggggcctcgggtcacagcagaccagaacttgacctggaggctggtgtcccccaaactgctgtatggaccctgcaacagctggggagtcctcgtctcaacagccctgctgtctcccactgaggtcatctgctggccctcctggtggccctgtgaggaagccaggagtcactgatgctgctctatcgacggcgacagatggatcacagctgataagtgacttgcccagagttttgcagcttggaactcacagagcagaagctgggaatcaggtggggaagcacccagctctctgcttctcctaagccaagctctgcagcgaggtcctgcttccctcgggactcctctttcagcatgacatgaactcattttgaatgtaaaggcaatgtcaaagccctacagctatttataccagagcatgtgtttattagc

SEQ ID NO: 157564 - DNA, 255 bp, Homo sapiens
aggccaagagacgggagacctgtctggggtctcagagcaggctggataatccgataaatggccccacactgactctgcactgttcctgttccctgcaggcaccaagcctgccctgggcacagagaaaggccttttgagttaccctgcagactttagacactttggcaagtgtttccaatgacagctccaaagggaagcagggctcaggactgagtcataagacaaatgcacattaggtacatgttaacatcatct

SEQ ID NO: 157565 - DNA, 103 bp, Homo sapiens
aatggcttgcaatacttttatgtactatattattatttttctcaggtctaagtcaacaccccagagctaagaaacagaggaaagaaattcaatcacagtgtgg

SEQ ID NO: 157566 - DNA, 159 bp, Homo sapiens
gaaggggatggtttcagcctggcttggggtttggccagtcgggttacaagagtgagtgagaggtaaagcaattgaaaacgttaaggctgggcacggtgggtcacgcctgtaatcccagtattttgggaggcccagtattttgtttttttcttttttttt

SEQ ID NO: 157567 - DNA, 195 bp, Homo sapiens
gatgaagatcaaacctcccgcatgctcagtgcagtccagcttcacattgtctcttcactcagtgtcctggacacaccacgctccttccgcctctgatctgagctgtgtctttgcacaggctatttgctctgctgaaaacactgtgttcccccagccatccatccctctgacctctggtcagatcagaggccttcc

SEQ ID NO: 157568 - DNA, 490 bp, Homo sapiens
caggaggtggagattgcagtgagccaagatcacgccactctactccagcctgggtgacagagtaagaccctgtctctcaaaaataataataataataataagatattgccaaactgttttctagtgtggctgtactattttgttttcccaccaacaacacacctttctagtaggtatatagggggatctcattgtgatttaaatttgcatttctgtatgatcagtgatgttgagcatgttttcatgtgcttatttgccatctgtatatgttctgtggtgaagtgtctattgtaatcttttgccattgtttgttattaaactgtgagagttctttatatattgtggatataaatcctgaccagctatgtgttttacaagtatttactcctaggctgtggcttgttttgttcataacagtatcttttgaaaaacaaatgtttctgtttttataaagtccaatttattaaatttttcttttatggttcatgct

SEQ ID NO: 157569 - DNA, 240 bp, Homo sapiens
gctcaggggctcttctcacagctttttgaccttcttgttcagagccttacactccacacctcttgagccagtcatggcctcctctagacctaaaaccaggagctgccccagtgctgagctcttcagctctagatccatttctgaccaaagtctttgagcttctgtttgccttctcctctcttctgactagtaggcctgaggatcagtttagacctctggagcccttgctgtcctggagtg

SEQ ID NO: 157570 - DNA, 551 bp, Homo sapiens
agctactgattgtgaaatttcagttacaacattatcttgccaagtgaaaaagctacgccttaagaggggtaagagtctccccttgttcaattatcttgggaaaacctgtctacagtgcggaaccatcgacttctcatcctggtttgcagtttgaatgtctctggttaaggcattgggcagtttggtgaacttttctgtgtggctcagacttcgagtaccagacttgtcccttaaaattcatcgagtttcagcttatagggcttcaggaacagagcaatttctgttttaataattctgtggaagaaagttggattggaggaacctagaagaatttaggatctaggccagtttgcaggtagataataaaaactcaaatacagtgtacagggctacagtctaataatagatacagtagtttttctttagaagcataactttttatagtcatcccagtttctaccaatcagaataagacaaatttgtttataaaatagttttattagttttttgtctgattatttacataaatgcagcaagaatagctgttgacc

SEQ ID NO: 157571 - DNA, 298 bp, Homo sapiens
tctctagccagcccaccactggagctatcaagccagtagcaactcagcagttccttggacagagcttccaggagcaaatgaaatcctttctgccactgcctttgcagtgaactgcccttgctatcctcagaagatatatcacgggagcaaagaccctaagtgccatatcaacacctccaataagctgcagttgacccaaagaacaagccaatccatctcccacaggtggattttgctttacttgcactgacagcacacaggagggcagcacacaccccaacccacatcaactgccatt

SEQ ID NO: 157572 - DNA, 367 bp, Homo sapiens
aagacagggtcttactctgttgcccaggctggattgcagtggtgcaatcacagctcactgtaacctcaaatctctgggctcatgcaatccccctgccatagcctccagagtagaatcagatcattttaaggggatactgtaaatttactattatgcctcaatggaacatccatggtcaactgtaagaaactctgtattcttaactttgttaaaacaaacaagcaaaccaaaaagctcgcgaatatgtttgtactatggcataaaataaagttttaaaagttgggaaaaaaatttaatgagttccaaaggtccagtggtgcaataaaaaaaatacatcatcctgatgttccagagcttccccattttc

SEQ ID NO: 157573 - DNA, 425 bp, Homo sapiens
catcacagcctcctctgtatacaccaggcagacaaaacctcccgagctgtctctcaatgttggcagactgaccacttctcagtcttcacaggggagaaccagggaagaaacaatctctgccaaccaatggcattcagacctctcctgtcatgtttgatggatatgaggtggtccctcaatggaaataatggactcaggacactggcgagatgagcttgaaagagttatctgggtcacgggaagactggaatggtaatattgaagctttaggaactagggaaattcgaccttggtgaacattacaagggcaggccttcatggttatgtacgttcttctggaagtgatggaaactgaatataaaagactttgtggcatagcaggaactcagccttttactctgtcgacgcggccgcgaatttagtag

SEQ ID NO: 157574 - DNA, 299 bp, Homo sapiens
tccagcactgaaaccaatagactttggccactttgagcagaatcacatcttctttcatgacactgtggttaatactttccagatagattttgttttcaagaaaattaccttaacaccactcttctttaggccacttcagacaaaccagaatgtctgcaagttaagtcgtgctagactttttcctcctttcttctagtctgatcctcaaactttgaatgaatgtgtgggtaacgtgggagcaaaattgcataaagtcctacactcatctcccttttgtttttgccaaagctgtgtcccgt

SEQ ID NO: 157575 - DNA, 455 bp, Homo sapiens
aaaggaactttcacattaggcaaagatacctaatgcttatggagtgagtgaagatgtaaagaatcccgagtttggggctttaaagataagttacattctggaaggaatgttgtatatgcattgaggctggtataaggtgacttctttttcagggactatgaagagagggaaagtagtagtccttattatttagatgttcttagaatgaatttcttttaacacaaagagctagtgcttggttttcatggaagttgattcttagccagatatgtattacttcagggagcaaatgtttcttttaatgaagagaaatttaaccttagtgagatctttgaattgtaatgcaactagtaaggtaacctgaaccatcctgttaacattttacttctgcctctggctgaaagctgtgtaaatggccgtaccctgtgtttattctgacttttgttccatgaact

SEQ ID NO: 157576 - DNA, 431 bp, Homo sapiens
gaattaaaagtcaaccacacagcaagaaaaacacgtgacagcagttcacattttgaatagcatggatgttcaggaggctatcctaaatgaccactttagctagcaatgaaaaaattcagactcactgaaaagtagtaagtgggtagaaaagtggtccctcaaagatgctcacatcctaatctccagaccctaaaaatatttcacctcacgtggcagagacgacttcgcagatgtgagtatcctagatgagattatcctagatatccacagataatagagatccatagatatctattatctatggatgaaggggggccatgagccaaggaatctggttgctctacaggctgagaatgttcttcagttgtcaaccagcaagaaaacagagatctcaatgccacaactgctagaaaattaattctgccaataga

SEQ ID NO: 157577 - DNA, 563 bp, Homo sapiens
ccgcaggatgagccctaagacttacagagcaatcgagaggagaaagcatcacatctttggggtcttccagttgtcagaagcttgtggcccccaggaagccctacaggtttgggaacaactgaaggtcacagttctcgtcttctgggtggctggccctctgtggcaggtttgtggccacagtggggtcagtgccccctcccgccaccatgagattgtaacttaaggaaatgaggtcaccgttggttggatcaacatggctccagccccagcctgtggttatcagtgacataagacgcttattctggcctgggcctggtggggggtgagggggaggcacatttgtttgggtggttgggctccaacctggctttggacaggccgttaattatccttgggaaagaggccccacagagtgttctgaaactccgtgttttcagggagcaggcccctcctcaggcaacctggccacagaatgttccagcctctgactgcccagtctctgactgctctgaataattattaacctcatgaggatttatactaataaaatatagtaactggaa

SEQ ID NO: 157578 - DNA, 597 bp, Homo sapiens
  misc_feature (168)..(168): n is a, c, g, or t
  misc_feature (270)..(270): n is a, c, g, or t
gtactaatcagtttacacaaatgtgtggaggatgctactaaagtcaaaaaggaaagaaagacaaaatataagggaaaagttgcatacgaaagattatctacccttttctttttttacctactttcttttaaagaagcgttagggtaaactacaaatacctgaggagtnggttaccttttaatgttggctgacaaatgtatgaactattatgaaaattcccatatggggcccaatggtatgtttctaaaagtaaaatgacatggcttcttngattgtgtaaactgattaatcagtttacacaaaaaaatcagtagctcttctagctatatgtataatagcagccagttagaacatataattgaagatcccttttaccatggttaaaaaaaaaagtgctatctaagaatacatagcaagaaatatgtagagcgtatatgaagaaaacttttaaactaccaaagagtataacagaagacttaaataaatgagtctcttctgggataggaggacctctcagtatggtaaaggtgacagttttctctaaactctaagtttaatttgctcaacataaaaagagcaacatgatgttttttctgg

SEQ ID NO: 157579 - DNA, 238 bp, Homo sapiens
cttgggtcctctaagccctccacttacggcaactcttgatgtcatgtgggcttgctgactagtggagagcgcctctattgaaaccaggtgattccaccaggttgctgctatgatgaggccataaactattatccgtctagtagggaattttctttaaaaatttgaaattgtttaaggaaggtcttaaaattcatccgtagtttattattatatttttaactttggtgtggcaacgtta

SEQ ID NO: 157580 - DNA, 907 bp, Homo sapiens
cacactcttgggtgtaccagtattattacactaaggaatctagcgctttatcagaaaagttcttgaaaagggtacatgcaacatcaatcacaaatatttatgaaaatcagtacctacaaataaaaatgaatgagagtatttattcttgctagaaaaacatttaataaggattttccttaacaggaagtcctccagcatgggcaacatagactccaactctacaaaaaattttttaaaaagtagccaggcacacatgcttgtagtgccagcctctggaaaggctgaggtgagaggactgcttaagcccaagtggttgacgctgtgaccatgccactgcattccagcttcggaaacagggaccctgtctcaaaaaagaggaggagagagggaagttttctggtacatccatcttccataactctcaagaatattatctattatattaattgaggcacattcagcagttaaggttttttttttaaagacttaagactttattggaaaagatcatccttttgacacaaaaataagaccagtggtcacgtatcacaattcaaacacgcaaatatctgccaatctaggagtgtcacactttccacagattatagtttccaaatgctagtgcaacatactactgaacctatgtgcacatacatagcaattgcaaatatgtaatgaaaagctcaaatgtttcccaataaaattttactgcttttctttagcctcagcaataaaaggagaaattatttgcttgttcttgtaattatttatgaaaaaagaaaaaaaaagaaatgatcacttttaaagggatctaagtaaataattgtgatatttacctttgagacttggataaagacagtgtgacattcttgtccttggggtaagtccaggatgaccttatgggtta

SEQ ID NO: 157581 - DNA, 141 bp, Homo sapiens
ttgggagaacaggagacctccacgtagcagtggaggggccctcccagctccctgtcccatagccttccctcagtccaccctacagacgctgggatccacacactgagggactttggactagagggagaaatagcccgtccc

SEQ ID NO: 157582 - DNA, 399 bp, Homo sapiens
ggtgtttcctttgtctaacttacacatcttccatcttcagtaatgaaaggtatgtatcattttcctccttgtagctgcataaaaataacaaaactagtccgggcatggtggctcacgcttgtaatcccagcactttgggaggccaaggcaggcggatcatgaggtcaggagttcaagacttgcctggcctggatcttttctataatggacatttctcacttatttacatctacctttattcttaagtctgtggcacttaaatttgtttcacattacttttccttgtgaaaatagtaattgtatgttggtgtttatatacactttttttttttttttaagatctagtatctactagttagcatttttggtgcctttgatatctcagatcaaagattcaca

SEQ ID NO: 157583 - DNA, 173 bp, Homo sapiens
aatggaaggggtgctgttgtgtgttagacacagtgcgatgtggtggtttagacagactcagggactttggaagccttgggcaggcatttaacctccctgtacctcagtatcttcatctgtaaaatgcgtaaacatccctacattcagcgtttcctaaggattaaacaatttaa

SEQ ID NO: 157584 - DNA, 387 bp, Homo sapiens
acatcctcatggaatgatctgcttgaaaaccacacccacagagtcttataaatattttatctgcttttgacctcttcaatcagtctctgcaagattttgttaagattgtgatcttctttgttatgctccatccacctcttcttccacctgtcactgagttatttcacatagacactatttctccctgcgatttttgcagaagcttctgaactggaatatttgtttcttagtgtcttctatcaaaatcaaactctacgttgatggcagagaagctttttaatgcaatttagattatgtcacactcctgcttcaaacctccagtggctttccactgtctttgggatgaaatctgaagtccttctaataaagcatgaattactcataatt

SEQ ID NO: 157585 - DNA, 225 bp, Homo sapiens
ttgctgatttctgctgagttggcttaggtctcaatatctgagtgctaaggagatggagtcaatgattcgatctttaacctcctcttgggattcagctccaatggtaaacaaaactctcttttccaaaagtcaccacatctcattgcatcttttcggctctggctgagtcaagtggtcatcatggagtgagccactggagcagtggagaatgcactggggtccctg

SEQ ID NO: 157586 - DNA, 223 bp, Homo sapiens
gagacagattacagggaagatctcgtggggttgtttaaaaagtctctcaaatttgatagacaggaaaactctttgctttaatttgtatttatttgatcattagtgaagttaagcttttaaatttgtattagtcatttgtctttcttcttttataaattatagatactttaaaattttatgcaagaaaatctatccatattttcttttatgatttctacccttg

SEQ ID NO: 157587 - DNA, 537 bp, Homo sapiens
aaattcctgcgtctctatggtgaataaatggatttctcaactttcttcatctgtaggttgctgggctatgttttgctccttttcctagctgtctggtttcccagtctgcttgggcttcccagtccccttttccactagatagatgatcacggccaagtaacctatggcaaagtgcttactctttgccttttttctgtaaaaaaaaaagatttgcaaatcatgcccaggagataccaaggggctgtttcagatttcatagttcagaattgttttcgtgtgtgtgtgtgtgtgctgttttttttgagagagagtcttgctctattgcccaggctggaagtactatggtgaaattatgtctcattgcagccttgaccttctgagctcaaatgatcctcccacctcactcctgagtagctgagactacgggcacatgccatcatgccaggctaatttttgtattttttgtagagacagggttttgacatgttgcccaagctggtcttgaacccctaggctcaagtaatccacctgcctcgg

SEQ ID NO: 157588 - DNA, 388 bp, Homo sapiens
ttaaaaaaaagttggttcaatggagttatgccatatagatgtttatgcaaatttagtaagctctcaataaagagagaaaaagcatttgactggggcggcggattcctcccaccatgtcacttaataggcacatcatttagtcacccccacctcctttttccaccctcctcgtgagacgacaagacaccagcctcattggcctcactgttgctcctttaacttgtcatctcttgtcccacctcagggccttggcactcactgttccttatgcctggaatgttgtctccccatggctcactccttcaattcccagctcagacatgtgtgtccctctcaaagagatctttcttgtgagatcgtaccttcccattaccatgtcctgctcata

SEQ ID NO: 157589 - DNA, 742 bp, Homo sapiens
atatctttccgtcatgtctttttcaaccttaaataaggaataacagtaatgacaactttcattccttctctccacttttttccttgcagctgtaacacatatcactgtactcatgtttgccagatcctcttacagtgtctttaaaatacttcagcataactgcattgcacttcatggcttacccctttggaactcctcataagtcctcactgtttgtattcatttgtacagaagtctcatcatccctattaaattatacccaaaaaagtgatatagatgcaggcattagttttaatccacacataggaataactaattaacatttgatatcctaattacgcgtacacactccagggtggatgaggtagcatatgaacacctctaatcaaggatgcatgctctagaatagggattcttaacgtggatagaatgaatgggggggggggttctataaacacggatggggaaaaggttacacttttatttctcagtaacttacaaatgaaatttagcgattccttcaattattaacataggtaatgaattatagtattagcagtacctgtgactttgtcaccaatacaaatcacagctgttttcgtatcacattctcattgttacaaatatctttagatgtttacattcaacacaactttgaagttgaagcaattattcccaatgctagaccttgttagttaataataaataagccaccatgcccggccagtgatttacacttcta

SEQ ID NO: 157590 - DNA, 306 bp, Homo sapiens
tcacacacacatacacacacacaccctccagagtcattttctttctttaatagtcatatgttcactagtgcaaactctggactgacattgaacctgaacagtgagagtaacggttgtacaaatgatgatccatccaccgtttaaaatcaggtctacaaagagttggaaaacaagagacaatgattttgataaatctaaagtgataaaacaggatgcaacattgtcacaacagtatgatcacaattacataatgaatgcactcatggaagagaaagtgaaggaaggatgtcagaatgtgacggtggt

SEQ ID NO: 157591 - DNA, 189 bp, Homo sapiens
aggataattgcaatgatgtgtccggtgctttacaggtggcaacttgctttctcatggaatatcttggaagtcatctaatcattccctctacctgatttacaaataccctaccaatgtgtggtgtaaggtaccaatatggtttggctctgtgtccccacccaaatctcatctcagattataatccctgta

SEQ ID NO: 157592 - DNA, 351 bp, Homo sapiens
ggaagagagaaatagtagaatgacaggccatgtttggcccgttggaaatgcccaccaccctttgggaagatttactggccgtttatagaaggcctgtgtatataatatgaaaaagcttctctcaactccaccccaaccttttaatagaaaatatttgccatatttagcccttctatagatggaaaaagccacgctgttttacttttataagcaatattgcattaaatttttaataatgaagaaaatccttcctgggtcgagtggggacttagagaacttttctgtcttacaagaggtttgtaaaatgcactcccaggcttttcaagaaattaaaaacaatctcttgacagt

SEQ ID NO: 157593 - DNA, 492 bp, Homo sapiens
gagacaggctcggtctgtcacctaggctggagcgcgatcttggctcactgcagcctccacctcccaggttcaagcaattctcctgcctcaggctcccaagtagctggattacaggtgtgcgccactatgcctggctaagttttttgtatttttagtagagacggggtttcgtcacgttggccaaggtggtcttgaactcctgactgcaagtgatctgcgagccttggcctcccaaagtgctgggattataggcatgagccaccatgccagattgacctggtttttattcattaataccacatgcattaattaaggctaactggttgataaatatgcaatcactgtaacagtcaatcatctagtgtttaactgtgtacctagggtctcagtagtagaagaatacagatttatcatccatgccaaaaaggagtttgtagccaagtgtgagagaatgtattcacatgaaaagtgacaaagaggcaggaaaaacgt

SEQ ID NO: 157594 - DNA, 315 bp, Homo sapiens
agctgccgaggaggggtcaccagcccctcggtgcggcacctgagtaacttgtccactgcctgaatcccacactttcttctgtgggagggaagtggcaagtccagacctccttggtaggtacaggagtgtgagctgcagcctggcagcttccctggcatcagatcggctgatttccaggcttgtggcccagcctcctgctgccaggtgtgacgagcgcattggcacggtcaggaagcagcagagcctgcctctgctctggggctcacggacaccagctcgtgcccccttcacacatctgcagatggggagaccaag

SEQ ID NO: 157595 - DNA, 650 bp, Homo sapiens
  misc_feature (107)..(107): n is a, c, g, or t
  misc_feature (169)..(169): n is a, c, g, or t
agaagactctgactctcttccttgctcccactctctcctgcttccttgtcctggtgaagccagctgccattctgtgagctgccctggggatgggccctgtggcaggnaccaatggtggctttcagccatcagccagcaccaaactgaggccctgagtccaaggaaccangaggatctgagtcctgccaagagccatgtgctgctgggccttgaggtgacaacgccttgatggcagccttgtgcgagacactgaactgaggtgtccgggaagacagcagctgcgttgctgtgaggacgctccaaaccttagcactatcgttactatggaacatcagaaccaacctgagggtcagctataaaacctgttaccctagagactggtacagcttcatgatttgacgaaatgcctccagatgctctcagagtgaagttatggaaacaatcccatgctgaaagaagatgctgaggtgaggcacaacagagaggaagaatgccagggaaacctgtcctgctggagacatggccaagaatcacgcagggacttgagcatccttgggtttccatatctgtgggggctcctggaaccaacccccagggatactgagagacaactgacagaccaagtgctgagagtcacagatgaagatcag

SEQ ID NO: 157596 - DNA, 861 bp, Homo sapiens
  misc_feature (107)..(107): n is a, c, g, or t
  misc_feature (169)..(169): n is a, c, g, or t
agaagactctgactctcttccttgctcccactctctcctgcttccttgtcctggtgaagccagctgccattctgtgagctgccctggggatgggccctgtggcaggnaccaatggtggctttcagccatcagccagcaccaaactgaggccctgagtccaaggaaccangaggatctgagtcctgccaagagccatgtgctgctgggccttgaggtgacaacgccttgatggcagccttgtgcgagacactgaactgaggtgtccgggaagacagcagctgcgttgctgtgaggacgctccaaaccttagcactatcgttactatggaacatcagaaccaacctgagggtcagctataaaacctgttaccctagagactggtacagcttcatgatttgacgaaatgcctccagatgctctcagagtgaagttatggaaacaatcccatgctgaaagaagatgctgaggtgaggcacaacagagaggaagaatgccagggaaacctgtcctgctggagacatggccaagaatcacgcaggtgagccacaggagaagggcatcagggatgcagctgatgttttcttaggatattttcttctgtctggaaaagtggcaggtgggaggctggcatgaataaaccctggggaagaagttattgaaagaaaacccagacaatgaagtaagggccacaggatttcaaagtcaggaaaggagaaatcagtgaaataaacccaactggatttcattcattcattcattcattcattcactcattcattcctctataggccaggacccaaatagatctctatagacccttctaggtttatagcctttctccagagtaccaactggtacaat

SEQ ID NO: 157597 - DNA, 491 bp, Homo sapiens
gctgcgagactagagcatggctccggtgtccagaactgagctgtcgcggtgtagcggttgacagtcgctacagctgatccttgttctgtggcaccattctgattgtgtgctagtctacctgactgttccctggtccctaagggcctttcttgttccttccagctgttcctggctcacacagactgactgctgttggattctgctgactaatctctagtctcctgattcttccctgtccttggacagttccttgagtacatttctttctttccattctttccttctttttcttcctcccttcctgtttctgagacagggcgtcactctgccacccaggctggagtgcagtggcacaatcacggctcactgcagcctccacctcccaggctcagatgatcctcccacctcagtaccaccctacccggctgattttttttttgtatgtatatatatatatatatcacacacatatatatatatacacacacaca

SEQ ID NO: 157598 - DNA, 416 bp, Homo sapiens
gccataccctattggttggggaagccacaaaatttcacctagatttaagcccaggtgctatggcctgaatgtttgtgttccctcaaaattcctatgttgagatcctaagccttaaggtaatagtattagaagatggagtctttgggggacacttaggacatgagtgaagagccttcatgattgggatgatgcctttataaaagagaccccagcgagcttgcttgccccttccatcgtgtgaagatgcaactagaaggcaccatctatgaagaagaggaccctcaccagacattgaaactgctgacacctccatcctggacttctcagcctccagaactgtaaacaatgtatttctgttgtttagaagtgacccagtctaaagtattttgttgtagcagtccaaacagactaaacag

SEQ ID NO: 157599 - DNA, 309 bp, Homo sapiens
attgcgcctggtgatggatatgtgagaattataacttaaaagaagaggcaagaatttcagacctgaaatggaccttagtgatatctagcatagatttattttacatatgaggaaagtgaggcctagtgtcactacctgaaatcctagagaataaagactagaatttttgtaaatgtaacttttttcctggctatttaacattgttaccctttgttttagaaaaagccacattaaaagggatatatatctatatgccctcaatgtttcttcctcctatagggggatagccactctgacccacggcataca

SEQ ID NO: 157600 - DNA, 439 bp, Homo sapiens
tggtgcttgactctccccattgctggcctaggattcagttttcttaggtcttataaatcattttccactcttctatcagcttccaatgtatcatggctgttgtttctccctgtctttctcatcctttggaattcatacttttaaaaacaaatctggccgggcacggtggctcatgtctataatcccagcactttgggaggccaaggccagtggatcacttgaggtgaggagttcaagaccagcatggccagcatggtgaaaccccatctctactaaacataccaaaaaaaattagctgggcatggtagtgcatgcctgtagtcccagctacctgggaggctgaggcaagagaatggtttaaacccgggaggcggaggttgcagtgagctgagattgcaccattgcactccagcctgggtgacaggacaagactccgtct

SEQ ID NO: 157601 - DNA, 453 bp, Homo sapiens
gacagagtcttgctctgtcgcccaggctggagtacagtggcatgatctccgctcactgcaacctctgcctcctgggttcaagcaattgtcctttctcagcttcccggttagctgagattacaggtgtgcgccaccgtgcccgactaatttttgcatttttagtagagacagggtttcaccatcttggccagactggtcttgaacccctcacctcaggtgatcggcctaccttggcctcccaaagtgctgggattacaggcatgagccactgcacccagcagtgatcggtgactattcacgtgaagagactgttggaaaatgacagttaggtagaattattaaggaaatgtctgtaagtatgaaggaggtcaaagtatgaaatctgtagattgctcaggcttttaagtggcctgaccatgtagtgccaaaccgacttccagtatcaccgttgtg

SEQ ID NO: 157602 - DNA, 348 bp, Homo sapiens
cctaagttgaattttttctgactgctacccttttgagcaatcttacccatgaattgctgcctttaaaattcctctgataacttttttttttttaagcttcaggtttagccaaaaacatgactgaacctgactcccaaagtgctgggattacaggcatgagccactgcacccagcagtgatcggtgactattcacgtgaagagactgttggaaaatgacagttaggtagaattattaaggaaatgtctgtaagtatgaaggaggtcaaagtatgaaatctgtagattgctcaggcttttaagtggcctgaccatgtagtgccaaaccgacttccagtatcaccgttgtg

SEQ ID NO: 157603 - DNA, 588 bp, Homo sapiens
gaagtaacagctgaaaatgtcccaagtcttgtaagagatatagacatccaaatataggaagctcaaagattcccaaagagattcaacccaaaaatgtcttctccaaggcacactagtcaagttgtcaaaagtcaaagaccaagaattctaaaaaacagcaagagaaaatcttacatagaagggatatacagaagggattcccatcagatgggaacaacaataaagttgttcccagataagcaaaaacagggaattcattatcatgagactggacctacaagaaatgcttaaggaaatcttacacctggaagtgaaaggatgctatctaccatcataaaaacacatgaaagcagaaagctcactggcagaacagacacaaatgagagaaagaagtcaaatgttaccaccacagaaaaccatcaaactgcaaagataaataagataggaagaaagaaacaaaagatacagaaaacaataaaatgacaggaataagtccttacctatcaataaggaaccatgaatgtacatgggttaaattctccacttaaaagatataatttggctgaacagattaataaacatgaccca

SEQ ID NO: 157604 - DNA, 396 bp, Homo sapiens
cactccagttgtgtacctcaatgtttttgtgcttttttttgagacggaatctcgctctgtcactcaggctggagtgcaatggcacgatctctgctcactgcaacctccgcctcccaggttcaagccattctcgtgcctcagcctcccgagtagttgggattacaggcgcctgccaccacgctcggctaatttttggtatttttagtagagacggagtttcactatgttggccaggatggtctcgatctcctgacctcgtgatccgcccacctcggcctcccaaagtgctgggattacaggcgtgagccaccgcgcccggcctacacagtttgcattttaaaagattactttgtatacccctagagaggttcccccccatggaattctatattgtct

SEQ ID NO: 157605 - DNA, 544 bp, Homo sapiens
gcctgatctttttttaaacttgcagaaatttctttagtgatgcacttatttcctgaatttagcagaaccttactttaaaggggttcacattcttacaatgagcagttatttctgacagaaagaaaccatgacatctctaaattgtgcataatccctacagtctctatgactaggatatccaggatattttgaaactgaggaaagatgaagtccccaaacaagaactgagtctagtctattcatgcagctgtagggaaagagacaaacttctcgactgagatattggtttccctcccttttactgcattgccaacaaaaatggtggtactagtctattccagccagttaaggagtcatttcttcctgtctccctcctgtccttcctctaataaaagtaatagacatgttcgccacctacaaagggaatggaaggtaacagataagctctaatagcccatgacattcctaacttgtccatagggaataatcaactgtaaactagattggtttagaaatacctcctgttggccgggcgcagtggctc

SEQ ID NO: 157606 - DNA, 304 bp, Homo sapiens
aggctctgatatataaaagagaagtatttttcagcgcctcttaactactatagtaagaagtaatatttataagaagaaaaggaggaaaaaaagtatctaaaacaaactggttaggtaggaacatcagaagtagagaagtaaaagtttgtaagttctaaagccaagacattcaagaacgaaaagagaacatcacccctgagctgggacacattcacctgagaaccagccatttcttcctcttgctcttccctttgggattccttctcaggtgatattatctggaaaatcacatctgtaacttgag

SEQ ID NO: 157607 - DNA, 271 bp, Homo sapiens
tgtgctcccccttcgtccaatctcagggtgggaaatcaagataacagttatccttgcatgattttcctccccatcacttcctttactcttttcaaatgtgttacagcagaacattctctaagtagaacatactctgcctttccccaaattgactaggaagaaggactgttcaccactgtctcctatggggaagagaaagcatcatcagtggctctgttctcgtccttccccacactatgctttccggttgccccacgtcagcctactcctc

SEQ ID NO: 157608 - DNA, 304 bp, Homo sapiens
acccactcctctgcctcctcacctcgctcccaggaccctggctcactctgactgcagcagggccaggaccctcctcgtggccctgccatcctgccatctccgtctccgtctcactccccacaagtggttgctattgctggtttggttccgcgtcaaagttcccaaggccatgtaccctaaggagtcctcaccccgaggccaaaagagagcctctttttcatggcccacccaggagtgatggagccaggatgcaaccccaacacccctaaccccaaacacacacgcctcctgtggccctgaaaca

SEQ ID NO: 157609 - DNA, 541 bp, Homo sapiens
aattactatgagaagccacagtatgtcaactgagagatacattaagccaagtgaaaaaagtgactttttcttaaaacaactttagaaatctaccattgcacatcatattggtcagaaaattgataactttgaagtttaggagaagggaagaggaactggaaggcatgagatgatataaagcagcaaacaagaaccaaatcgtgtgtgcagtgcttctaatgtgtcattgctgcaggcagatgtttaggggtcttgccttgggagatggtaatcaatgaagaccagaaataaccaggacaacattgggtgtgtgtaggtagtgatggcatcaatctttataccaatttataattgtaatatgcctagcacctttttttaaagctttattgcaatcatcactaccccaaaaagaaacacaatacccactagtattccctccctgtctcctagtcctcagcaaccactgatctactttctgtctctacagattgcctgaatgtaaaattctggacattttacataaatgaaatcataccatgtg

SEQ ID NO: 157610 - DNA, 225 bp, Homo sapiens
tataatggaagggagacaaagacaagggtgtggatttgagctttttattttgaaaactaaaacaaaggacatgaatataagttgggtgtccagaatgagagaggaatcaagggtggcctcagtgtccatggtgttagcaaatgggtggtgaacgaggcaaaagtgggtaaaattgggagagaaacattttcttattttaaatcccaatttgctccttgggtacaa

SEQ ID NO: 157611 - DNA, 578 bp, Homo sapiens
agatgactgcagagaacccccgccctgactgcttcagcttcggaaaagttctgaagtcatggaaagttggggctgtgctcccagccaggggctaggccggatggcagccaaaacctgagctgggttttgactttatttttagcttttctgactgagacagaggagggaatacattctccggttctggaaggggctcttttttgcaggagacagacacttacattaaacaacttgttctgaggtgtggccagaggcctggactgagcaagtgtgcaggctgggggagcttcctctggcttctcatgtccttcccctgcccctctgagtgtcactctatcctcctccctgcctggtggggggaggtgggggtgactccttttttggactctcctaagcagaacactgcctgggtctcgtcctccagagcttctgcaaatctagccttccctatccctcttcacagtgaattgctgggcctcttggagtttaggacttttgtggtagaagaaaaatgttggcagggctgcttttctcctttccaggatagatttttccttctgcccacgcttggttttcct

SEQ ID NO: 157612 - DNA, 686 bp, Homo sapiens
gccttcagggtagagaggcctcttctgggaagccccagccagcctgggggtcagcccaaggagctcggaatctaagttgccccagttgcttcactttaccagcggtttttcttcattttccctcctccccctgcagctgcttcagcttcggaaaagttctgaagtcatggaaagttggggctgtgctcccagccaggggctaggccggatggcagccaaaacctgagctgggttttgactttatttttagcttttctgactgagacagaggagggaatacattctccggttctggaaggggctcttttttgcaggagacagacacttacattaaacaacttgttctgaggtgtggccagaggcctggactgagcaagtgtgcaggctgggggagcttcctctggcttctcatgtccttcccctgcccctctgagtgtcactctatcctcctccctgcctggtggggggaggtgggggtgactccttttttggactctcctaagcagaacactgcctgggtctcgtcctccagagcttctgcaaatctagccttccctatccctcttcacagtgaattgctgggcctcttggagtttaggacttttgtggtagaagaaaaatgttggcagggctgcttttctcctttccaggatagatttttccttctgcccacgcttggttttcct

SEQ ID NO: 157613 - DNA, 116 bp, Homo sapiens
agtgtccaccttaggctgctcgatgaagggggtgatacactcatcttcatccctagtgttcacacgagtggtcttttcacaaagcagtctccacactggataagccaattattttc

SEQ ID NO: 157614 - DNA, 308 bp, Homo sapiens
atccaaatctcatgcaatttttttatggttctcattagctcagacgcatgcagggaggcggggtctgggaaatgtaaagtccagtttacgtgacaccatacaaagtcactgtgtaacgcgtgtcacaaattaactacagagatttttattgcagtattacttgtgataataaagaataggatacaacctaacttccaacaatacagaaatggttaaaaatgtatgaaacatccacacattagaacataatatattacaaagggggctgggtgtggtggctcacgcccataatccccaactttgggagg

SEQ ID NO: 157615 - DNA, 317 bp, Homo sapiens
aaaaagtaaactatgaatagattcattacattttaaatttgcttgtataacttgtaaagtcttttcacatatatggtgaataatttagggactgaggactaacagcatggatcgcagtaacgtcttttaatctagaattcaagaactattcatttatcaagcatttatttcaaagtatttaaaaagtattcacttttaaaaattgaagtagctaaatctttagaagctaaacttttattgcatcttctcctcagaaatccatctattgtcttcctatcccacttatactgatgtcttacttacgctagactcaggtg

SEQ ID NO: 157616 - DNA, 240 bp, Homo sapiens
tactttcttttacaacaaaaaagtaataaaaatggttacctatagggtgatactgggaagaatgaaaacagagaatgcttctctatgtagaactttttatttaattttgacttcaaacctatttatatggaaagaattaatccagaaattgaaaactcagaattagagaaacagaaataaaccactattaacatcgaatcggtaaaatatctacacagaaaaaatatatgaagagacttt

SEQ ID NO: 157617 - DNA, 442 bp, Homo sapiens
ccacttccaggtatggctgagaagggtgaaaatgcatgcacccacagacacacacacacaccgtggaaatgaggaaaagttacttctctctgttgtaaatttaaatgcagtccagagtagtgaaggccgtttgtaaggtctgctgagctaatggattcataatgacttttaaagcttcactcggctgcactgggggagagcctgctgaagctgcttgaatctcaacactgtcatacccgccatctcattatctacagccacatctaaaacccacatgaaataccaagtcacacgcggctctgggaaagacattttacagagaccatcttatgagtttttaatctgcctcctgagaacttacaatctaagaaatagaaaactgattccagtaagcatgcccagaatatgctagcagcaagattaaaacatgaaactatgaaaa

SEQ ID NO: 157618 - DNA, 295 bp, Homo sapiens
ccacttccaggtatggctgagaagggtgaaaatgcatgcacccacagacacacacacacaccgtggaaatgaggaaaagttacttctctctgttgtaaatttaaatgcagtccagagtagtgaaggccgtttgtaaggtctgctgagctaatggattcataatgacttttaaagcttcactcggtacatcctatgtgccagacactgcgataggttctggagataacaacagtgtccaagaaacaacagtgtccaagaaacaggactttccctcaaagagcttactggggaagcc

SEQ ID NO: 157619 - DNA, 2462 bp, Homo sapiens
tcattaataagacaaactactggtgaaaaaaagaaccctttccgatattttagtaaacaagaattaagagagctctttacaatcgaggatcttcagaactctgtaacccagctgcagcttcagtctttgcatgctgctcagaggaaatctgatataaaactagatgaacatattgcctacctgcagtctttggggatagctggaatctcagaccatgatttgatgtacacatgtgatctgtctgttaaagaagagcttgatgtggtagaagaatctcactatattcaacaaagggttcagaaagctcaattcctcgttgaattcgagtctcaaaataaagagttcctgatggaacaacaaagaactagaaatgagggggcctggctaagagaacctgtatttccttcttcaacaaagaagaaatgccctaaattgaataaaccacagcctcagccttcacctcttctaagtactcatcatactcaggaagaagatatcagttccaaaatggcaagtgtagtcattgatgatctgcccaaagagggtgagaaacaagatctctccagtataaaggtgaatgttaccaccttgcaagatggtaaaggtacaggtagtgctgactctatagctactttaccaaaggggtttggaagtgtagaagaactttgtactaactcttcattgggaatggaaaaaagctttgcaactaaaaatgaagctgtacaaaaagagacattacaagaggggcctaagcaagaggcactgcaagaggatcctctggaaagttttaattatgtacttagcaaatcaaccaaagctgatattgggccaaatttagatcaactaaaggatgatgagattttacgtcattgcaatccttggcccattatttccataacaaatgaaagtcaaaatgcagaatcaaatgtatccattattgaaatagctgatgacctttcagcatcccatagtgcactgcaggatgctcaagcaagtgaggccaagttggaagaggaaccttcagcatcttcaccacagtatgcatgtgatttcaatcttttcttggaagactcagcagacaacagacaaaatttttccagtcagtctttagagcatgttgagaaagaaaatagcttgtgtggctctgcacctaattccagagcagggtttgtgcatagcaaaacatgtctcagttgggagttttctgagaaagacgatgaaccagaagaagtagtagttaaagcaaaaatcagaagtaaagctagaaggattgtttcagatggcgaagatgaagatgattcttttaaagatacctcaagcataaatccattcaacacatctctctttcaattctcatctgtgaaacaatttgatgcttcaactcccaaaaatgacatcagtccaccaggaaggttcttttcatctcaaatacccagtagtgtaaataagtctatgaactctagaagatctctggcttctaggaggtctcttattaatatggttttagaccacgtggaggacatggaggaaagacttgacgacagcagtgaagcaaagggtcctgaagattatccagaagaaggggtggaggaaagcagtggcgaagcctccaagtatacagaagaggatccttccggagaaacactgtcttcagaaaacaagtccagctggttaatgacgtctaagcctagtgctctagctcaagagacctctcttggtgcccctgagcctttgtctggtgaacagttggttggttctccccaggataaggcggcagaggctacaaatgactatgagactcttgtaaagcgtggaaaagaactaaaagagtgtggaaaaatccaggaggccctaaactgcttagttaaagcgcttgacataaaaagtgcagatcctgaagttatgctcttgactttaagtttgtataagcaacttaataacaattgagaatgtaacctgtttattgtattttaaagtgaaactgaatatgagggaatttttgttcccataattggattctttgggaacatgaagcattcaggcttaaggcaagaaagatctcaaaaagcaacttctgccctgcaacgccccccactccatagtctggtattctgagcactagcttaatatttcttcacttgaatattcttatattttaggcatattctataaatttaactgtgttgtttcttggaaagttttgtaaaattattctggtcattcttaattttactctgaaagtgatcatctttgtatataacagttcagataagaaaattaaagttacttttctcaaaaaaaaaaaaggggggggctaaatatcccgggggcagatagggaccgttttgaaaagggcctagggggcgattaaagccgggcgtaaagcggaggaaaggttgacttgagccactcggggaatggacccagatggcggaaaagtatgacgtggggagtgtaaagaa

SEQ ID NO: 157620 - DNA, 1911 bp, Homo sapiens
taggctacgtggagccggggtgaatcggacgaggcacttgcaagatggtaaaggtacaggtagtgctgactctatagctactttaccaaaggggtttggaagtgtagaagaactttgtactaactcttcattgggaatggaaaaaagctttgcaactaaaaatgaagctgtacaaaaagagacattacaagaggggcctaagcaagaggcactgcaagaggatcctctggaaagttttaattatgtacttagcaaatcaaccaaagctgatattgggccaaatttagatcaactaaaggatgatgagattttacgtcattgcaatccttggcccattatttccataacaaatgaaagtcaaaatgcagaatcaaatgtatccattattgaaatagctgatgacctttcagcatcccatagtgcactgcaggatgctcaagcaagtgaggccaagttggaagaggaaccttcagcatcttcaccacagtatgcatgtgatttcaatcttttcttggaagactcagcagacaacagacaaaatttttccagtcagtctttagagcatgttgagaaagaaaatagcttgtgtggctctgcacctaattccagagcagggtttgtgcatagcaaaacatgtctcagttgggagttttctgagaaagacgatgaaccagaagaagtagtagttaaagcaaaaatcagaagtaaagctagaaggattgtttcagatggcgaagatgaagatgattcttttaaagatacctcaagcataaatccattcaacacatctctctttcaattctcatctgtgaaacaatttgatgcttcaactcccaaaaatgacatcagtccaccaggaaggttcttttcatctcaaatacccagtagtgtaaataagtctatgaactctagaagatctctggcttctaggaggtctcttattaatatggttttagaccacgtggaggacatggaggaaagacttgacgacagcagtgaagcaaagggtcctgaagattatccagaagaaggggtggaggaaagcagtggcgaagcctccaagtatacagaagaggatccttccggagaaacactgtcttcagaaaacaagtccagctggttaatgacgtctaagcctagtgctctagctcaagagacctctcttggtgcccctgagcctttgtctggtgaacagttggttggttctccccaggataaggcggcagaggctacaaatgactatgagactcttgtaaagcgtggaaaagaactaaaagagtgtggaaaaatccaggaggccctaaactgcttagttaaagcgcttgacataaaaagtgcagatcctgaagttatgctcttgactttaagtttgtataagcaacttaataacaattgagaatgtaacctgtttattgtattttaaagtgaaactgaatatgagggaatttttgttcccataattggattctttgggaacatgaagcattcaggcttaaggcaagaaagatctcaaaaagcaacttctgccctgcaacgccccccactccatagtctggtattctgagcactagcttaatatttcttcacttgaatattcttatattttaggcatattctataaatttaactgtgttgtttcttggaaagttttgtaaaattattctggtcattcttaattttactctgaaagtgatcatctttgtatataacagttcagataagaaaattaaagttacttttctcaaaaaaaaaaaaggggggggctaaatatcccgggggcagatagggaccgttttgaaaagggcctagggggcgattaaagccgggcgtaaagcggaggaaaggttgacttgagccactcggggaatggacccagatggcggaaaagtatgacgtggggagtgtaaagaa

SEQ ID NO: 157621 - DNA, 2296 bp, Homo sapiens
tcattaataagacaaactactggtgaaaaaaagaaccctttccgatattttagtaaacaagaattaagagagctctttacaatcgaggatcttcagaactctgtaacccagctgcagcttcagtctttgcatgctgctcagaggaaatctgatataaaactagatgaacatattgcctacctgcagtctttggggatagctggaatctcagaccatgatttgatgtacacatgtgatctgtctgttaaagaagagcttgatgtggtagaagaatctcactatattcaacaaagggttcagaaagctcaattcctcgttgaattcgagtctcaaaataaagagttcctgatggaacaacaaagaactagaaatgagggggcctggctaagagaacctgtatttccttcttcaacaaagaagaaatgccctaaattgaataaaccacagcctcagccttcacctcttctaagtactcatcatactcaggaagaagatatcagttccaaaatggcaagtgtagtcattgatgatctgcccaaagagggtgagaaacaagatctctccagtataaaggtgaatgttaccaccttgcaagatggtaaaggtacaggtagtgctgactctatagctactttaccaaaggggtttggaagtgtagaagaactttgtactaactcttcattgggaatggaaaaaagctttgcaactaaaaatgaagctgtacaaaaagagacattacaagaggggcctaagcaagaggcactgcaagaggatcctctggaaagttttaattatgtacttagcaaatcaaccaaagctgatattgggccaaatttagatcaactaaaggatgatgagattttacgtcattgcaatccttggcccattatttccataacaaatgaaagtcaaaatgcagaatcaaatgtatccattattgaaatagctgatgacctttcagcatcccatagtgcactgcaggatgctcaagcaagtgaggccaagttggaagaggaaccttcagcatcttcaccacagtatgcatgtgatttcaatcttttcttggaagactcagcagacaacagacaaaatttttccagtcagtctttagagcatgttgagaaagaaaatagcttgtgtggctctgcacctaattccagagcagggtttgtgcatagcaaaacatgtctcagttgggagttttctgagaaagacgatgaaccagaagaagtagtagttaaagcaaaaatcagaagtaaagctagaaggattgtttcagatggcgaagatgaagatgattcttttaaagatacctcaagcataaatccattcaacacatctctctttcaattctcatctgtgaaacaatttgatgcttcaactcccaaaaatgacatcagtccaccaggaaggttcttttcatctcaaatacccagtagtgtaaataagtctatgaactctagaagatctctggcttctaggaggtctcttattaatatggttttagaccacgtggaggacatggaggaaagacttgacgacagcagtgaagcaaagggtcctgaagattatccagaagaaggggtggaggaaagcagtggcgaagcctccaagtatacagaagaggatccttccggagaaacactgtcttcagaaaacaagtccagctggttaatgacgtctaagcctagtgctctagctcaagagacctctcttggtgcccctgagcctttgtctggtgaacagttggttggttctccccaggataaggcggcagaggctacaaatgactatgagactcttgtaaagcgtggaaaagaactaaaagagtgtggaaaaatccaggaggccctaaactgcttagttaaagcgcttgacataaaaagtgcagatcctgaagttatgctcttgactttaagtttgtataagcaacttaataacaattgagaatgtaacctgtttattgtattttaaagtgaaactgaatatgagggaatttttgttcccataattggattctttgggaacatgaagcattcaggcttaaggcaagaaagatctcaaaaagcaacttctgccctgcaacgccccccactccatagtctggtattctgagcactagcttaatatttcttcacttgaatattcttatattttaggcatattctataaatttaactgtgttgtttcttggaaagttttgtaaaattattctggtcattcttaattttactctgaaagtgatcatctttgtatataacagttcagataagaaaattaaagttacttttctcaa

SEQ ID NO: 157622 - DNA, 1753 bp, Homo sapiens
tagtgttctagaggatccctggcttcctacaagaggggcctaagcaagaggcactgcaagaggatcctctggaaagttttaattatgtacttagcaaatcaaccaaagctgatattgggccaaatttagatcaactaaaggatgatgagattttacgtcattgcaatccttggcccattatttccataacaaatgaaagtcaaaatgcagaatcaaatgtatccattattgaaatagctgatgacctttcagcatcccatagtgcactgcaggatgctcaagcaagtgaggccaagttggaagaggaaccttcagcatcttcaccacagtatgcatgtgatttcaatcttttcttggaagactcagcagacaacagacaaaatttttccagtcagtctttagagcatgttgagaaagaaaatagcttgtgtggctctgcacctaattccagagcagggtttgtgcatagcaaaacatgtctcagttgggagttttctgagaaagacgatgaaccagaagaagtagtagttaaagcaaaaatcagaagtaaagctagaaggattgtttcagatggcgaagatgaagatgattcttttaaagatacctcaagcataaatccattcaacacatctctctttcaattctcatctgtgaaacaatttgatgcttcaactcccaaaaatgacatcagtccaccaggaaggttcttttcatctcaaatacccagtagtgtaaataagtctatgaactctagaagatctctggcttctaggaggtctcttattaatatggttttagaccacgtggaggacatggaggaaagacttgacgacagcagtgaagcaaagggtcctgaagattatccagaagaaggggtggaggaaagcagtggcgaagcctccaagtatacagaagaggatccttccggagaaacactgtcttcagaaaacaagtccagctggttaatgacgtctaagcctagtgctctagctcaagagacctctcttggtgcccctgagcctttgtctggtgaacagttggttggttctccccaggataaggcggcagaggctacaaatgactatgagactcttgtaaagcgtggaaaagaactaaaagagtgtggaaaaatccaggaggccctaaactgcttagttaaagcgcttgacataaaaagtgcagatcctgaagttatgctcttgactttaagtttgtataagcaacttaataacaattgagaatgtaacctgtttattgtattttaaagtgaaactgaatatgagggaatttttgttcccataattggattctttgggaacatgaagcattcaggcttaaggcaagaaagatctcaaaaagcaacttctgccctgcaacgccccccactccatagtctggtattctgagcactagcttaatatttcttcacttgaatattcttatattttaggcatattctataaatttaactgtgttgtttcttggaaagttttgtaaaattattctggtcattcttaattttactctgaaagtgatcatctttgtatataacagttcagataagaaaattaaagttacttttctcaaaaaaaaaaaaggggggggctaaatatcccgggggcagatagggaccgttttgaaaagggcctagggggcgattaaagccgggcgtaaagcggaggaaaggttgacttgagccactcggggaatggacccagatggcggaaaagtatgacgtggggagtgtaaagaa

SEQ ID NO: 157623 - DNA, 987 bp, Homo sapiens
  misc_feature (804)..(804): n is a, c, g, or t
aaatagagagaaaagggtttccttttgttctctcctggagctgggacactcttcatctcctgaacttggacattagaattccattctccctggccttgagactctgagacttacacaagcagccccacccaggttctcaggccttcggactcacattgagaattacaccatcagcttccctggttctgattctttagaacttggactgagccacgctactatcatcccagggtctccagcttacaagtgtcctgccatgggacttctcagcctccataatcatatagatgataccaaagcggccaacgagtttaaaactctttttgcgcagtaggaatgactccatgaagatttctcatcatggagcccagactagatggacccaaatctccagactcccagctcttctgtaaaccccatcctgattctctgagtctctgaatcttttatcctcattttcttcccaactgtccataatgtagaatttaaataaaagattaaatgtaatctttataaacaaaaaaaaaaaaagaaaaaaaaaaaacaaacaaaaaaaaaacaaagaaaaacataaaaaaaaaagggggggggggggaataaatatactcccggggggggggccaaattgatgggaccccttttttttggcaaaggggggccccaaaagggggggaataaaaaagggaagggaggggggcgggaaaaaagggggggggggaacacgcgagggggctctgggaggaccccctctttcggcggccaaggggaaccccccacgagaatgagggcgcggggaaaataacntgggtgttggggtacccagcgcattctggcgaaaagttgtctcactttttgatatggcgggtatacattaataggggatgaatgaacaagaaagcgtcagtatggaagagacaggtaatatctgaatcctcttgaagtcagtaaggaacccaacgtcaagaacgcagcatgtgcactacagta

SEQ ID NO: 157624 - DNA, 484 bp, Homo sapiens
ctgaacaaggcgcctccctctctgaggctgttttccaaatgcagacagggcacagtccccaggcctcttgaggccacccccaacttaccctgtgaccttgaccctccccgcctcaggggcatcagcaggtggcagcccctgcagcccctgccccgcaggcttcacctgaggactggaggcagcaatactgaaaaacgtgcaagggcgccccagcctctgttgggtgctctatgtgtgttaaataaacacaaacgattaaattatcagccactcagacacagtgagccccaagctcagaattctttgctcttttggccacacatcaagtgagttcccacctccaggcctttgccagcccctcccatcctgaaacattactcctctgtgaagcctttgcttggccccacctctgggctcccatagcaccaatcacacccggatgtttaccccactgcgatggaccactgtcatccccacggactga

SEQ ID NO: 157625 - DNA, 229 bp, Homo sapiens
catgaggcaacagaggacactggctacttggtgggtctggggaggctggactttagacaccgggtttcctgcctggcagaggttcaggtgccatgcaagtacagatatgctgattttaccggcctgtgggtgaccatgaggattttggcagcaagcacaacaggctagaggccctttgcttctgtgacatccgaggaatagctctgagggatcagtttctaccacaggc

SEQ ID NO: 157626 - DNA, 354 bp, Homo sapiens
actgaattgcacacttaaaaatgattaaaatggtaagttgtacattatgtgtattataccattaaaaaaaagatagccatacataggtgggaatgaggtggctgggagaagggacagttctggagctcctgtccaggacagccttccaaagccatctttgctgcactgtgtgtgcctttccaagggcctgggttgtacattaattgagaaatgattcctaataagtcccaagaagccacaggtcttttccttacaaacaggaaacaatcacatctcatggcagctcattacacattctttgggtaccatgagttgttttaaaaccgtgaaattagttctggcagagtttacaga

SEQ ID NO: 157627 - DNA, 439 bp, Homo sapiens
agcagatgtcaataagggtttagctgactgatggtttgatacatgagctctgtatctccatgattcaggtgttttcctgaaaactaatttttaaaagacaaattgctccaggccatcattaatcttttcctgagatactttcatacatttagatgctctgaaaaaatatgttgcccaaatagcattttgtgcctttacatttcttcaagtacgtataccaacataatccctattaaaataatccttgaaagtcactacctaaacctacgtattattctagtttgtttcttcaaatagcaattaccaggtatggtgtctcacacctgtaatcccagcactctggggaggccgaggcaggcacatcgcttgaggccagtagttcgagaccaggcctggccaacatagcgaaaccccgtctctactaaaaatacaagtggta

SEQ ID NO: 157628 - DNA, 489 bp, Homo sapiens
tctgaggctgtggtgagccatgatcccagaactgcactccaacctgggtgatagtgcaagaccctgacttaaaaattaattaattaattaatgagaaaatggctgaaaattatttcacagtagatgaaaggccatacagaaaaaatgctcaacaccgatgttaatcagtaaaaagcaacatctaatcacatggagataaatatttataaggaataaacacacatgcacacatggtctgccagttaatccatacatgccaacgggttttcctagcacatttaaatttatccataatccacaacccagcacatttccccctatatgtacaaaatgtataaagtgttagcatttggggacaaaaacaaagatgacattgtcaacaaagtccagcaaaaatgaaacaattcaagtcctatgagccgtggaatatgagagtgaagtgggtgacccacacctcagacagcagcatgaatcaaacagactgaggca

SEQ ID NO: 157629 - DNA, 209 bp, Homo sapiens
cttcgttcatacttggagatttactacactgctaggtgaaacagacaaaaaatataaaagatatagaacactgtacctcaaatgcaaaaatcacattattatctagtatatttggaacatatacaaaaattgactatattcccagcacaaaaacaaataacaactaatttcaaaggactgaaatcatacagggtaaactaaatttcaca

SEQ ID NO: 157630 - DNA, 299 bp, Homo sapiens
gctctcctgctgtggttcagtcttgatttttcaaaggcacgggtcaccaagtcgctgcccagttaggtggctgagggagaggctcgtggagaggctcgtggagcgcctcgagcatctgagctttctcaggactcggagctgtgctgttggcgtcagcgtgtgacaccaagaacctcctcacttggggtcagaaatctgcttgattcacttagctggtttgatgccagtcctccagccacacaccctgccctcctcacactgtcctgaggatgccgggttttcgtgtcctgactcctggg

SEQ ID NO: 157631 - DNA, 525 bp, Homo sapiens
gatttattggtctttgggggaatttgatgcatcaccactatattagaactgagccattaattttgtagcttcatcaatattaactactttattttcatgatgctgctgaggaatcagttctttctacagaggttcaagagaaagtccttttaagaagtgtgcaaatctcgtatatttattagattggtgcaaaagtaattgcagtttttgaatacaaaagctttatctactctgttgactttttcatcattcataacgtttaacttttttttccccgagactttttgctccccttgcccaagctggagtgcaatggtgcaatctcagctcaccgcaacctccgcctcccaggttcaagcgattctcctgcctcagcctcccgagtagctgagattacaggcacacgccaccatgcccagctaattttgtatttttagtagagatggggtttcaccatgttggtcagcctggtctcaaactcccaacctcaggtgatccgcccgcctcagcctcccaaagtgctgg

SEQ ID NO: 157632 - DNA, 473 bp, Homo sapiens
aaatgctttaccctctgccccaatgcttgtcctctagacattcccagagcaggttccttcatgccatgcagatttcagccaaaacgcacctccttaagaagccatctttgaccactcagtctcatttacctccccttcccctacagtcactgccacatcaccttgctttattttccgttcatttatttcttgtttcctgtgtgtcgcctgcctccttcactagagtcaaattccacggaggcagagacggggtcggtgtggctcacaggggtatctgccgaaccccaaacagcgctggacacacagaaggcgctgggagaaggaagaggcctctctgaacctgttccctcacctggaaagtggggctaatcacataaccctgcagtctctgaggtggttgtgagggggattcagagaggggacccggggagctctgagcgcagtgccaggcccggacgtggtcaccgccttgt

SEQ ID NO: 157633 - DNA, 653 bp, Homo sapiens
aataatgtatttgaaaatgttttataagctataaaacactacagaaacacaagagtatctttctttcaaattcatatcataaacttttttagaacaggaaggtttgttaagaatattcaagagaatgtaaacaacagatgtatgtgcatgtttataccaataagagaagtgggcagaatttctttctcccacaccaagggaatttcctgattattctttgggcttgggtttaatgaatattatatactttgtacgtaccagtgacgttttataacttcgagatgcctttgattaattaacaagtgaagtgaataaagtgaaacggggaaggccctctgggctatttaattgctgaaggatagagagcacacatagagcttgtgtttctcatgtgttgttctcatagatggatccagcgatttttgtacatgggaaatagaatggtaatgggaggtttgggggtaaagattctataaaggtatgtgataaaatggaaagaatgtgatttggagccagaagacccaaatgtggtcctgattatgccattcactggctgagttatttgggacaagccataaccctatgagaatcagattcctcctctgtaaaatggggtttttgtaaaaaaatcagacttctcctctgtaaaatgt

SEQ ID NO: 157634 - DNA, 344 bp, Homo sapiens
acatggccgatcagagattgaattacttcacataagaattagggctgcagcaagtctcgagtggaaggattcagaaagtcagtatgaaaccataaaagtaaatgcccccaaactcagtatttcggtacctctcacaaccatgagggcaaccactgctagataacaactttctcatttccttccttctcttcccagctttcaacacaaccctggagcattcagacacaacacagagataagaggaattgagaaatttgtgaaaatggaaaagaaactgatcatctgatcatgtgtccaatctctactacaggttttgagcttgaattaggctcatattgtcaaaa

SEQ ID NO: 157635 - DNA, 662 bp, Homo sapiens
agccaaggccagtccctcagttgaatccctccagagtcattttgcaggacaaggactgtagaaaggcataatagaacacccataatgttgatactagaatctcttctgtattggggttatctaagaaggaatctggtcacattgattctccctccatcaaaatgaggatttcaagagaattctcttaattaatgaacagtcacctggagcactcttttcatatgcaggttccggatcccacctgagattctaacctagtagactggtgatgaactcaggaatctgtctggttaaacagttctttgagcagtgctgataacctgccagatttgggaaccactactgtatggaccagttttcttcaattccctgccctcacaaaaactaaggagatgatggctaggattaacagttggccttgataaggttggagctgttttctccaacttccctacaaaagacagagaactttcactttgtgatccttaaagtagattcctttaaagtagaaaatattttacatgtaacccaaatataagatgagaattactttaaaatgagacagagtagtaaaattccattaataaagtctgtggccttttaaatgttgcatatgcttttcagtctgacataagtatccctcttttgactcaacttccttt

SEQ ID NO: 157636 - DNA, 403 bp, Homo sapiens
aaaattctatgggcttttctttgatactaccgttttcaacccgtgtgcacacatgcttcccagatagtctaccgtcctctctttctttgtgttcatgacgatgtgaacactggcatctgtttagtggcagtcctggctgtccttcaagctagcacagcactgttgaacaaaactttgccagcattacacctcctttccagaatcaccattcatccagtgatggctgccttctaacatccagttcctctgttcccccaaatcctttagtctgagtaccatgggttgatattgacaaatgccttccctcactctggtgcaagctactgccatctgttgccagccaaagctttttaagtggcttcctggccacccaccatgctaccctctcatccactgcctacat

SEQ ID NO: 157637 - DNA, 577 bp, Homo sapiens
gtttgaggctgcaggcagctatgatggcaccatcgcactccagcctgggtgacaagaccccatctcttttttttaaagaagtgatttttccctattctgatggtgctaaatcaattacttatttaattctaatgatcttatataaaatgttgacctgaaatagtcagctgtcccagcaaagcatcatctggggtaaaaaaaaaaaaaaaccatgtagatcagctttctgtcaagtacaacttccactgctataattatgcaatcatcaaccatcactgcaagacaacaaaaaccccaaagctgatgttactgaaattgctaaatacaataattactagggtctcaaaatcatgaccaccaattcctttaggaaagcaacagaaatctttgtaattataagggaaaaaggctgattagttatcccagatggtggtctctacagcagaaggtttttggtcactggccagaatggcagcatacacagaaatctttctcatattgctgttttctcacactcatactatgaaagcacaatatcaacaaaagaacttgaaagaaagaaagaaagaaagaaaga

SEQ ID NO: 157638 - DNA, 633 bp, Homo sapiens
aaaaggtaagacaattagaggaccagcctgagaggaccagcatccaaataagatgagagctaaaaaacgatcctgcagcaacaacaccacaaacaaaatgagaagacaagaaagtatattaaaaaaaaacaaacaggaacaattcccaaatggaagaagtttacttaatttccaggccaaaggatgaaaatagaaaaaagaaggtgtatcattaagaaagaatacaacactaaggaaaaagatcttaaaagcttctagagattcaacaggggagctctgatgcacaagatgagaatctgaaaggtatcagtcttaataacaatactctaaaggaaaagacaagtcttaaacatttggaaatacagataagaacctgaaaagagaattaatgcaaactaactttcattcctgaccacatttcctgtcaacaatcacaaaacagttttagaaatactaccagaaaagatttagacaaatcaagaaacaataagacaaacctagactgaattctggctcaacgtctcactagctctaatcaatcacttgcatctttgaatctcagtgtcaccatttttaataagaggctaataatatctaactcatagaattattccaagaattaaatgtgataac

SEQ ID NO: 157639 - DNA, 533 bp, Homo sapiens
caggtgttaacaagtaggttacattccgaacccctttccctttccctccagctctcggcctcctctgacctcaccagtatttattaacttttaactctgcattcttatccctccctgccaaacactcccaggaaaacctgaaacaacaaaagttctttttccaagttgctgcttcccttcagcgcccacacacataaatcaaggaggacagagtacagcaagaacagcacaggagtatatccggcagacacgcagaagaaacccgaggagaaacacctgcctcccatcgctgcccctgccaatcacagttaaccacaagaacacttcggctgtagtcagctaaggagaatcacataagctcagaaagcaatacaaaggggagctgacttctctgttgcaccttcaccctacttagggacactaagggttcctgcctggagaatgaaaacaactccttagatctaatcgttttatttgttagtttaggacattcctccagaatacattaaagtggctttcttcaaatacacctg

SEQ ID NO: 157640 - DNA, 714 bp, Homo sapiens
  misc_feature (293)..(293): n is a, c, g, or t
ctcagaatggcgggcacaggtttggtggctggagaggttgtggtgtgatgcgctgccgtattttgatcaaggttatgaagcctctggtgtgcaggaagcagctgcagtgctggtggagaagtaaactcgcagataccaacctactatgaactacctgagatacctgacagtcctggattattcctgccgtaatggaacactaggacattacatgacgacaactgcaattctgacacagaacttggtgtcttgggctatctgaaacaaaaccaaaaatctgaacacttatggcntacgagggggagttgcaaacagcgatatgaacttccagccccttcctctggtcaaaaaaatggcattactgcatggcaagaatgtgtaaacaattctatggcctagttagagcatcaagcagttacaactgagaatctgaaactaatgtcacagcatggatgtaatgcctggaaagtatacaatgaaaatctagttcatatgattgaacatgcacagaaagaacttcagaagttaagaaaacatattcaagatttaaactggcagagaaagaacatgcaactcacagctggatctaaattgagagaaatggagtcaaattggatatctgtagtaagaattatgagactgaacggactatttttcaactagaaaatgaaatctatcaaattaaacagcaacatggaaaggcaaacaaagaaa

SEQ ID NO: 157641 - DNA, 327 bp, Homo sapiens
cagtattatagaggtgaaaaataggagttgacaggggttagtgatggcagtggtgggaggtaggaatgtgtgtgattatgaaggaatagcatgagagtgttctttgtggcgatggaatagttttttcatcttgactggggtggtagttacatgaatctgcatgtgataaaatgatatggagctatccatgcacattttaccaaagtgaaatgcttggtcttgatatagtactgtagctaagtaagatataatcactgagggaaactggtgaagagtacctgggatctcaccatactacctttgtaatttcctgtatatttatatttc

SEQ ID NO: 157642 - DNA, 455 bp, Homo sapiens
cagcagcctgctccttcctttactcgctcatttattcaacataatacagcatcactatggctgaatataaaatgagcacttactttatgcttatttttatttatttgtttatttaattatttatttttgagacagaggcttgctctgttgcccaggctgcagtgcaatggcacaatctcggctcactgcaacctctgcctcccgtggtcaagcaattctcttgcctccgcctcccaagtagctggtattacaggtgtgtgtcaccacgcccagctaattttttgtatttttagtagagatggggtttcaccacgttggccagcctgttctcaaactcgacctcaggtgatcaacctgccttggcctcccaaagtgctggcctcccaaaatacgggcgtgagtcaccgtattttttttttttttggagacagattctcactctgttgcccaggctg

SEQ ID NO: 157643 - DNA, 191 bp, Homo sapiens
tggtagtaatatagaggatccaggttttattttttgtagatatggtgtcttgtatgtagcccaggttggtgtcaagtccttgtgatcaacctgccttggcctcccaaagtgctggcctcccaaaatacgggcgtgagtcaccgtattttttttttttttggagacagattctcactctgttgcccaggctg

SEQ ID NO: 157644 - DNA, 218 bp, Homo sapiens
tggggaggggatccttgtggaaaagggaggaagaaagggatgtggggagccctgtggaggagggcggaggagagcagagaacccggaagagggaggaggtcagagtcgaagcagatgtgaacagaggaagaagaaaaggggtcaggagagaacaaaggaaaagcttgaaacagaggtttttctggagcaaggactggggcaggcagcccaggtagggg

SEQ ID NO: 157645 - DNA, 332 bp, Homo sapiens
acatgtcttctcagcagaatctactctgacagcccacataccctgccgcctgcttcctggctccctccttggagtgactggtgtgtacaagacagacagagcttcattcagcacatcccattccattctgtggtccagtgcttgccagctcccatgggaccttagagtggctgattgctcttccctcctccctacaaatttacattcctgccttcccccccttcaactggaatcttaaatagtaaagctattcattgatctgcgagcttggaaataatagattagaagggaagaaacattaacacaaagcagaagtatcctgaatgcatcat

SEQ ID NO: 157646 - DNA, 189 bp, Homo sapiens
ccataatcctatgttctcgttgtcaaattgttaagcaaaggattacaggcatacaggaggcatggagagtatctgcgggactcacaaaaaagaataagttaactgtcatactattgattgtacactaggtgacaagtaaggaaatttgcaaaggaagaggaaagaaaacataggcagagggcataaagt

SEQ ID NO: 157647 - DNA, 410 bp, Homo sapiens
atcattcttaagatgatataagctacatttgaagaataccacaacagtggttttaaacatttttgaattgactagtcagaaatgggcatagtttttatatgcagttccaattaacaagtgaaaaaaattacgtcttgcaagtaacatattgaaagctgagtaaattttagagcatggttaagtagtaaataaatttatagaattatctaaatgtttcttgagggagaaaaagccagccgatcaagacattcggataattttttatattgtacagaccttagtaaagtcttcaatttaataaaaatcaaaaagccaaaactaaaaggtcaaggaaaccttgccattctctgtaatctaataaaatgggaggaaaacttttctcaattaggaaattacttctagcagttgaa

SEQ ID NO: 157648 - DNA, 493 bp, Homo sapiens
tctgtcagatctcagttccagaaaatagctgtccttcttctgaattactggttcatctgtaccttactcatgcccccaatcttatttctatctttgcactagctttgcagaagctcagaggcaactatgtagttcatgtctagcaggaggacttggattcgatttgttgatcccttggtttcacatgccataatttccttgcttctctacttttctcacttattttgttgtgagcattattgtaagcagccttaaatcctgttggaacaaggctgggtgtaaattaaaaaacaaatcaagcatccattcctctgagaggttatataatcactgagaataggcttccacatcaggacaggtttcatgtcttagccttgggactacatgttttctctttcccttctggacactactgacctctcattgtcatgttggacttgattctatcagttgtgctcatgctttcccttgaatctagataacctgtaacttc

SEQ ID NO: 157649 - DNA, 524 bp, Homo sapiens
ggattacaggcgtgagccaccgtgcccggccaggttggattttataagtagttgggccactaaaatttctgagttgtacagtttcatgtctttagttggcagaccaaagctgatccactcataaaattttatttagtgctctcctttgacgtgagacacgtggtatatttattggcaccgtaatactggctacattatttgacctcatatttcagtttgtgttgcaaggttttgggcattagagctaatgtataggaagccctgtgcttacatatgctgagtatgagtaagtagtgggttaccaactgtttttgatgaaatatctgcatttcaccaaattgccatataccagtctcaaaatatcctgaaccttctgaaataccttcctaagtgagctcactaacacctacttttctgtgtcctttgcggagaaggctgatttggactgagaaagccctgtgtgcactggccctagcaacccaccgttaggcagctagggagggacccacctagggcctagctcc

SEQ ID NO: 157650 - DNA, 650 bp, Homo sapiens
cattttcacacaaagaatcattcacacaggttactggttatattactttcgctttatgtaattaaaatatttaaaagctgtgaaatcaacatgcatctgaagctttactgggttacacatattgttaggtgcactattttgcaacatacaagggtccaacacgaagccacggtcacaagtgacacccgaacacccacaagagccctctgctcctcccacacaagttgacgagctccagtttcaggacgcctgtgcctgagtctctgtgaaggccgcatgtaggtgtgtgtattctccaggaaaagagtccactggttctcacggattcccaaagaagtatgtatctcaaaaagctgtagaaccatttctactctggtctgatgagttgaacaaatacgccttcatttctcatttaatatcaagcactatattatcttcaaaacacagatcaacctggattgaaactgagattgggccagatgaaattaagtgtcacaactgtaaaaatgttgggtatgtcatgcttcctcaggctttggaggcccaactttttttttttattttattttttcgtttttgagacggagtctcgctaccttccaggctggagtgcagtggtgtgatcgcggctcactgcaagctccgcctcc

SEQ ID NO: 157651 - DNA, 496 bp, Homo sapiens
tggggaccgctcctgttgggccccagcaaggcgccctgagacccctgctccatccctgccgctccccacccgcctgctcctagcctctgttctagctctgcccgcggcggccacagcctccccgagccgccggccgggccctctgctgccctctggcggcccgagcgcgcggtgccgagctccgcgcctgaggccctgaaaccccgcgtccgcccggcggtcgcctcccgggaacaagagcccggctggggaccggagcggaagggggctggggctggggctgtgctctgaggactgcaatatacggtccgcgcaagcactcagcaaacgctgctgcgcttactgggttacttactagattcctattctctggggaaactgagaaccaaagaaaataagtgtacgcgcgcgggaggtgcaggaatgggggtccttgcccgaagtcgcagagggacaggggcaccgccgggaccagaaccccgacgcccctgcggcc

SEQ ID NO: 157652 - DNA, 240 bp, Homo sapiens
ctcaggggcccaggacgtggctggtccccatcttcaggggtattcatgggacaggctggagacgccgggtgctaagagatactgggctgactgtgaaggaggctgggaccaggccccctgggtcctcccaggacaccctgcatgggcgggccagacttagcccgggtacgccctgctcaggtctacagtcaaacgcccatcctggtctttccccatctccctccttatggcccccacccc

SEQ ID NO: 157653 - DNA, 416 bp, Homo sapiens
attacaggtgtgtgccaccaggtccagtcttgggaccacattttgaaaactgctttacacattagtttttctaaaatgctaatctaatgaaccacaaacagggctgagaaatcaaagttctgacaactattctcccaccactgcatccagtgaaaaagctgggctctagagtcagactgctacctgtacctcagttttctcaactgtaaactgcaaagaataataattgattctacctcttgggtttgttgtgattaggtaaaacatgttaagtgctgagaatggtgactagcacatgttcaaaagctccataaacattatttaatataacaatttatgctcatggcagctaaacatagtatgattttatctttgttatctcctgtcacctattctttcgtcgacgcggccgcgaa

SEQ ID NO: 157654 - DNA, 360 bp, Homo sapiens
attgttattagcatccctgtttaactgaggcccaggggtaacttgcccaaggtctccagcttttctgtacgagctgggaatcgaagccatgcatttggctttagagcaccatgctcttgagcacatacttgcctgtctctggggaatgtgagcgggctcctggccgggcctctgcccactcctggctgctggtagcacccccacccatcatgaccacagatggaactagctcttctgttggtttgatcagtggcaccagtaccctctggctactccagctgagagtcctggattcattttcatcaactctctaactctgtcaactggtctcttggttactttggaggcctgctaagggtg

SEQ ID NO: 157655 - DNA, 108 bp, Homo sapiens
ggcaaatgcatcttattgttttagggcaaaaaacttaagctttcttctattaaagtgatttaataagcactttgtaagtgtgtaatgaggatgatttgggttttatta

SEQ ID NO: 157656 - DNA, 176 bp, Homo sapiens
  misc_feature (24)..(24): n is a, c, g, or t
  misc_feature (48)..(48): n is a, c, g, or t
  misc_feature (55)..(55): n is a, c, g, or t
cgttcacaaacatcagcaactcantatctgatgtatggggtggggganagggtangaagtcaatattgctggtacaaggctgggacaagagtgaattagggagaaaagaaagaataacattccagaaagaatagcacgaacatcaaggaactcaatatactgatgtattggggtgg

SEQ ID NO: 157657 - DNA, 957 bp, Homo sapiens
gtataaaaagagtattgagctggaacaaggcactaaggacctcataagagaagaaaagctaaatgattgctcagcccaaaggaccctcgattgagtagtcattgtctgccaaagaaagcattaatggcagggtgtaagtattctggagatacgctgacattcactttttcatcaagacgctggtacaataagtcttttagaaatcgattgcctcttaaaaaattatcatcagatgaagttgcacagttggacacatttcaaagtgcaacaatacaattcttacttgatgtatatgtgctatttcatctcaaacccttgtttcattaaattaaagagcatggctgaccggctggggcacagtggagaaattgattagttcagccttcagatcttccttatattcaaagactttcattaagcaagtgtgtttcagagttgaattttgcttttgtaactccgcactctttgatttttaattcatcatagatttcataatgttaagttatcgtgtacattagatctgttctcagatttgtgtttggaaagagattgtgattttcagggccttttattaataatgtaattgggcctttaaaaatgcagattttactatgatttacaaagttggtagcctactttatgttgggtttgtgcctttgtttttgtgtgtttctcagtggctagtgccttattcaggcacttgtaacttcttgatagtaaatgggctagaagatctgtggctaacatctatcgtcatttaagtgaattatgcaaataaacttggcctaggcggtttaatctttttttttttttttaatttactctgaagggcacttttttttggataacagatattatggaagagtaagaggagactgagctttttcttaaacccataaactcaaaggatttaataacctcattgactcttttacaagggaacaccacctcagtgtg

SEQ ID NO: 157658 - DNA, 363 bp, Homo sapiens
acaacgaatccactcccgacacaaaagcatattccatccacaggggcaaagcctcaggcctaatctcagaaaggccccaacacggttacaagagcaactcagcttccagcacgtgaactccggggcactagcagactccgcgctcagaacattggcacttctcatttgaactctatcttcacacaccctgcgtgaactgggaagcgccctcagcaaatagactcatgtggctacactaagcttgttcactttgcctcccgccttgcaagggttttgcccttccagtttctgtcagcttctgggtgatctctagtgccttcaaactgttgttttaatatctaatacagaagctatcatcgttat

SEQ ID NO: 157659 - DNA, 472 bp, Homo sapiens
tcttagcatctttaaattgctacataatatttttatagtatgtatgtttctacaatttatgtaacctaactctttgttgtcagagttgtttctaaatgtttgctattacacaaaaaatagtggtgctggcacttggcgtgtctttggaccattctgagtgacaccccaggatgtacttctaggagaggcgacttgctgagtcggaggcgcacactttaatgtgcactgtcaaggcttgctggggtcccagggctcacgcatccctttctctcgctgagggccagtccacccacatcagccgtcagtcccggtgccagcccggagcgggagggggcccaagcccgcagcacccggcgccttttgtgtggcccgagccctggagaggctgagggcgcggcgggcatgtagcctgcggatggccctggcccgcacctgccagaagtgtgtcgcgtcggcctggtgcggggcggcc

SEQ ID NO: 157660 - DNA, 335 bp, Homo sapiens
accatgtaattcagggaagctttagaaagaaaacctaggggatctgttggccatatcaaaaaagtacaagctacatggacagtgaggtgatactgtaatacttccacctgtaggtcaactggagagacttggttttttccaaatagacctagcttaattgtgatgacgcatgccaacctaattaacctcctaatgttacttgtctttgtttttgtattgtcaggaacttggtgtgtgggttgggaatattagaacataatagaactatgtgatgtctaaattgagctttaacacaaactggttggtgttattgagggaaagtataacttattagt

SEQ ID NO: 157661 - DNA, 528 bp, Homo sapiens
taaattttactttctaagatgagtaatacagatactcaagttaaccaggatgttagtctgtgggtcagtgatcaggtatctccaagtcaagacattcctcagccgcccctgtggttgtcctgtgaggtggttggtggtgagggtgggcctggggggagacaactgcaacaggaggacctctggattacatacccaagttccctctcaggaatgtggatgctaaaagtgaagtgctgataacaaatctcactggtatgaagtagattttacaagctgcttcagtctcaggctatatctcaatttatggggcggcgtcattgctgaaagttctgtgtaggtcttttaccatagtattgaattttacattcattataatgctttttattatgagctctaattccaagttagttatttttaattcagaaagaaagtaaatatttgctttctggaggtaactgcacttgagtatctgcaaggagagcccctcaagttctgtttttggggatcctccccttttgaaaacactaa

SEQ ID NO: 157662 - DNA, 270 bp, Homo sapiens
acaaaccactataccagtattggttcattaattttaacaaccgtaccatactaattaagatattaataatgggggaactgggtgtggagtatattatataggaactctctgtaaatccaaaatgtttttctataaatccaaaacgttctaacacaaatttcttaacttatgtaatttgaggcattaattaaataattcattcactcattcattccctactctgtgtcaaggtgccataatagtgaaaggaaatacaagattcctgttgtc

SEQ ID NO: 157663 - DNA, 502 bp, Homo sapiens
taagatattctgatacagtgtgtgtagaagcactacattaatttgttctttttttttcattgcctttggagattatacaccacattaatttcaatggtgacataggatttcatagtatggaggtagaataattcatctgatcacttatctgatagaatgagttctttagagggcttggtgagagtgagacctgggctaatgtccaggtttagagtcaggacacctgtgacattatttttttcttttttcttttctctcgcaattttgcccaggctgattctgaactcctgggctcaaggcatccttcctctcagcctccagagtagctgggattacaggcacgcatcaccgcgctgggcaaaaaatccgtgtaactgtaatggaagggcttgagagcagttgcggttcagggctggccttcttccgcagatctgcagtcttaccacggggcggcgctggtgagcaagcctgcgctgggacggctcctgcaggaaaggcgagg

SEQ ID NO: 157664 - DNA, 584 bp, Homo sapiens
aggaatgagacttcatggccaaggatgctgggagatggggaggatacagggagggagaccggtcctgggggcatcttgggggtccccagggctgctcccaggaagaggggccagccggacagaaggggaccgagcctctgtcccaaaagtccctcctttgtctgtcgctactctaacctaagcagagcggaaagcagccacaacagcggctccaatgattaacttcctactgtataccaggattcagttcccactgtataccaagctccagcttggtcctctacaaacagaataaaaacagctggtatttcctctagagagtcttaggtcaccccaggacatcccgcatgtcccaggagacccggctgacactgttctgagtctcacagatgagggcctgaggggtccctgacctttctgtgggtgaagggacctgcccataatcacctagccagtgagaggtgtagcctggggcccaatccaggccatctaccctcggagcctggctcagccccgccaccctttgggaatctgggtcaaaacatggcgcttccctctgattccacagctccacactgagaaca

SEQ ID NO: 157665 - DNA, 351 bp, Homo sapiens
tttctgggagtaagacagcaaatggagctgagctgcagtatccctccttaccagtggatggcaatgccactcacagtttgacctatttgtgctacgtggtcaagaaacgctaatgtttacgctttcattgcctttgatctgaggctacatcaggagctataaaatgaactcgtcccctgaaagctcagcaagtttgaaattcaataatttcaaatgtcagacaaaagccaccaccataccctgacaaggccagcctagggatttggattgtgctgacttggcatttgtggaataacagctggtcttgtttactgagcagcctcatggtgccagacactgtgctgggccctt

SEQ ID NO: 157666 - DNA, 331 bp, Homo sapiens
gaaaattgtaggttaaatgtttgaaatgggtacatgatatagatgttgaccaatccttcacatcacattgagtggtctgaacattttggttacagtaattttgtcttttattatttgttgttaatctgtaagtacttacttcagttttgccaactcattattatttctaaataaactattttggaagcaatgaaccaaaataagtgcatatgtttattgaaaacttaagtaccaaatctccatttcttaagaaagttgatgataaatgtataaattgcctaaaatatgtgtctacatttgccatctatcatgggagtcagagagatatcac

SEQ ID NO: 157667 - DNA, 369 bp, Homo sapiens
gcactgtttctttctgactggcttcacgtgtgttgccactacaggaagagaccaagtcactggtaaaaagctagggtaaccaggagaaatggccccttcagatgacactgtgagagtcaacaaggtaagaaagaggaagctttaaaatcaccaccatcatcatttttgaaatgtggaaagttagttatgcatggtgcttgcccttgggtaccttaaaattgaaaacatataagcaaaacaccatatatggcctggcacagtgactcatgcctataaatcccagcactttggaaggtggaggtgggtggatggcttgagcccaggagtttcagatcagcttgtgcaatatggtgaaagcctgtatctgcc

SEQ ID NO: 157668 - DNA, 656 bp, Homo sapiens
atcttagtcctgtaaatgaaaagcatgttaagttttagcaatatttgacacgttaaaacttaccaaattcccgatatgcctcaaaaaacatctttttagggttattcgttctaagagatttgaacacaaagtagcaatttgattataccaaggaattactgttaatttgcttagatgtgatacagccctgtggtttaacaatgtccattttaagagatgcagataagtttctgagatttgctttaaaatacttaagcatatacacacccaacactggagcacccagattcataaaacaagttattctcggcttacaagaagacttagccacacaataatagtgggggacctcaggctgggtgcggtggctcatgcctgtaataccagtagtttgggaggccgaggcaggtggatcaagaggtcaggagttcgagaccagcctggccaacataatgaaacctagtctctactaaaaatacaaaaattagccaggcatggtggtgggcacctgtaatcccagctactgaagaggctgaggcaggaaaatcgcttgaacctgggaggtggaggttgcagtgagccaagatcatgccattgcactccagcctgggtaacaagcgcaaaactccatctcaaaaaaaaaaaaaaaaaaaaat

SEQ ID NO: 157669 - DNA, 490 bp, Homo sapiens
tcgactctaggtaggatcccccaagcagttatacgactcaggggattggttccaggaatcccaccaatggcaaaatccacacatacccaagtctcaaagtccactctgcagagcccgcttataggagaagctgggcctctacacacatgggtttcacatcctgcaatattttctgtctgcaattggttgaaaaaaaatcctgagtcgaagtggaccctcgaagttcagatggtattgttcaagggtcagctgtgtattctttctgtcagggttttctgtaagttgggaatgctgaaaatttctacaactgtctaggtctaactgtctgcaggtgacaaatgtatttctgaaaattagatagtaaattaaacctgatcgtgatttaaaggctctgctgagctcatatgtaaagcaaaagtggttctcagtttaatttcaccaatctgtgaaaattttcttttttttttttggagtctgtatctctgtcacc

SEQ ID NO: 157670 - DNA, 316 bp, Homo sapiens
atgttggttgctggttcacagcacattgctgtagcacaggagttggcatgcttttttctgtaaaggaccagataataaatattccaagctttaaagaccacacatgattgatatctgtcatgtattcttttttgttgttactgttacaacccttaaaaagtgtaaaaaaaaaattcttaaaatctgtccaaaaataggatttagggcatatttgccctcagactataatttgctaatctctgctatagggcgacatcctaactttgcaaagcattccttccctgctgggaaacaaaagacacatacacacaaatgt

SEQ ID NO: 157671 - DNA, 391 bp, Homo sapiens
tgcctgcatctatgtggaacccctgtgtcagggctttcagagctggtgaatgcgcttgaccatcctcagtggctgcaaatatctctcctggaaaacaacagtgaacaaatgcaggggcttctgccaagacctcatgttccgtaaaaatccttcaattagaggatatgaggatagtgcactgattatactatgatactatgagcacacaggaaatgagctggctttaaaaacaatttgagaaaagcttatcacagcctcaagaactcttcttaaggccgggcgtggtggctcacacctgtaatcccaaagtgctgggattacaggcatgagccactgagcccggcctagaataatgttttttaaatgcataaaataaaatacataggaattg

SEQ ID NO: 157672 - DNA, 169 bp, Homo sapiens
taatagcggcattgtttctctttcccaaagcaaccataactgagacaggattagatgcaaaaaccacttgctgatacagtttagaattgcaaaattctaaattccaacagattcatattatacacaagtataaacagagtgtagccagttttcctcaaagagataacat

SEQ ID NO: 157673 - DNA, 176 bp, Homo sapiens
gcatgtgtgtgtgtctgtggttgtgtttctgtgtgtatgtgtctatggatgtgtgtttcagtgtgtggtatctgtgtgtgtgtgtgtctatgggtgtatctgtgtgtgtctgtgtgtggtatctgtgtgtctctgtgtttgtgtgtctatgggtgtatctgtgtatatatacctgt

SEQ ID NO: 157674 - DNA, 612 bp, Homo sapiens
tagcaactttttctcatgacttttttggcaacacactgctataaataaacatctctcactgcttaaacactagaaccgagttataatttaatcactgatattccagaggttaaaagtaggtttcataaagtatgttctacttcacagaaccagaaatcgaacacagtgaacaaccagttcaccaccctccgcaaatctatggaaatatttccattacaaagtaaatttctcctgccacgcaagttttaaactgtcactctgcgctgttagcctaaacaaaacataattggtaaggtacatctgccacatacagaagtcaataatccattccaaacccaaaatatttctggattatcttgctcctgaaaattgacactggtagaaaattagtgatccagaaataggcaacttccactaaaaggcaagtaaaattaggtaagtaaaatacaagactgacataattttataataaagggcaaaattttaaaggctcaaatgtcttagtgaatacaaaattaaaggaggaccgaaagagaagttaaaaattcagctttttacaaaagaaaaagcaccttccactccacctctagccctaaaaaagtctttcccctt

SEQ ID NO: 157675 - DNA, 421 bp, Homo sapiens
gatggggacatgggggttcatcctgatattttcaacactgttttatatgtttgaaaaaatttaagtacttgggaagtgaaagtgctcagagataccagaatcaaagtgggatgagattaactttgtttgggtgttgctgggaagactgcatggaggaggtgggaactggtataagatgggaagaaacggtattcccctaggcaaggaggccactgcttcctgagagtcagcgccatctgaagaggaagggagatgaagctgggtgccgaggaggaggaaaggttagaaagtggcctgagcagctctataaaacgattcacttcatttcttttgttttgttttgttttaagacagagtcttgctctgtggcccaggctggactgcaatggtgcgatctcagctcactgcaacttccagcctc

SEQ ID NO: 157676 - DNA, 401 bp, Homo sapiens
aaatgcaaaggacccagagtagccaaaacaatttagaagaagaagaataaagttggaggacttcaaaacttactacaaagcaacagtaatcaagagactatggtactagagtaagaacagagattagatcaatgaaacagaatagaaaggccagaaataaacccttctggttacggctaactgattttcagcaaaagtgtcaaggaaattcaatgagaaaagatggtcttttcaacaaatagtactagtaacattggatatggatatgtacatgcaaaacagttgaccctcacctcacaccatatacaaaaattaattcaaaatggatcacagacttaaatataagagctaaaactatgcaacttctagaagaaaacatgagaaaaattttaagatcttgg

SEQ ID NO: 157677 - DNA, 460 bp, Homo sapiens
gatcccacaggtccttaagtctctgctaaaggtcccatcccagcaaagccctcttctcctattccttaccagtactccttgtttttcgcctacatagcacctactgtgactttaaacaaataatgtatttattggcatacatgttgactgtccgtctcttcaacaagaccagaagccccaggaggggaaatgtttatgcttcggtgtctgcacagtacctagcacgtagccataaataactatcaggtgcatggataagccaccaatcaaaccgaccatcaggagcctgggcctcaagcctaggagggcaaggccctgccacatttcacgagcattcctgaatgtacagctattcccgtattggctagagctataaagttcttaaacatttcagcaattgggaacggtgggcagtattcagaagcatcacaaggctccctagatgtcagcaaacgagtac

SEQ ID NO: 157678 - DNA, 387 bp, Homo sapiens
ggacatgttttaatccgtaccactcaatgacttctggttgaagacaataagatataaaaaatatagttaaagatacccctgggaaaaattcgaggtgaatggccaggcacagtggctcacgcctataatcttagcactttggcaggctgaggcaggcggattgcgtgagctcaggggtttgacaccagcctgggcaacaaggtgaaatcccgtctctactaaaatacaaaaaattagctggatgtggcaacagcgtgtacctgtagtcccagctactaggtaggctgaggcaggagaattgcttgaactcaggaggcagaggctgcagtgagctgagatcgcaccactgcactccaacctgggcaagggagcaaaactccgtctccc

SEQ ID NO: 157679 - DNA, 568 bp, Homo sapiens
tgatgctgcggtttgatctagaggatcccgcgccactcttgtaccttaagtgatccacctgcctcggcctcccaaagtgctgggattacaggcatgagccaccgtgtctggcccagggtctcttaagagattgcaatcatttgaaaactttgagttaacttgtacgcagcaatagataacttacacatgtggtcgtagcctcatcactggggttagaggatccacatgagaaagagctcattcacacagctgttggcaaaaggcctcagctcctggcaacatggaagctgcctttccctggaacaagtgatcagagaaagagagagagcacactgatcggcactgtatctatataacctagtcttggaagcgatacatcaacacttctctcatattctattggccactgtattagccatgtctttgattttctttattctgatgctttgacatctggagccttgctgaccccactggagggaccacctcttccaagagttcttagggatagagaacaactcacctgagagtgtgcttttcaaatgcaaaccaaccagtccagagcgcg

SEQ ID NO: 157680 - DNA, 604 bp, Homo sapiens
ctttggcatctgacccccagacggtccccagtaggtgctgacgaatgtcccgcctgtcttcagacacactcgtaccgggcacaaagagagacccaggcatcagagatgttctcccagtggatacagagctctcagtagcacctgctgatcacacgagcaggtgtgcaccaccttacctgcttggctgacatctatgccttcccactctactacattcagaaatttccagtacatacaggtactggaaaggtcgagctgagccctgcctcagccccttcctaacgatgggagcttggactccagtctgagcctcatctttcccgtatggaaaatggcaacaacgataatcatcaaccttatgcggttgtggtgagggtgaaatggacatgatgagactagcagagctcctggcacacagtaggagctcaaaacacgccagtcctggcacacagtagaagctcagtaaacactagttctcttcccctttgcaacccaacgtggagactcagctcagcttctgagacttggccccacagcacaaagcaagaggaccagtagctgacagaggaaaggaggggagtggccctctctgggaccaggaaag

SEQ ID NO: 157681 - DNA, 623 bp, Homo sapiens
cttggtgcgtcggccgcagctccacgcctgtgtccctccctgtgtctggcgctgcgctcttcagctgtgcccaggaggagaggcccggggcggggtggggctgctgcaggtgtcggtcccaacccaggacaggactgagtgcgcacaggcaccagggcccgggagtcccaggcgtgtgccctacgtgcacggacgtcacagcacacgtgggtctcacacaggcacacacagataacgtacacggatgccacagcacacacagcctcacacagacatcacagcacgtgggtctcatgggcacatgcagataacacacacggacgtcacagcactcacatgggcttcatgggcacacagataacacacggatgtcacagtacacagcctcacacagaaatcagagcacacatgtgggcctcacacagacatcatggcacacacagacatcacacaccgatgttcacagtacacatactggcctgcacggatgtcatagatgccacagcacacatgtgggcctcacagacatcacagtatacatgacctcacgggcgcacacagaaatcacacatggacatcacagcacagacgtggacctcacgggcacacacagataacacaga

SEQ ID NO: 157682 - DNA, 548 bp, Homo sapiens
cttggtgcgtcggccgcagctccacgcctgtgtccctccctgtgtctggcgctgcgctcttcagctgtgcccaggaggagaggcccggggcggggtggggctgctgcaggtgtcggtcccaacccaggacaggactgagtgcgcacaggcaccagggcccgggagtcccaggcgtgtgccctacgtgcacggacgtcacagcacacgtgggtctcacacaggcacacacagataacgtacacggatgccacagcacacacagcctcacacagacatcacagcacgtgggtctcatgggcacatgcagataacacacacggacgtcacagcactcacatgggcttcatgggcacacagataacacacggatgtcacagtacacagcctcacacagaaatcagagcacacatgtgggcctcacacaggcacacacagataacgtacacggatgcacactgcaacacagagtaaccacatgctcacagagcgcggacactctggggcaatgatgatggaggggacccgagttcgaatacgcactcggggtc

SEQ ID NO: 157683 - DNA, 475 bp, Homo sapiens
aaatcctcctgtggctggagagctatcctgagtcatttttatttttacaacagcctactatttgaagaaagatcgtaaaagagtatacctctaaaatctctccatataccccacagccctgtctatgtaaatcctggatatgaaaagaaaatggttaaaagattacagaagataaaaaatcataataataaaggttaacaatagctgctttcacccctaatttctgatatggcgatagaccctcttagaacattaattagaatggaaagagagatgaaagaaatgcccaggagacataataaattagcctcttatgcaaattactcattcattttcatcactgacccagctagttgagtctctaaattacaggaagtggttagctcctttaacaaaaaactctgaatgaaagattatctttaaaaaaaatctgagggcttaacgcaacaaataatttctcacttttccttacaga

SEQ ID NO: 157684 - DNA, 499 bp, Homo sapiens
caagcacactgcaggcaccctcaggtgctggtcaggcagaaggcagtgcctgaacccatctgaaccttgctggcacgctttagagaacttaaggggcagaggattctaggcttgggggacactgccttcacctgtttatgcacaagcttccacagaggtctctgtgagaaaacaaagtgtgaaaactcatgcaggcaatagagcacgcaattgagaggcaaacagttgagtttcaaatccctgtggcaccctatcaccgatgtgacaatactgatcaccttccattcttcctgcctggttgtgcagatacgtggacagcacaggggaaaggtaagtggtggcagtgacagtgactagtgttggctgcagtgcagggactggaacaggtggaatgtagggtctcagccctcatttccatttctccctcctgtgtctctcacagccaaaggcaagtggatacaaatgagcaaaaatgatggcctttgattgcaacaggacc

SEQ ID NO: 157685 - DNA, 711 bp, Homo sapiens
ctcctgcttgtagtcccagcaaccctggagactgaggtaggaggataccttaagcccaggagttggaggctgcagtgagctatgatggtgccaccacactccagcctaggcaacagggcaataccctgtctctctcaaaaataaatttaaaaaataaaacgttttgaatttgcgttttcttcaacgtctttcccaaagcccaacttcttttattctaatggttgcttttaagattcattttgaggacaaatcaggctctctcaaataagatgcagtactaatcaaaatatattgacagcagaatatacctttttctgtccatattatgctgtaatggatatttaaattggtcctaggaattcttacaatctggttggaaattttgatttgagttttctttggatgtcactggaaggattaatgagtttctcagaatctttatggtgattgcttcacggtcttgacatatttccaacaacctggagcagaaatgtgagggcaaaggctgccatatactgttaagcaatgttcagaggaccttaatactgctccatatgttacaatatattttctatcttgagcttaacattgtaatacaacttgaaatcttgtgattctatctcgaaattaacatttaatacataatatgtcttgacattcttgtaattctatctagaaattaacattgtagtacatgtaatacatcttggc

SEQ ID NO: 157686 - DNA, 639 bp, Homo sapiens
cctcagcgcaggaagaccttcagactcccagcacggtggccaggaaacactctgcaagcaaaattgccacaatcactcagccttcaacagctaccaccctgataagtcagcagccagcatcgtggaagcaggaccctctaccagcaaaaagattatgactcactgcaggctcggaggattgttactgtcttttttttttttttttttagcaatgaagaaacctctaatgtcacgaaatacaccaatgggtccactctctgctagatggaatctacttaaaatgcaccacatggagcaaaaatctgccgttctaaagcaacgctttatgtagttcctggcttggacacatatgaccaggtggaaatgaccagcaaaaatatatggttaagttagagttggggaagcactgtttttttttcctaactgtagtttttaatatcttttttcctgttttatgaaaagacaatgacgttatcaaaaagtaaatgcaaaaaacatgggagaggagcagaaaagatatctattgggtacagagcttaatacctgggtgatgaaataatatgtacaacaaacccccatgacacacgtttacctccgtaacaaaccttcatgtgtacccccaaacctaaaataaaaatt

SEQ ID NO: 157687 - DNA, 516 bp, Homo sapiens
tttgggcaggcctactgggtgagcctctgtgtcataattcggcatgcattttctttgagctaagctccctggacctacaggccacacaaagcgttgccaaaaatcccaaaaccaaagccacacaattttatgtcctgtgatcacctcgatgtcaaggggccaagttcaacttcctcactgtaccaggttatctctagtgagcagtaggtggtgtggtgtgagctggaggcagggtccctgggggggagtctgggatgggagtggcaggactggtgggcaatgtgtgcccctcccccacagtctgccctggtgcccctggccactagagcattagcttgggtgatggggcatcctcacctagcaagccaagtgttttgaccaaaaatgggtgttttaagcacccaaagctattcatagcctcctgctggaaaactgcaaatcagggaggcaaattagcaaactggcctgccaagccaggaggtgtgttgacgtcacatgcacggtggcagaagtgcc

SEQ ID NO: 157688 - DNA, 474 bp, Homo sapiens
gtcgctctagaggaccccctcggtctacctgtctggtcaagtgattttgatgctggtgatccttggaccagacttggtgaagctcaatgcttagctaggaaagccccaaaaatttgctttattggattgtgtaatttgactacatccattgtttcttttttcaaatgtagagttatatgccacaaaaatattttccgtagcagtaggcatcctaattaatctcgatgtttgtttatagccccattgatggggctataaacttggcagcaaattgttttcccactaatttggcattttccataaaaaacacgtatctgttgttagctgcctagacgttagctggacatggtttaggttacttttctcttaaaaagtaaattttaattcaagttcctttaagccagcagtctcaacctggggcagtttttccctccaggggacattcagcagtgtctagagacatttttggttgtc

SEQ ID NO: 157689 - DNA, 671 bp, Homo sapiens
atccctccgacgtggctacatatactactctactagtacttctccagaagcatttaaatatgctagaaaatttctcccattaacaaaacatacgagccaggcatggtggctcatgcctgtaatctcagcactttgggaggccaaggaaggaggatcacttgaggccaggagttcgagaccagcctgggcaacatagtgagacaaacccttacaaaatatacaaaaattagctaggcgtggtggtgcatgcctgtagaggctgaggtgggaggatcgcttcaaccagggagttagaagtaacagtaagctgtgattgtgctgctgtgttccagcctgggtgacagagcaagacccagtctcaaatcaatcaatcaatcaatcaatcaatcaatgtagtgagaccctgtctcaaaacacacacatacacgcgcgcgcgcacacacacacacacaagagaacatttaacatgatacaggtatttgtaagtgccacactgagaggagaccctcttcgttcagtggaatgactgattttcagtctccttcctctgaacattttttgccagctcttccttccctaacctccctcacttttctgcttgaatatttttcatcccatccctgtactgtaaaagtccctttacagaatcatggatccctagcacatgtcag

SEQ ID NO: 157690 - DNA, 629 bp, Homo sapiens
tgatcactcctattttttagaagagtagagaccctcctaaaatcaatcttaaaatagcaacagcagcaaatgaactctagtgcttcccagaatttaatgtgcatgccgcacctggggaatcttaaaatgcagattctgattcatcaggtctggggtgaggtctgagtttctgcatgtttagcaaccgctgagtgatgctgaggctgccggcataagcaccgctctcagccactcaaggaactggtgcatccaaaagccctgaactaatccggcttcacgaggggaagatgcaactataataagggtggccgtggtgatgttgttactaggaggagtggttattgagcagttactctgcaccagatactccatgccactgtggtacaacagaaggaaaatctatccagccttgcaggattttcctaatctctctccaagagtcaacagggaaggaggaaactgaatataagaggattaacattttctttgcaatatgtctcactgccccatttgatagacgaagtaactgaggctggaagagctttggtagcttgccgaggtcccataactcacaagcagcagggccaggattccagctgaggtgtgctctggctttcaagaccatggta

SEQ ID NO: 157691 - DNA, 772 bp, Homo sapiens
gtgagtatgtaaagcagtaaaaatcatccaagagatgtgttcttgtcaatgagtgggagaagaggaaataggtaagagtttcgctgctttcttaagaagtttggcttaaagaggagggaagaggttgaaactggaggggagagattccaaagaacatgcttagaactgatcaaaatgcttcagtcaggaggatgaaggtatggaagggagagaacaaaatccatgaaccaagtccctaatgacagcccagattcagagtgtgaagtggcttcacttgctcacagaaggaagggcagggcacagaatcaggtgagcctgtggggttgtagtggaaaggtaggtgggggtgttgtgtgatgtggccgcagttggtctgtaaggaagaggtggaatcatctgcggagagtgagatggggacattgatgattatggcctccagattatttctttacgaaaaggtagagtatctgaaactggcttcaaattatccaatgtagtgagagttgagcagagtttagaggaaagattggctgtaagttgatgcgtgttgaagctgactaatgtatacataagctttctgctgttctatttttgtttgattgaaattgtctgtgataaaaatattttgaaaataaaagaacgtagggagtctttgaaatggctgcagtggtgaactgagagagacctaaccgaaaggacataaaggccagctggcagcagggaggacttgacggaattggggctcatggatttttagtgggccctgtgtatg

SEQ ID NO: 157692 - DNA, 314 bp, Homo sapiens
atgtttgaagaatcaaataaagaaaaatatattattttattagtgttagaatatcaaaatcttaggcttttatagtttagcacttgattttttaattgtatttttttcattgttttgttaaatattattttgtagactgtcaagtccttgtggacaaaattttgtcttaaactttttgtatttcttaagagtactgaagaattcattttaattaacaggataaaatatggtcttgtattcttaaaaagaaacaattttttctatatttactttgcctcatcttatggatcatgatacagactaaacacaggaaa

SEQ ID NO: 157693 - DNA, 346 bp, Homo sapiens
agggtgcggctcctgacaggctgagctgggtgggaaccttgagggacgtcccctcagacacccagacccaggaagcagccgtatctggaggcgcaggagaggctggaacacgggggccccagcagtcctgtccacccggcatgccatggcaaagtgcagcgtccactatggagagcatcctagggcaggcggaggggtggaaatatggtcaaagagaagaattcttggccttgaaaggactcttagccggctacggagatgagacgggcactcacgtacaccgcagcccaggccctggccaccacgcacagggcactgcaggcatcgtgcttgctcccagggcccc

SEQ ID NO: 157694 - DNA, 162 bp, Homo sapiens
  misc_feature (31)..(31): n is a, c, g, or t
  misc_feature (36)..(36): n is a, c, g, or t
  misc_feature (44)..(44): n is a, c, g, or t
atgtgcgcggtgattctagaggatccgcggncggcnctgagtgnctgggactacaggatagcagtgagattcacttcaaagtgaaaatgacaacacatctcaagaaactcaaagaatcatactgtcaaagacagggtgttccaatgaattcactcaggagcg

SEQ ID NO: 157695 - DNA, 328 bp, Homo sapiens
acagatgaaagctagaaacagcactcaaagcaactcgctgttgaagtttgcagaaatgaatgctttactggcacttggggaataaggaatggcatcttggaggaccagtgagtttacccggtctttggaagagaggtaaaatgtgatgggtggatacactgagtgtgggagacaggggtcttagtgagtctgtatgtttgtttaatgttcccattttggttccaacaatcaagcttgtccatctacagcgtctaaataaagttagacttggctagagcatattctaaagacctggttagctgcttttaaccaatgcaattagatcacc

SEQ ID NO: 157696 - DNA, 1112 bp, Homo sapiens
aggtgctgctggcagacggcgtgaaggtgaacagacatggggttttatgatatgcaaaatcactcatgaacaactaaactggaaaccagggaggagagcataatgagcttcccttcttagcttagatttctaggagaatcctcaggcataacaacaggaacacagccagtgcagctgccccacgtggatgatcagaggcgacgtcttactctccacaaagccaagtttggtcaagctcctcacagctgtttcccacagagaggaaatcccctaagttcccaggcagtgtaaactgaccgtgtgtttataaaatacacgccatgccccaagaacatgaaaacagtccagatgcatgaacctgcaatgcagcagtgattcaagacacttgggagtagggaggagagcgtgagtgagagaacgcttcaatgccgaagcagagtggctgttctctggagaacacccaaactgatctaaagccaaagttcaaaaaataacaaacatgcaagccttttgaaaacaaattgtgcctagatatctttgcaagctgagtggtcagccctcagacagtgctatgagggagtgattgcagaccacccagcacccaaggaattaggggcagttcatgctgtccctgtgtccaagggctccgagagctcagattaaaattctttctgctggaaccaaaagagcccacttgtgagaaggcaggggattgaggagggtcccctcctcccagtacggactgtgtggtgccttcagatgagctgttttgtttcacgctgagctgagctcacctaggcgatgaccttgtgacaagaataccaggctgagtccagatcagcaaagaggggacaggaagaggaagaggaagagagaagcaagtgcagccatgcgaagctgtgactgacagaagccaagtcagaactgctggttaacataatttttaatccttcatcagggctggtaaaatgttgacaaaggagagtccttgtagtgaatctctcagtctattaagaaagctgtttcagacccagggacataaggcaggtgtattggagtcatcagactctctacaaaatattagtcatcagctctgcaaaaaccccgtgggc

SEQ ID NO: 157697 - DNA, 400 bp, Homo sapiens
caggaacataactagaacccaagttctctatttcttatagcacgtactttccattacaccaagaggtctatcttgctttgtatttatggaaacccaggcacatccacttgtcagagcttggcacagacaagtggcacattgccttttcttattaatgtgaagaatgagccaaatggcttccttagcctatgtatccttagctatgtatagcctatctatccagatctaaaacaggcataaaatactataacttttgtagctctaaagagcttaggaaaacattttgtgtagtatacacacagacacacacacatacatatattcaatgctatatatgaattagagttttgaaatatttcaatgaatttgtcatagatcattgtttcatagaaaaataaat

SEQ ID NO: 157698 - DNA, 491 bp, Homo sapiens
ggcacgtgccaccatgcccagctagtttttgtatttttagtgaagacggggtttcaccatgttggtcaggctggtctcaaactcctgacctcatgatccacccgcctcagcctcccaaagttctgggattacaggcatgagccaccacgccctgctgcctttgagcattctacagtgagtggagataggcctggaccccagaaactgagctttcaagcatgatggctaaatgcaaaagcaagaatgaagagaggtattatcagctccaaggaaaagcatttaattccaaaggaaggaggcaggagtcataaggtagaaagaagcattaaggatagcttcacacaggtagacagtatttgtatgagccttgaaaaatgagtaaatatccactgggggaagttatggagtatatttgagaagctgaacaaagacatggagtagagaagtgtatggcctgttccagattgacaagtactgcagtataaccaaag

SEQ ID NO: 157699 - DNA, 488 bp, Homo sapiens
atccactccttagcaagtgcatcatgggggacctggaatggggtctgtgttcaggggagagggaaatgctgttcttgagatgatttgacagcatatccctcttaattatgtgctacctggaagaggtgtaaagggtagcaaggtggttttgtaagatcagaattgggtgcaactgcttgattcattcattcagtacatttgatggaacacctgcatgccagccattctgtaggagctggaccaaggaagagcttgtggtccaagccacagaccgggagggaagaggaagcctgcctggatgagggtggtctaagccgagattcctcaggtggctctgctgcatccccacgccgcagctgaagggatctttctgttggcagatggcccatgtttttccagtgggacaatgcccactgcttcctgcattttgctctgatggccggagctgtatttagttgtgtcctgcctcagtccctcccaagctgtcc

SEQ ID NO: 157700 - DNA, 210 bp, Homo sapiens
ggctttccttaacttgtggtagttgtttgaaatgaagacagtttagtgggaactgtgtccttcacctgtgaaacttcacctaaatctaggtggtcactgtcagaatgtcactgcacccatctacctgttcccaagagtggttttaaagtaggggtcaggaaggactaggacagttgctcaagttgggagggggaacgacgacgacgacga

SEQ ID NO: 157701 - DNA, 309 bp, Homo sapiens
ttcatgctggtgaatcattcaaggttgatgcagatatttatggcaaaccaataccaaccattcagtggataaaaggtgatcaggagctttcaaacacagctcgattagaaataaagagcaccgactttgccaccagtctcagtgtaaaagatgcagtacgtgtcgacagtggaaattacatactgaagtgggggtttccaagctagtgtgcatttttctgctgtaactcctgagataacaacaggtccttcaggtggccctggtctgtcaagaaccttgacattcacagtaactgatctttctcctgca

SEQ ID NO: 157702 - DNA, 329 bp, Homo sapiens
ttcatgctggtgaatcattcaaggttgatgcagatatttatggcaaaccaataccaaccattcagtggataaaaggtgatcaggagctttcaaacacagctcgattagaaataaagagcaccgactttgccaccagtctcagtgtaaaagatgcagtacgtgtcgacagtggaaattacatactgaaggccaaaaatgttgcaggagaaagatcagttactgtgaatgtcaaggttcttgacagaccagggccacctgaaggacctgttgttatctcaggagttacagcagaaaaatgcacactagcttggaaacccccacttcaggat

SEQ ID NO: 157703 - DNA, 396 bp, Homo sapiens
tttatgaggatatgaggaagggtctcgagtcacttcttccacagatacctaattgtcccaacaccatgtgttagactctccttttcccaactgaaatgtcttggcatctttgttgaaaaatcagatggcctcgaatacaaggatttattctagactccgacctgctggtctccatgcccttccttgcaccactgtcacactttatttttgagatggagtcttgctcttgtggcccaggctggagcgcagtggcacaatctcagctcactgcaacctccacctcctggttcaagcgattctcctgcctcagcctcccgattagctgggattacaggcatgcaccaccacacccggctaaattttgtatttttagtagagacaggatttcagcatgtt

SEQ ID NO: 157704 - DNA, 449 bp, Homo sapiens
tagcttacctgccaggatcggtggcagccaacgattggggttgtacactcagtaaataaaaatactttaccgctttcaaggagcgccaattagctgattgctccatgtggctgtctttaaggagaatgctgttttacctatcttcttgcacaaaggtttgttttttaatgtcttgtgaaaaggattctctttgtcttgattgatgtcaggaataaaagcatgatggtaatatccctttgaaagctattgtattgtcagccctcgctgacagcgggacggcctcccagcgttatagattggtgctgtgaaaacactgacattttctttgttacgttgctgttgttctacttgcaaagtcaattacacaatgtcggagctcagttaccaagttgactttggaggtaacaatgtctttcattctctttttaaagatataatttccctttaaa

SEQ ID NO: 157705 - DNA, 154 bp, Homo sapiens
agggcacgctccacaggcatctaagggtgaaaggtactgccagtctgttgggtttgttatttccatagagctacacaggaaataacaccaccaaaaataacacattcaaactcagagggcaatcttccctaactattcataggcacacgtcagg

SEQ ID NO: 157706 - DNA, 360 bp, Homo sapiens
ggaggagactgacatgtaaataaacactgtagggagataggagcaataatttaagtatatacaaagtctttgatgccatagtggagggagtgattattcagaatggggaacggaagctggtcagggacggtctcggtcttgtcacaagtggcattcaccaggtggacggtagatataggatcaggaaaggggaggcatccctagcaaagtgaactgaatatgcagggtttagaagtgtggaacatatgttagaggaactagggaaaaaaattcagaatggttggaggatgaaatgctattctgagtggaatgcaagaggagtgatggtagtggtaagatgtaacattggagaggtaggta

SEQ ID NO: 157707 - DNA, 218 bp, Homo sapiens
agccggacccctcataatgtgtgcccatacttttttcatttgttgccttgaatttacttagagaagagtagtacatttaaattaaagagttcatacagtttgctcaagattttttaaattatgcctctaatgttagtctgtcactcagggtatttctatattgttactgtttaaatttatggactaaaacgaaagaggctagcctctaagaaagaaga

SEQ ID NO: 157708 - DNA, 211 bp, Homo sapiens
ctctgaaatatttattcattcttggaggtgagcattgctccagtgggcagaattaagaaccttgcttctgcttggaaggcagatcttcccgtactttcgccaagtgtttttcttgcttgactgagtagcctgctttcttacatgtccgtctttacatgtggccgctcactaacttggttgtacagttttctttttgcccatgaacctctta

SEQ ID NO: 157709 - DNA, 463 bp, Homo sapiens
taagacactcagtccagtgcccagcatagaggaagcatgtggtatgtgctggctggcatgattccggccaggtttctgggagacctgttgtcagacccaaaatagaatagaccctgttctattttgcagggcttcagtttcttttctgggcaggggttggatagcagactggagatctctaaggaatcagcagtttgaaaacctcaaaggccaaaagctcaggagcttctgggagatataagactttatctgccgggcatgatggctcacgactgtaatcccagcactttgggaggctgagacaggcagatcatgaggtcaggagatcgagaccatctggctaacacggtgaaaccccgtctccactaaaaatacaaaaaaaaattagctgggcatgatggcgggcacttgtagtcccagctacttgggaggctgaggcgggagaatggcgtgaacccgggag

SEQ ID NO: 157710 - DNA, 209 bp, Homo sapiens
cttctgagcgctggattctaacctctgaattatccatacatttcaataagatgtagctcatgtttgcagctgagtggttttttcagtctgtttcctgcccatagaagccctggagccaagttctctttgaattgcatcctctcctaaccctgtaatcctaaactgatagtttacaccagaacagtttttctgaaactgggagtttgcta

SEQ ID NO: 157711 - DNA, 230 bp, Homo sapiens
cttagtcttctggaggatatggaaaacagacaacccaaacaaccaacaaaagagcaagatgctgcaaaaaaaaaaaaaaaaaaaaaaaaaaaaatttgttgttttcgcccaagtggcggttttagacccaaaaacttgtttttggggggaacgggttgcaaataacaggggctaaaaatctttactctttttaaaaaagggggggccccggcctcgaattcgaaataagg

SEQ ID NO: 157712 - DNA, 1237 bp, Homo sapiens
taagaaaaagtaactcaccaagtttgtatttgtactgttaacggatcaaatacaggttaagcaccctgcgtcccctcatcataacatcaactgtgcatttgtgagggttagtcttctcccattctcctcctcaggaaactctgtctgcatagttaccaccaccacgtgcacattctcagcctcagttcttgcttttcttttctaaaataatacaagctttattttactgattgcaaaaatgatccctgctcattgtaaaacattcaaaagttaccacaaatataaagtgagtcacattaattcccaccacccagagatgaccactattaacattttggtgactctttcaagattctgataagggcagaaaaatacaaatatacacacaaaaaacttaaaattttacgtatgattttgggggctccatacacttacaaaacttgtttgagggcccccttgggaccatgctgatcaacaaactgcttttttcacctcacagtttgtcctatacaccttccatttcaataaatgtgtgtccacaacagcaggtctaatggcttcacagtcttcttctatctaaatgtcccagtggacatttgcatattctcaccttatgctgttataaatagtgtggctgtcagcattcttgtgcacatacctttgccacttttgggattacaaaatcaaagaatatgcacatttacagtttttacacacactgtcttactgccctccagaatggccaatcctttgttcactaaggaatcccccttcaattcctggtcagcacccgatcttccaagcctcagttgctattcttcttggactcattttcctcctcgttaactgtgaggacctagttttctacctgttaagagtcaggatttgtactggatacctactgtcctagctgctgcagacccttgaggtgtagggtaaggttgtattttggtctgaaacctgaaagaataattcactttctccccagggacccttctacagttgtagccattgattaagaactaagttcagtttaccagctcttccggaaagaagagaaattaaagtcctaattggaatatgaggcaaagtggttaggaacatggactgttgttgctagggttaagtgggaacatatgtgcacatgcacacatacacacatttcttagttttgcacaagggacaacatgttgtaagtatagtacctccaacactcatagaaaatatctgcctgaag

SEQ ID NO: 157713 - DNA, 967 bp, Homo sapiens
gctcgtggtctaaggcttgcatcaatctaagatgaactgtgacctagtcttcaatgtcttctgcttgtatggcaatgtggagaaggtgaaattcctgaaaagcaagccgggggcgccatggtggagatggctgatggctacgctgtggaccgggtcattacccacctcaacaacaacttcatgtttgggcagaagctgaatgtctgtgtctccaagcagccagccatcatgcccggtcagtcatacgggttggaagatgggtcttgcagttacaaagacttcagtgaatcccggaacaatcggttctccaccccagagcaggcagccaagaaccgcatccagcaccccagcaacgtgctgcacttcttcaacgccccgctggaggcgaccgaggagaacttctttgagatctatgatgagctgggagtgaagcggccatcttctgtgaaagtattctcaggcgaaagcgagcgcagctcctctggactgctggaatgggaatccaagagcgatgccctggagactccgggcttcctgaaccattacctgatgaaaaacccaatggtccatacccttacactctgaagttgtgtttctccaccgctcagcacgccttctaattaggtgcctaggaagagtcccatctgagcaggaaggtatttctctttcctttatgccattttttggtttttgtttttgttatttgcaaaagatcttgtattcctttttttttttttttttttttaatgctaggttcgtagaggcttaaccttaacggaaacgctggaagtctgcagggggagggagaggggaactgatatctcccaagattaaccttcactttaaaaaaattattgtacatgtgatttttttttcctgttcatacatttgtgctgcccatctactcctggcacatttcaataaaattgtttggaaaataaacacagcacttgctgggaaaaaagaa

SEQ ID NO: 157714 - DNA, 979 bp, Homo sapiens
gctcgtggtctaaggcttgcatcaatctaagatgaactgtgacctagtcttcaatgtcttctgcttgtatggcaatgtggagaaggtgaaattcctgaaaagcaagccgggggcgccatggtggagatggctgatggctacgctgtggaccgggtcattacccacctcaacaacaacttcatgtttgggcagaagctgaatgtctgtgtctccaagcagccagccatcatgcccggtcagtcatacgggttggaagatgggtcttgcagttacaaagacttcagtgaatcccggaacaatcggttctccaccccagagcaggcagccaagaaccgcatccagcaccccagcaacgtgctgcacttcttcaacgccccgctggaggcgaccgaggagaacttctttgagatctatgatgagctgggagtgaagcggccatcttctgtgaaagtattctcaggcgaaagcgagcgcagctcctctggactgctggaatgggaatccaagagcgatgccctggagactccgggcttcctgaaccattacctgatgaaaaacccaatggtccatacccttacactctgaagttgtgtttctccaccgctcagcacgccttctaattaggtgcctaggaagagtcccatctgagcaggaaggtgccggtgtgtgatgttccccttcctgtgtccaagtgttctcattgttccattcccacctatgagtgagaacatgtggtgtttggtttttgtccttgagaaagtttgcgaagaatgatggtttccagcttcatccatgtccctacaaaggacatgaactcatcattttttatggctgcatagtattccatgatgtatatgtgccacattttcttaatccagtctatcattgatggatatttgcgtggtttcaagtctttactattgtgaatagtgccacaataaacatatgtgtgcatgtgtctttatagcagcatgattta

SEQ ID NO: 157715 - DNA, 198 bp, Homo sapiens
cattgtcctgcctttggactaaaaatttccggttgaaactaagtaacagtccttgtttgactggatttgccagcaaatacatgtagtcacaggccccaaaacatgctttctgataatctggaggaaaataaggactagaaatgtaactggcaatgctgggagcaatggtaggcacttctagtccaaaggcaggacctg

SEQ ID NO: 157716 - DNA, 381 bp, Homo sapiens
  misc_feature (1)..(1): n is a, c, g, or t
naggaccccctccatcccgggaggcagaggtggcagtgagatgagattgcgcctttgctctccagcctgggtgacaagagtgaaattgggtcttaaaaaaaataaagaaaatttaaccaatagcgtgagccactgcaggtcgccagtcattgaatttctgtgatgcactaggtctctgtgcggtgaaggtccaaggagatagattttcagcgaatcacctgaagacttctaatggctcagctgtgcaatgtggatcccctgctgaagtagttcggagcacagtgtctagcaagttagctgacagaacgttagaactttcttaccctgggtggaggtggacctgagaacctaccattccctttcatctctccacgggtgcaa

SEQ ID NO: 157717 - DNA, 236 bp, Homo sapiens
aggaagtggaactttcttagtagaaaaaatgcacacgaaccaaaaaaagaaaagaaaaactcagaaggcagtagcttcttggtccatacaatcaatggtcaaattgcagaaaagatagccctagaaaggacaggcttttctcggaaaagagatgatggagagagagggcataagtgtcagcaccagaaaggtgaatctttaggtcatattccactggctggagaagtgtgtcctcg

SEQ ID NO: 157718 - DNA, 302 bp, Homo sapiens
caggggagagccactgcaccgggccccctaggattttatgtagttagttcttagccttgattctttacttccagttagcacctcttcacttttcttcctctcgccttcagtttttcctgtttcttccctgaagctagtactactctttaggcagaaaaagtagtttagtaggtaggaacatataaaatcacctctcttcagatttgggactttcggttatattctcagaatttttgggaattaaggggtaggattaagagctgaatcctgtagctcagtctagggcaatttctactatagaa

SEQ ID NO: 157719 - DNA, 176 bp, Homo sapiens
ctgctttctgtagtctctatctattcccactacttctatctatgcatttgccattccaactaactaaatccgtacctatttcctaagccttgcccatcaccatggtgctggcaatgctgcaccttcccttctcctggaacatcctccaccttcccattcacctcattaaatcatac

SEQ ID NO: 157720 - DNA, 452 bp, Homo sapiens
gattagagaggtagtgagatccattccagttggctggtaacagctaataggtttgagttccacagacagagtaagaatcattgagtgctagcctggagtcataagataattatctgatggctgaaggtgaccaaagaataaacatttcgatgattgagaaaggattttttggaggtggtctgtgtgtggttgggttgggtgagagaaattaggctgagaggggaagtggggacatttccattcgtatgagagatgtccaggaacctgtagtggcttggaggcattatgttacatttaatgatggctggagaagtgtaatgacaaatgcttgttcccagaaaagaattgatgatggtaaaattatgatgggagtggacatgacccttgcaaggatagactggagcatattcagaggtttttctcacaatgggtatttgtctggtttaaaatgg

SEQ ID NO: 157721 - DNA, 255 bp, Homo sapiens
acatcttccccttcacaggtacccaagagccaggtaatgagcagttaaggtaagaacattaagaaatagtagttgtttatagcatggattaaggcaatgctgttgtaaactttttttcccccaaagctgatttatcaatcaattgccacgagtttgctgcacaaaactgcagccattatcatggttggctctgcagccacaacaaaattactgaaagccttttaccaggaaaggttgtcaggagggagaagagtg

SEQ ID NO: 157722 - DNA, 150 bp, Homo sapiens
tcacttgtgaccctcaatgttggaggaggggcctggtgggaggtgaccggattatggggcggagttccccatggcgtggctgctctcaggatagtgagatctgactgggccatgggtgtggagttcctcccggggctgctctcaggatag

SEQ ID NO: 157723 - DNA, 317 bp, Homo sapiens
ttcggcactgagggagatgaacaaaataccagatagaacaagttccctgagggcaggaatttttgtggccttcagcaccttggtgaatgctgacacatagtagttatttaaatgattgtagaataaatgaagacacagtttgagaccagcctgagcaacatagtgagaggcatgcacgctgggagcagtggtagtatgtgcctataatcccagctaggtgggaggattgcctgagcccaggagtttgaggctgcagtgagatatgaccataccattgtgtactccagcctgggcaacagcatgaggccttgtctcta

SEQ ID NO: 157724 - DNA, 369 bp, Homo sapiens
agaggtcaaaaaatatgcaagttgcaggattttccctaggtccccttactttacttctagtgctcttccaccaaaccacaattacttctgtgttgtgtatatataaatataaaagaggcttatttcaaaacaccagtggtaaaaaaagaagttacagagcttttcttagaaaatcatgagattatctgttattacaataacttaagtttcctctttataatgtctgaaacagaaataagcatgaaacagggtgaaatacactgaactatttttcttttctttttttttttttttttttgagacggagtctcacactgttacccaggctggagggcagtggcccaattttggctgcctgcaagctccgcc

SEQ ID NO: 157725 - DNA, 365 bp, Homo sapiens
gggcagtgccagggagcgctgatgctctggaaggaaagagaagatgggctggatgttggtcttgttgccagagacactgaatggaaagactgtgtaggagtcagtatgtttggagctcagatatctgggtttcggatgtaccttagggagccagcagcttagccatggtcatttatccccagggctggcttggagagagaaacagcctagggctgggtctggaagacttcaacatttacaaagatgggtggtggaaggaggggccagcaaaccagaccaagatgatgaggcagagaagtaggaaggtaactatgtgggtgtgatgccacctaggggacaaaaggagtgtttgcaggaggaaggaa

SEQ ID NO: 157726 - DNA, 643 bp, Homo sapiens
ccatcatcttgtctgctctggtgagctacctctcttccctatcctaccaaatttgctttaaagatcgaatacaaccatgtatgtaacaatacaagttactttcaactaggcaatttctatttaaggtatttttctcctccctatttattttcacttacattttgttttcttgcacacaaaaaaaccaaagatgactaaaaagacccaaaggaagagagtagaaaataacaattatgaagtgtggtgatgatttaaaatactaaaaataaagaagaggatatcatcatgccatctatctatgtgtacctttctgtgatttgtctttggcttcagtcagaagaatcataaaattatttatagtttgtctgttagaatttgtggttgggagggaattatctatgactttttataatttatatctcaattaatttaaaaaatggtagagtccctattaatgtgtcccttgaaagaaaagttgtctagatcatatgctctcctactaaaattatctttttcacaaaggacatatacgtacatgagaaataagatccttttaggaaatattagaataagattttcaattagaaagttgcatctgcataggcctcctggacagtaggaggaataactggactggaataat

SEQ ID NO: 157727 - DNA, 568 bp, Homo sapiens
tctggctgcttcaggctgttatgccctccccagcaagtcaccctgttctgctcatgcccaccctggcccctttccctgcctccaggccaaagagcagagtcagatcccagcatagccaagggaaccaattacaagtgaaaccatcaaggaaaagacacatacttcagagaacaaggactgtgccaacatacaccagcaaaaaccagggagaatggtgagaacggatttggagtgtccccgaccctgggggaagagcatcaacccaggccagggcaatgtactgctgcaggtgcgccccccatgctggagtccaagagccggcaggtgagctgttggttccctgacctcagcttgatagtggctccacaaagtgaaactgaaaagccaaaatcccttgaaggaatccagacatctgaagggatacagtgttggtggagaccgatcaagagcaacctgtacaacatccctaaccatgtctccaggggagccaaaaggacctgccccagccggaagcaccaagaaacatttaggaaggagaacaccaacagcttggaatattgccacagac

SEQ ID NO: 157728 - DNA, 387 bp, Homo sapiens
cccctcagacaccaagttaaagaaggaagggctttattaggccgggagctttggcaagactcacatctccaacaaccaagctccccaagtgagcaattcctgtcccttttaaggggtcacaactctaagggggtctgcatgagagggtcatgatcaattgaacaagcagggggtacatgactgggggctgcatgcactggtaattagaacagaacagaacaagacagggatcttcacagtgcttttcttatacaaataaccaattaggtcaggggtcgatctttaactaccaggcccaggttttggtgccaggctgtctgcttgtggatttcatttctgccttttagtttttacttcttctttctttggaagcagaaattgggcata

SEQ ID NO: 157729 - DNA, 262 bp, Homo sapiens
tgctctccccttctcttcactacaaagcaaaacaaataaataaataaatttccccaagaacctcaattttcatatcctttgctcttctattatcttgtttaatcctcactgccctgacaggtggacattatgcattatgatcatcatcactctcatttcatacatgaagaaactaaatccagagcagctaacagatttgctccaggccaggtgtggtagttcacgcctgtaatcctagcactttaggaggccaaggtaggct

SEQ ID NO: 157730 - DNA, 228 bp, Homo sapiens
aagcagtcaaatgtcaactcatcggttcttttcaaggctttcaactctcaaatgttattaaagtcattctttgtgatacattttaagtaacatataattgtaagagatgttttgtttgcttttcagagattttggattagcttattttacccccaacctggcacagcttgagaatttagaaaatatcttgacaaaaacctttcatatatttgaggcctttcctgtttt

SEQ ID NO: 157731 - DNA, 357 bp, Homo sapiens
tacctacttgcaagtgtgtgaatgtgtctgtgtgtgtatgtgtgcacatgtgttcttttgaaagacattcctctttttcatatgaaaatttcttttatttatttctttattttctgagatagggtctcactctgtcacccaggctggagtgcaacagagtgatcatgactcactgcagcctcaaactccagggctcaggtgattctcccaactcagcctcctgagtagctgggactacaggtgcatgccctcacacctagctaatttttgaaaatttttttgtagttatgggggtcttgttatgttgcccaggctagtcttaaactcctgggctcaagcaatcgcctgcatcagcct

SEQ ID NO: 157732 - DNA, 203 bp, Homo sapiens
ataggaggatgcatcctgctacttccagggatggtattccttacctctttcctcttccatcactagcttgagtgaaaatccaggaaagaaggctttgagtggtgtattctaagatagaggtagctgattgctgtttcctatcacatagctaggtgtatcttagctgcaagagatgctggaaactctaagcctcaaacatctta

SEQ ID NO: 157733 - DNA, 528 bp, Homo sapiens
tagttcctccactatcctccacgcttctcctctctcaaaaccatctccttccaccactctctcctctcaccattcatgtcttctctgacatatgggactccacaaacagtggacacttttagaaccaggctaacaatcttatcttcctcaccgccctctccttctgtcctcaggaatgtcaaacaccatggcaatgtgcgtccaatgctaaggcctcccgtgatttccatcctgctgcctctacgaatgttcacaaactccactcactgaggctctcaaggggtgtggtgaggcagagtcagcgttttccactagtgtcttttaccctgcttcttgaggcaggagaatcacttaaacccaggaggcagaggttgcagtgagccgacatcatgccactgccctccagcctggacgacaaagtgagactctgtctcaagaaaaaataaaaacaaacaaacaaacaaaaaacactgtttaccaaacttaccctaattcatagttgtctacttatctgtgtgtgtatttgtt

SEQ ID NO: 157734 - DNA, 470 bp, Homo sapiens
tctcctgaatgcagcctgctgagtagttgggagtggagatgcgtcccacatcgcctggttaatttttgtatttttgtggagaggggatctcgccacgttgcccaggcttgaagccagatcaagcaattgggttcttcggatttccgaaatagaccccaatattctgcctttaccccagaggatgcagatgtaccttctctcaggccgatgacctcaggcctccccggtccctggagctctaggaaaggtgagcgcgatctcgcgcccacacccagtgctctgggtcataagcctggatctggaaaaacataagcccataatcaatagagtcaagtgttagctttattggtgattttagtaaatcaaaataaaaacagagataacttttcttaacccatgttttagaccctgtggttagaatatcacatacacatgtaacatccacatcctttcaacatgtgtatcttagg

SEQ ID NO: 157735 - DNA, 139 bp, Homo sapiens
tacacccccgaactcacgaatttcactgacttactccccagtctccctcatgttctcacccccagccctcaggtactcttctgtctctctcagctactctccaaccatctccagatttcacctggagtcagcttcccgc

SEQ ID NO: 157736 - DNA, 186 bp, Homo sapiens
acccaggctggagagctgttactgatgttaggtaaaactgagactttgaagccacaaaaaaggattcctgggcgtcctgtgggaggccaggccgcctgtagcataaccctcccaggctgtgatcatagtgtctgcacctgtcaccgtcttcaaactgtctgacagcttcaaattgtagaaaactga

SEQ ID NO: 157737 - DNA, 420 bp, Homo sapiens
tgtataacgtgtaaggaggggatcagtttcagctttctacatatggctagacagttttcccagcaccatttattaaatagggaatcctttccccattgcttatttttctcaggtttgtcaaagatcagatagttgtagatatacagcgttatttctgagggctctgttctgttccattgatctatatctctgttttggtacccggctaatttttttttgtatttttagtagagacgaggtttcaccgtgttagccaggatggtctcaatctcctgacctcgtgatctgcctgcctcggcctcccaaagtgctggggttacaggcatgagccacagggccaagccttgaaagataacattttcagattatttggactattctgaaaactacgtaagcctgtcatttaaatcatcttttcac

SEQ ID NO: 157738 - DNA, 412 bp, Homo sapiens
atttattgttaacgtttaaattgaaattaaaatagacattctaaagcttttaacgatgcaataactttttttgtaaaaggtcttctctgtctcccaggggtgtggccaccagcagttgagaagtgccattcagatactctcagaggtctcgtctagtcaaacaatttgtgtcttagtaaattcagtcctgccctgcagcagcagccattcccatagacatgagggatgcattggagtgctgcctgagctacctattgtttcttgggatggtgagctagtctctgattcaggtagataatgggatataatgtttattattggaataacttcaataaattctattttctgatcacatactagtaataggtaccaggtatgattttctagaccagaggtttgcaaactacctata

SEQ ID NO: 157739 - DNA, 494 bp, Homo sapiens
gatttttagtgcgtcctttgtctcatctgatgtctttatttataaagcgggtttaattctggacctattatactgttgatttcactgatttaaatactataactttatactgtgttttaatatcccattggccaagtctcacttattccttctatccccactcaaccagaaagacaggatcttgctctgttgcctaggctggagtgcagtggcatgatcacgccaaccaggctgtcacctcagccttctgaattgctgggattacaggcatgagccaccacgcctggccaaaagcaccttatttcatctatattgtacacttcagtttacgatagggtttctccacctttattgttatacctaataaatcaatgcccagtaaatttcttgagatactattctgctgtctaacaacccaatgatttggggtgacatcaactattcactttcacatgtcacatttgctcactaaccagacatatggaaacaccggg

SEQ ID NO: 157740 - DNA, 1745 bp, Homo sapiens
gtcatgatacacatgtgtcctgaggaaatttcaggaggccccagggattagtgctgtggagaaccaaaagcaatttgaaaatgggttacgcttgcaggttagactgctgacctgtttctttttgtggaaggaaatataaagagggctgtaatcgattatgaagcataagcattcttgcaatcctacgataggatgataaaacatctattacatgaaacctttgggctctgggccagggagtgtcatggatctaaaaggttcatagtggtaacagcctgcttcattttatgtcatctccttcaaagtgattagagtgtttctagcttgccgaaactgcacccaaagggagacatttggagccatgttattggtgatttactggtgtggaaaattacctggtgttgtagccaagtagccatttccattctaacccagtcctatagtcctgaactgggctgaataaacatacctaaatatatgtttagaaatgctcctatgtatcagttttcccaggaacaactataatattatagaaatcttaaaattatttcctaataaaaaattataggatacaaaagaaaaaaaagaaatatgaagagggctggatgggcacaggaaaacaatcagatgagaacaacagatgaccgtgtctgcaggcagcacccagaactgatattcccctcaaacgtctaaatatattgttgagaaaattatctctaactgttctagtgggaatgtgggaatggaaaatatgcaacagccatggggccaggccctttgctgagcctgcaggttgggagtttgtgaatctattgaggcatcacaaatcttttctgatagcccctctgtgtctgtcagttccagtgtctcgccctgtcctcaccctcaggtctcctggggcccaggctgcagtgggggacctgctggagcttcactgtgaggccctgagaggctctcccccaatcttgtaccaattttatcatgaggatgtcacccttgggaacagctcggccccctctggaggaggggcctccttcaacctctctttgactgcagaacattctggaaactactcctgtgaggccaacaacggcctgggggcccagtgcagtgaggcagtgccagtctccatctcaggacctgatggctatagaagagacctcatgacagctggagttctctggggactgtttggtgtccttggtttcactggtgttgctttgctgttgtatgccttgttccacaagatatcaggagaaagttctgccactaatgaacccagaggggcttccaggccaaatcctcaagagttcacctattcaagcccaaccccagacatggaggagctgcagccagtgtatgtcaatgtgggctctgtagatgtggatgtggtttattctcaggtctggagcatgcagcagccagaaagctcagcaaacatcaggacacttctggagaacaaggactcccaagtcatctactcttctgtgaagaaatcataacacttggaggaatcagaagggaagatcaacagcaaggatggggcatcattaagacttgctataaaaccttatgaaaatgcttgaggcttatcacctgccacagccagaacgtgcctcaggaggcacctcctgtcatttttgtcctgatgatgtttcttctccaatatcttcttttacctatcaatattcattgaactgctgctacatccagacactgtgcaaataaattatttctgctacctt

SEQ ID NO: 157741 - DNA, 2775 bp, Homo sapiens
gtcatgatacacatgtgtcctgaggaaatttcaggaggccccagggattagtgctgtggagaaccaaaagcaatttgaaaatgggttacgcttgcaggttagactgctgacctgtttctttttgtggaaggaaatataaagagggctgtaatcgattatgaagcataagcattcttgcaatcctacgataggatgataaaacatctattacatgaaacctttgggctctgggccagggagtgtcatggatctaaaaggttcatagtggtaacagcctgcttcattttatgtcatctccttcaaagtgattagagtgtttctagcttgccgaaactgcacccaaagggagacatttggagccatgttattggtgatttactggtgtggaaaattacctggtgttgtagccaagtagccatttccattctaacccagtcctatagtcctgaactgggctgaataaacatacctaaatatatgtttagaaatgctcctatgtatcagttttcccaggaacaactataatattatagaaatcttaaaattatttcctaataaaaaattataggatacaaaagaaaaaaaagaaatatgaagagggctggatgggcacaggaaaacaatcagatgagaacaacagatgaccgtgtctgcaggcagcacccagaactgatattcccctcaaacgtctaaatatattgttgagaaaattatctctaactgttctagtgggaatgtgggaatggaaaatatgcaacagccatggggccaggccctttgctgagcctgcaggttgggagtttgtgaatctattgaggcatcacaaatcttttctgatagcccctctgtgtctgtcagttccagtgtctcgccctgtcctcaccctcaggtctcctggggcccaggctgcagtgggggacctgctggagcttcactgtgaggccctgagaggctctcccccaatcttgtaccaattttatcatgaggatgtcacccttgggaacagctcggccccctctggaggaggggcctccttcaacctctctttgactgcagaacattctggaaactactcctgtgaggccaacaacggcctgggggcccagtgcagtgaggcagtgccagtctccatctcaggtgggtgggtgttacctggatacagagtttgatgtcaatggctgtgtctcaccagcctggagatgtctgctgtgtgtgaagagggggaaggtgatctcagtgtccagtggcttctcttctccccacactaacctgaagagtacagactacacttcaatgatctcttacttgaatttgtatttaacatccctatatagcatttataagaagggcccaagtcttaaacctctggggctgaagcactgctttctttcctcaggacctgatggctatagaagagacctcatgacagctggagttctctggggactgtttggtgtccttggtttcactggtgttgctttgctgttgtatgccttgttccacaagatatcaggagaaagttctgccactaatgaacccagaggggcttccaggccaaatcctcaagagttcacctattcaagcccaaccccagacatggaggagctgcagccagtgtatgtcaatgtgggctctgtagatgtggatgtggtttattctcaggtctggagcatgcagcagccagaaagctcagcaaacatcaggacacttctggagaacaaggactcccaagtcatctactcttctgtgaagaaatcataacacttggaggaatcagaagggaagatcaacagcaaggatggggcatcattaagacttgctataaaaccttatgaaaatgcttgaggcttatcacctgccacagccagaacgtgcctcaggaggcacctcctgtcatttttgtcctgatgatgtttcttctccaatatcttcttttacctatcaatattcattgaactgctgctacatccagacactgtgcaaataaattatttctgctaccttctcttaagcaatcagtgtgtaaagatttgagggaagaatgaataagagatacaaggtctcaccttcatctactgtgaagtgatgagaacaggacttgatagtggtgtattaacttatttatgtgctgctggatacagtttgctaatattttgttgagaatttttgcaaatatgttcattgggaatattggcctgaaattttcttttccactgtgtctctgccagaatgtttgtatcaggctgatgctggcttcatagaatgagttaggcaggagcccttcctccttgattttttggcatagtttcagcaggattggtaccagttattctttctgcatcttgtagaattcagctatgaatccatctggtctagggcttttgtgttggttggtaagttttttattactaattcaacttcagcgcttgatattggtctaggaggggtttctgtctcttcctggttcaatcttgggagattgtgtgtttccaggaatttagccgtttcctccagattttcttctttatgtgcatcgacttgagtgtaaacataacttatatgcactgggaaaccaaaaaatctgtgtgacttgctttattgcagcatttgttttattttggtagtctggaactgaacctgcaatatcaccaaagtatgcatatagttgcaaaaatgtgatttttgacatagtaaatatgagtatttgcaataaactatgatattacttttgtaagtatatagaataaaatgtaaataatctatagatttgatact

SEQ ID NO: 157742 - DNA, 459 bp, Homo sapiens
aaggagccatgatgggtgagaggtgtctagctctgaatgtcctgtttgctggggttgcttcttgccagaggcttttcagcaggaatcttagctgtcactgctttggggactattgtgatccttctctctagagctctttcaacgtcctgtgctgactgccagctccttccagcccatcgaagggggtccagtgagcctgaaatgtgagacccggctctctccacagaggttggatgttcaactccagttctgcttcttcagagaaaaccaggtcctggggtcaggctggagcagctctccggagctccagatttctgccgtgtggagtgaagacacagggtcttactggtgcaaggcagaaacggtgactcacaggatcagaaaacagagcctccaatcccagattcacgtgcagagcaagtatcagtgaggctgagcctggagaaaaaaagataggag

SEQ ID NO: 157743 - DNA, 2586 bp, Homo sapiens
  misc_feature (78)..(78): n is a, c, g, or t
  misc_feature (86)..(86): n is a, c, g, or t
  misc_feature (88)..(88): n is a, c, g, or t
  misc_feature (90)..(92): n is a, c, g, or t
  misc_feature (94)..(94): n is a, c, g, or t
ggtgaccaagagtacatctcttttcaaatagctggattaggtcctcatgctgctgtggtcattgctggtcatctttgntgagtcantnannngncagattcgctgacccttgtggcgccctcttctgtcttcgaaggagacagcatcgttctgaaatgccagggagaacagaactggaaaattcagaagatggcttaccataaggataacaaagagttatctgttttcaaaaaattctcagatttccttatccaaagtgcagttttaagtgacagtggtaactatttctgtagtaccaaaggacaactctttctctgggataaaacttcaaatatagtaaagataaaagtccaagagctctttcaacgtcctgtgctgactgccagctccttccagcccatcgaagggggtccagtgagcctgaaatgtgagacccggctctctccacagaggttggatgttcaactccagttctgcttcttcagagaaaaccaggtcctggggtcaggctggagcagctctccggagctccagatttctgccgtgtggagtgaagacacagggtcttactggtgcaaggcagaaacggtgactcacaggatcagaaaacagagcctccaatcccagattcacgtgcagagaatccccatctctaatgtaagcttggagatccgggcccccgggggacaggtgactgaaggacaaaaactgatcctgctctgctcagtggctgggggtacaggaaatgtcacattctcctggtacagagaggccacaggaaccagtatgggaaagaaaacccagcgttccctgtcagcagagctggagatcccagctgtgaaagagagtgatgccggcaaatattactgtagagctgacaacggccatgtgcctatccagagcaaggtggtgaatatccctgtgagaattccagtgtctcgccctgtcctcaccctcaggtctcctggggcccaggctgcagtgggggacctgctggagcttcactgtgaggccctgagaggctctcccccaatcttgtaccaattttatcatgaggatgtcacccttgggaacagctcggccccctctggaggaggggcctccttcaacctctctttgactgcagaacattctggaaactactcctgtgaggccaacaacggcctgggggcccagtgcagtgaggcagtgccagtctccatctcaggacctgatggctatagaagagacctcatgacagctggagttctctggggactgtttggtgtccttggtttcactggtgttgctttgctgttgtatgccttgttccacaagatatcaggagaaagttctgccactaatgaacccagaggggcttccaggccaaatcctcaagagttcacctattcaagcccaaccccagacatggaggagctgcagccagtgtatgtcaatgtgggctctgtagatgtggatgtggtttattctcaggtctggagcatgcagcagccagaaagctcagcaaacatcaggacacttctggagaacaaggactcccaagtcatctactcttctgtgaagaaatcataacacttggaggaatcagaagggaagatcaacagcaaggatggggcatcattaagacttgctataaaaccttatgaaaatgcttgaggcttatcacctgccacagccagaacgtgcctcaggaggcacctcctgtcatttttgtcctgatgatgtttcttctccaatatcttcttttacctatcaatattcattgaactgctgctacatccagacactgtgcaaataaattatttctgctaccttctcttaagcaatcagtgtgtaaagatttgagggaagaatgaataagagatacaaggtctcaccttcatctactgtgaagtgatgagaacaggacttgatagtggtgtattaacttatttatgtgctgctggatacagtttgctaatattttgttgagaatttttgcaaatatgttcattgggaatattggcctgaaattttcttttccactgtgtctctgccagaatgtttgtatcaggctgatgctggcttcatagaatgagttaggcaggagcccttcctccttgattttttggcatagtttcagcaggattggtaccagttattctttctgcatcttgtagaattcagctatgaatccatctggtctagggcttttgtgttggttggtaagttttttattactaattcaacttcagcgcttgatattggtctaggaggggtttctgtctcttcctggttcaatcttgggagattgtgtgtttccaggaatttagccgtttcctccagattttcttctttatgtgcatcgacttgagtgtaaacataacttatatgcactgggaaaccaaaaaatctgtgtgacttgctttattgcagcatttgttttattttggtagtctggaactgaacctgcaatatcaccaaagtatgcatatagttgcaaaaatgtgatttttgacatagtaaatatgagtatttgcaataaactatgatattacttttgtaagtatatagaataaaatgtaaataatctatagatttgatact

SEQ ID NO: 157744 - DNA, 1496 bp, Homo sapiens
gtcatgatacacatgtgtcctgaggaaatttcaggaggccccagggattagtgctgtggagaaccaaaagcaatttgaaaatgggttacgcttgcaggttagactgctgacctgtttctttttgtggaaggaaatataaagagggctgtaatcgattatgaagcataagcattcttgcaatcctacgataggatgataaaacatctattacatgaaacctttgggctctgggccagggagtgtcatggatctaaaaggttcatagtggtaacagcctgcttcattttatgtcatctccttcaaagtgattagagtgtttctagcttgccgaaactgcacccaaagggagacatttggagccatgttattggtgatttactggtgtggaaaattacctggtgttgtagccaagtagccatttccattctaacccagtcctatagtcctgaactgggctgaataaacatacctaaatatatgtttagaaatgctcctatgtatcagttttcccaggaacaactataatattatagaaatcttaaaattatttcctaataaaaaattataggatacaaaagaaaaaaaagaaatatgaagagggctggatgggcacaggaaaacaatcagatgagaacaacagatgaccgtgtctgcaggcagcacccagaactgatattcccctcaaacgtctaaatatattgttgagaaaattatctctaactgttctagtgggaatgtgggaatggaaaatatgcaacagccatggggccaggccctttgctgagcctgcaggttgggagtttgtgaatctattgaggcatcacaaatcttttctgatagcccctctgtgtctgtcagttccagtgtctcgccctgtcctcaccctcaggtctcctggggcccaggctgcagtgggggacctgctggagcttcactgtgaggccctgagaggctctcccccaatcttgtaccaattttatcatgaggatgtcacccttgggaacagctcggccccctctggaggaggggcctccttcaacctctctttgactgcagaacattctggaaactactcctgtgaggccaacaacggcctgggggcccagtgcagtgaggcagtgccagtctccatctcaggacctgatggctatagaagagacctcatgacagctggagttctctggggactgtttggtgtccttggtttcactggtgttgctttgctgttgtatgccttgttccacaagatatcaggttgtatctaccatttggattctccatattttgctatgacctttccactactgatatagattgaaattacaaaaaaagaagagagaaaagaaaactctccaaaagccaataatttctttttatgcttcataattctgcaaggctctgtgcaatgctcaatgtggtcatactgctaattatacaatatgtcactgttccctgtgcatagtcactggagattaaattatttacacattctttca

SEQ ID NO: 157745 - DNA, 338 bp, Homo sapiens
actagtgaacaaaaccagccaacattcttgccctcgtagaacttactttgtcatagggtgggatgggtatgacagacaataagcaaataagtaaaatgcatcgtggccaaatgacagtgcaatggagaagaataagacaggaaaaggggtgaagtctgagcgacgaagcagtgcaacatttgatgcaacatttgagcaaagatcggaaagagataagacaatgagggtgtacatctgtgccaagcatggtggctcatgcctgtaatcccagcactttgggaggccgaggcaggtggatcaccagaggtcaggagtccgagaccagcctggctaacatg

SEQ ID NO: 157746 - DNA, 116 bp, Homo sapiens
atggcctttgggggaacatgtcttactcataattataggcagcggaaaatgcctgctagcgagtaggcactcaaacgtgtctgaataatttagtcccattttctccattcttaaat

SEQ ID NO: 157747 - DNA, 292 bp, Homo sapiens
gattctagaggatcccccgcgctcctgagtagctgggactacaggcgtccacaaccacgcccagctaatctttgtattactttattgtataaaatgggaaggcaaaagctagcaaatttcatgtggaagcccaaaagatacattctgaatgcatctcacactcctaagatgccctcctgcaaatcatttatacataggaagtgtttacatttggtgtagttacggagaccagtaattggagagttcccagaaaatccagaggaagtcaagatgcccaaaaatcaggagcgcg

SEQ ID NO: 157748 - DNA, 395 bp, Homo sapiens
  misc_feature (100)..(100): n is a, c, g, or t
attacagacgaacaaaaagaaaagaataaaaccaagtaatgagttcacatcctgcaaaatgtgaaaaattaaagggctcactaagtataacaaatacaanataggccgggcacggtggctcacacctgtaatcctagcgctttgggaagctgaggtgggtggatctcaaagtgctgggattataggcatgagccaccacatccgtccttattttcatgttttagagattgtgtctcattctgtcaccccaattggagtgtagcagtgtgatcacagcttactgcacccttgaatttctggacttaagtgattctcctgcctcagcctcctgagtagctgggattacaagcgcctgccaccacacttggctaatttttgatttttagggggaacga

SEQ ID NO: 157749 - DNA, 580 bp, Homo sapiens
cgcccaggctggagtgcagtggctcgatctcggctcactgtaagctccgtctcccgggttcacgccattctcctgcctcagcgtctggagtagctgggactacaggtgcccgccaccatgcctggctaattttttgtatttttagtacagatggggtttcactgtgttagccaggatggtctcgatctcctgacctcatgatccgcccacctcggcctcccatagtgctgggattataggcgtgagccagcgcacccggccaaaaaatcccattactctttatctgtagacatattaccatttggtattggtaccagtagacaaatagaagactactgaatgggattctttttttttttttactgtagcttttttctcctttgccttttgtacctcttccttacagactagatctgcaatgtccaatacggttgccactagccatatgtggctgttaagcacttgaaatatgactagtccaaattgagatgtgctgtaagtggattttgaagacatagtacgataaaaataatgtaaaatatcaataatttcttatattgataacgtgtgaaatgatatt

SEQ ID NO: 157750 - DNA, 321 bp, Homo sapiens
ataaaagagtcccccaacactagttctataaagggtgcacactgtatttacacatacaaatgcatgcagcacttgaaaaatattaagcaaccaaaacatacatatgtaaatatgtgcaaagactaatatacttctacatgtatgcccttattaagtacttttatgtttgactagatgtgcttcttttgaaatctttttagcttcattacatgtttttgtaatttcatggaagtaaattaaaagtaacatagttctaaatcctaaacagctaagactgcattaaattgccacctccatctacagaattgtatggcccttgaa

SEQ ID NO: 157751 - DNA, 498 bp, Homo sapiens
tcagcatagtgtccaaaacatttatggaggtaaaaatgctacactttgagttcgggtttatagagcaggtgtgtggaagtttattttaggcaagaagaaacttcaaagaacagattgggagacagtgtgaaaaaaagcaagtaaacatattatggaaaccgatcttgtcaaaggtgactagatcatacattggccttcattattggaaataatttggaaattggattcataatgaagtttccaccatttccagttagaagagcatcttacatcttttgtattgtgttctttgagatacatctagccttgcaatcttgtaatatttaccgaatgctactattttgcacacatttttaaaaatgaagaatatagttgttacgaatccctccgcaaaacctctgattagatttggcagaaaaatatggagagattgaacaaaagagatactaggtctgagatgtatgtatgttgtagatccgtatggtttattcaggaact

SEQ ID NO: 157752 - DNA, 382 bp, Homo sapiens
tctctgctctggctggtaacaaagtgccacagactggggtggcttaacttaaaaaaaaaaaacatttttttcacagttctgagggctggaagtctgcaatcgggtgccagtgtggtcgggttctgatgagaactctcttccaggcttgcagacttcttgctgtgtcctccatggtcagtgatgagagacagcgagcgagcaagctctcacaactcttttaataagagcactaatgcctcatcacctcacctaaacctaattttctgccgaaggcacatctccaaaccccatcgtattgggagttagggtctcaatacatgcctttggaggaataaacattcattccataagatgggcagatacaaggaaatgactggtacct

SEQ ID NO: 157753 - DNA, 718 bp, Homo sapiens
gttctagccaggacagttaggaaagagatgaaataaaagccattcaggttggaaacgaagaagtaaactactctatcagatgacatcttttatatagaaaatcctagagaatccactgaaataaaacaagcctttagaactaataaacgagtttagcaagtttgcaggatacaaggtcaatatagaaaatgaactgtatttttgtacactagcagtgaacaatctgaaagtggatttaagaaaacagttacatttaatatactatcaaaaataataaaatacttaggaatatgttgacaaaagaaataaaaaacttctctgagaattataaaacattgttgaaagaaattaaataagacctaaataaatggaatggtatttcctgttcatggtttagaatacttaatgttgtgaagatggcagtattcaccaagttgatctacagatttcaaatccttttcaaaatcccagctaggctgggcatggtggctcacgcctgtaatcccagcactttgggaggctgaggtgggcggatcacctgaggtcaggagttcgagactagccttaccaatgtggagaaaccccgtctctactaaaaatacaaaaaaaaaaattagccaggcatggtggtgcatgcctgtaatcccagctactcaggaggctgaggcaggagaatcacttgaacccaggaggcggaggttgtggtgtgccaagatcg

SEQ ID NO: 157754 - DNA, 398 bp, Homo sapiens
tgaactcctggcctcaagcactttccttttggttcatggaaatgttcattttgtttgggagcctgaggtttgtctttgtttcccttcatttgtttctgtggttgtcttgtgtggagcagaggtggcctctgcaagcatcatcttagtgacagatgaccaggtgtaccctgaactgcagccacgcaggtgcatttagagcatgagagaggtgggtgggcacagaagcccccttcatgccaagccttagggagttcgtcctgagggcactggggagccacagcaaggttgaagctgaagaagggtagaatcggattagagggttttcatttgtgtattttaatgctgcttagtacagaaggggcatagattgagaagaagatagtttgcaaacttgtcag

SEQ ID NO: 157755 - DNA, 348 bp, Homo sapiens
ggttcatgtactcgaaaaagttgaggtgcctctgaagggcagctccccgaggaaactcccaattttgctgccctctccaggtgtgcgtgtgagtgtactcatctgttgtttccatgtgttagttaacctgtattttgtgagctcctgtcgctactattgttgggcattggggaaaagagaaataaatgaagattcttgttttctcagcatcctgtttaaggaatataccatcttatatttggcgagctccataagagcagagctacccagaaaactgcccctatctatattggcgttttttccctagcttttctttatctctggaaaccacaggagcccttcgcctct

SEQ ID NO: 157756 - DNA, 412 bp, Homo sapiens
ggtttaagttcccatattattaggaaagctttagggtgcttcaggaaaacgctttttaaaaaatcaaatttggaaaatatcaaatggaattacaggcaataagcataacccagtggaaacatgaatcaaaccctctagagcagggttgtctaaattttgggttccttgggccacactgggaaaaaaaaaaaaaaaagacatttgtcttgggcccagcataatatacactaactgcaactgaaccgtgcgtgtaaagcttgtaaacaaaatctgtctgtaaagtctgtaaacaggccaggcgcggtggctcaggcctgtaatcccaacattttgggtggccgaggcgggcggataacttgaggtcaggagtttaagaccagcctggccaacatggtaaaaccctgtctctacc

SEQ ID NO: 157757 - DNA, 364 bp, Homo sapiens
ggcaaaggagaatggctgtgattagccatatatgcctataagaaggagcagagccatactgtccttgtgggttgggagaggggacacagaatccagggcaattgtctgaggtctcaaagtaagttaagccagagtcaaagccaaactccaagtcttggccaaggggatgagaaaagcaaggagctagtcttataggtcaaggaagatgaggtatagttaagagtcatcagtatcacagaacaggccagcagggctttattaggtatgtagaactattataaaccaaggatcttgggagatattaatatctgctggccagacctaaaaaaaactgaaggcccaaggaaagtgactggactcactg

SEQ ID NO: 157758 - DNA, 1207 bp, Homo sapiens
acactggattattctaaaggcagttgtgtatacagaagccaggggcgaaagaacttcgaaaatagcctagaggaaagaatgggacaaagagaggaaggggaaaaaaaggataaataggggaaaaaatgcaaaaactggagttttttggtaactaagaagaggggcattttaaaagccaaggcttggtaaaaacctagggaataggcttaagtagaaaggagatttgggaagctccagggcccttggacacctggcagtgagcatcagaaagaaaagtaagagttcttaagaaaaaccaatcaactttgcatttgccctggggctggcctggcagtgctgctatcagaattcagatactggcccagccctgctctagggcctgaagtttggctcttgcctcttcatttcagtccctttagctgcccatccaatctagatccccggagtgctcaaaggagaggcaacaagaagaaaaagaaaaagaaggacaaactgaaatgcaagcatggaccttagatgacgattctcacagctctcccccttcatgggaccttcagaattcattcttgtgaaagctgtaagtcaaggaggacacagccagaaaccgtgactcatcaaattcccaaagccaagaccagaacacacagactctggatccaaggactcgctttctgctttcagaacacgggatcctgcctactttgtagtatttcaatacaaagctgatcaagccgagggtccccatctactccccgccagcctggctgcccttccctgtcttcagagttttctaaatcatagagaagatagagtttaattccatggtgtttgagtcacaggaccttagaacacttcagaaaacgattggccttaaaacatggttgggtctgtacaagaaagtcactgagtacagaggatggcaaacatttctgtcatgggctaggtaaatactataggctttgcaagccatgtgttttctgttacatattattcttttatttgtttctttttgttttttgtttttggggtttttgttttttgtttttgagacaggatctccctctgtcacccaggctggagtacagtggtgccataacagctcactgcagcctcaacctccctggctccagggatcctcctgcttcggcctcctgagtagactgcaggtgtgcttcactacacttggctaatttttttattttatgta

SEQ ID NO: 157759 - DNA, 188 bp, Homo sapiens
ctcaaagtgctgggattacaggcatgagccactgtgcccagccaagattttttttcacctagaaataaaagtcagtattatatttttttgcatatacagttttgacttgtaaaatggaatcacctcaattgtgctactttaaatattaagcatagtttttaccttaactaaactttcaataagcttga

SEQ ID NO: 157760 - DNA, 559 bp, Homo sapiens
gggtttatcttatttaggtttttctctgcttcttaaatctgtaggtttatgtcttttgacaaatttggcaagtttcagccattatttcttcaaatactctctcagtcctactctctattcctctcctctgagacttccatgacacaaatgttggattttttcttattgtgcttgaggctgtgttcatttaattttttcagtctatttcttctttactgctcagattgggtaaattatattttttgtcctcaagttcattgactctctcctgtcatctccactctactactgagtccatttttggggtttatattatcaaattctacagtttcacaatttccatttagttctttttaaaataacttccatttctttgaaaagattttctggttttgtttgttgagtgataactgtgattattgaagcatttttacgatggctgctttaaaaatccttgtcagataattgcagcaactgattcatctttgcattgaggtcttctgatcatcttttttcatgccagtggtgactgtcctagttcttggtatgatgagtgagt

SEQ ID NO: 157761 - DNA, 329 bp, Homo sapiens
cagattctttctctacacgtaggctgcagtgcacaagctctcgggactccttctccttggcaggaggcttagctgcatctccactggctcctttctcacaggatcagaggtcttgatggacccagggctctatttccctggtaaagaaatgcacccattccttacccaccccatccctcttccctcaacacccctttcagctttgtggaaaggcaagcagaagaggagacttggaaaaggacttggacacacctaacccagaaaaaaggaaccttcccgactccctataatctagcccagttcactactttccatgcactgcggccaga

SEQ ID NO: 157762 - DNA, 165 bp, Homo sapiens
tcatcacgtcaactataaacaggtataaataactaagcaacataagcagaagaaagtgactatattttctcagttttgttgagtgcctagcaacataggccttttttttttttttttggggaaggggttttggtgctggggccccaaatgggggggcaggggcaa

SEQ ID NO: 157763 - DNA, 660 bp, Homo sapiens
tgacctcagctcagtgcagccttgaccttccaggctcaagtgatctcccacctcagcctcctgatagctgggattacaggcactcaccatcatgcccagctaatttttgtatttttgtagagatggggttttgacatgttacccagactggccttgaactcctgagctcaagagatccatccacctcagcctcccaaagtgttgggattacaggtgtaagccactgtacctggcctcttttttttgagacagagtcttgctctgttgccaggctggagtgcagtggtgcgacctcagctcgctgcaacctccaactccctggttcaaacgattctcctgcctcagcctcccaagtagctgggattacaggcacccaccaccatgcccagctaatttttgtatttttagtagagacagggtttcatcatgttggccaggatggtcttgaactcccaagctcaggtgatccacctgtctcggcctcccaaagtgctgggattacaggtgtacgctgctgcacccggccactctgcctcttatgtagattcttttccccaggtgacaagaataaaatcaatatgcctcagaaatgtataattctgagacctaatttcatccacttgtcattagtgcccactggccactcatcttttttgtcct

SEQ ID NO: 157764 - DNA, 191 bp, Homo sapiens
cagtcgcaagtgtccagctcgctgcatcccagagacagaacatagctgtgtagtcagcacccaggtggagacacagcagcacatcccagaacccccgaacccccactgcctccaccagagacaaccaccatcccaactgtcacagcatagggtcgctactgctgattcaggtagtaaaacttgtcatagga

SEQ ID NO: 157765 - DNA, 417 bp, Homo sapiens
tctctgtatgtccttgtgtacccatggctgagctcccacttatgagtgagaacatgcagtatttgactttctgagttacttctttttggcctccagttccacccatgttgctgcaaaagacacaatttattcttgttttatggctgagtagtattctatggtgtgtgtgtctgtgtgtgtgtgtgtgtgtataccacattttctttctccagtgctccactgatgggacacttaggttgattctttacctttgctattatgaatagtgttgcaataaacatacgaatgcaggtatctttttgatataatgatttctttccctttgggtatacactcagtagtggtattactgggtcgaatgatagttctagttttagttctttgagaaatctccatactgttttccataaaggttct

SEQ ID NO: 157766 - DNA, 364 bp, Homo sapiens
gcgcacacacgacacacacgcacagacgcgcacacacgacacacacgcacacacacgcacgcacgcacacgcacacgcacgcacacacacacgcacacacaaacgcacacgcacacacacacacgcgcacacacacacgcgcacacacacacacacgcggagggcgagccaagggaagggattcagaacaggatactcaaaaagaggaagaaccgtcgtttcaccacccgccgcagtgaaagctgaaattaagtgtcccctccacgacttcttcgacctctgagagaacttcgagtgcaggaacagtgctccaccaagcctgccacctgctttgtcgcgtcctaggctgggagcagtctgtggg

SEQ ID NO: 157767 - DNA, 350 bp, Homo sapiens
atatacttattaacactaaccaaacgtgtacttaaaaatgattaagatggtgagctttatgacatcccacccactctaagctatcggtcaaatgttccattcctacctagagtatcccacacacgggcatcactccgctgtggagagagggagtttccccctctgtctccgatacctgtgtagctccttttatcacctccccaggagatttctttatatttgaaacatcaggtataatggaattctaggcacgatatcagacataaatcactttagaatttcttctcagtgccttcaagtcacttgtggcttttttgagacttttgatttgtgttagaatattaccctcg

SEQ ID NO: 157768 - DNA, 512 bp, Homo sapiens
agtgcatggtgtttataaagtctacggtagtgtataataatgtcctatgccttcacattcattcaccactcactcactgactcacccagagcaacttctagccctgaaaactccattcatgataagaattttaacaggtataccattttttaattttttagatgattgtatttgtacagtaacttttctacgtatagttatgtttaaatacacaaatgcttcccactgtgttacaattccctgtagtattcagtatagtaatatgctgtacaggttgtaagttaggagcaatagattatgccatacagcctaggtgtgtagtaggctacaccctgtagatttatgtaagtacactgtatgatgttcacacaacaaaatcatgtaacaatgcagttcatatatccctgttgttaagcaatgcatgactgtatataatattctcaagtacattaacattttccaagataggccattgctaggccgtgtctctcaataaaagtactgaaatcata

SEQ ID NO: 157769 - DNA, 282 bp, Homo sapiens
gaagctgagggtgtttcatttgttccaagagctggcaaggccaaatgccaacaagcatatttatttctcaaacttccatttctgtaatggattggcactttatttatttttatcatagtcaaggttttatgcctgagttttgtagacactggaacctggcagccctatatctgcagtgcacttctcagggggacttgttaggttttatatatagtgagccctccatagccttggttccgcatctgcagatataaccaaactcagattgaaaaatttcacgga

SEQ ID NO: 157770 - DNA, 1096 bp, Homo sapiens
ccacctcagcctcctgagactgtaggcacactgccacatccagataatttttgtattttttgtagagatggggtttcaccaggctggtcttgaactcctgggctcaagccatctgcctgcctcagcttcccaaagtgctaggattacagggtgagccactgtgcccagccaataagttttaagtaggggagtaacagcacattttaattttagaaaattcactttggccataaaatggaaaatggtttggagaagaatgagacgtaaagtgaggagaaaagttagaagcctagtttaatagtccagtcaagagataatacacatttgaactaagggtgcatttgaacaaggatggaaatatggatgtggattttatttgaaagaagtttacaaggcaaaattgacaggatctagtaactcactgagtgattgggggaatggtaatggaacaggaatagtcttgtttctgacttgattgtctttagtcaggatagagaatgtaggagaagctcttaggatggagagaggagtggcataataagatgatttttggaaatgttgacttaaaagtcttttgggttattcaagtgaacttctccaactggctattggttgttggtatctgattaagcagatttggaacttctagatgtgtaagtaaagccataaatatagatgaagcctctacaaagacttatacatgaatgttcatggcagctgttttcagtcaaaaactggaaacaatccaatgttcgtcagcaggtgaatgaataagcaaattgtgatacaaacagtggaatactattggttgttggtatctgatgaagcagatttggaacttctagatgtgtaagtaaagccataaatatagatgaagcttatacaaagacttatacatgaatgttcatggcatctcttttcagtcaaaaactggaaaaaatccaatgttcgtcaacaggtgaatgaataagcaaattgtgatacaaacagtggaatactactcagcaataaaaaggaacaaactggctgggtgtggtggctcacacctgtaatcccagcactttaggaggccaaagtgggaggattacttgagccc

SEQ ID NO: 157771 - DNA, 317 bp, Homo sapiens
taagtgctgaatcacacagtgctttttagctcaggatgtagctaagcttatggggactggtgctggaaaccctttttcctaggccatagaacgtgctgaagccatggttgagctgggggtttaagagaatcccaatcacttgcaaagcattttcaaacaatatatgctcccctagaaattctgctgggaatccacatgaaaaatgagtatgtcaacaacaaccatacaagattttaagtctaacagatcttcatttatcagggactcttaactgcgaaagttaactgttgaggctaccgaaccttacattttgctag

SEQ ID NO: 157772 - DNA, 487 bp, Homo sapiens
cccaggctggagtgcagtggcgtaatctcggctcactgcaacctccacctcctgggttcaagcgattctcctgcctcagcctcctgagtagctgggactgcaggtgttcctgagtagctgggactacaggcgcacaccaccacacctggctaatttttgtatttttagtagagacagggttttgccatgttggccaggctggtcttgaactcctgacctcaggtgatctgcccgcctcggcctcccaaagtgctgggattagaggcttaagccactgtgcctggccaagagaaacagactttatgaacaaccacatgagacagtgagacaggtgatgaggacctaaactaaaacaatgacaagtgtggtgggagagagggggctgcattcccagcttgggaagccagctgtgcagcaatgctgttaaccagcatctagaaggcagagcagtgcgggactggaagtgtgagcatctgcgggtgcatct

SEQ ID NO: 157773 - DNA, 263 bp, Homo sapiens
tgctgggattacaggcgtgagccaccatgcccagcaaatgattcttaataaatatttattagactcctaagttccaagcagtgggtcagtaatgggaatataagcacatagaggggaatatatcatattccctccccttcagaagttcatttgtaagtcaggtatgcaaacatgaagaatatatcatgacaagtatcattacagagtcaggagcagagtgaaaacaagattgagtgggtgaccatgcattcactgaaagaagg

SEQ ID NO: 157774 - DNA, 321 bp, Homo sapiens
  misc_feature (119)..(119): n is a, c, g, or t
  misc_feature (122)..(122): n is a, c, g, or t
caccgacgttctctctgtgggggtgcagactgtagatgggaggcctgtgtgtggtgcagtgggtggggggcgtgggaggcattctctttaccttctcctgtccaccaccagtaggaccngtncttccttggggctgttttttatagccagtgattatagccttgagggttatcttcttggaaatttttctcactagccctgagattaataagcttctggaaacttcaatatcattatcaagaaaaacggagacaacagtacttgacttgggcttattctcaaagttcaatgaggcagagtccgtccccacagagagagcgt

SEQ ID NO: 157775 - DNA, 423 bp, Homo sapiens
gtaagatttggtttggattacaccaggcatgggtacttaacataattggtcatttcatcagttcacagtctttattttaaatgccatttaggctgctacagacagtttcagcaggctagagagcacttcaattcttgtacaatggaaaccaagcagagcattagaaggggacaagctcatttttcagaggggacccagggcaggctgaacagaagagtggcttattcagagccctgcaggcgtggccagctgacaggtgtccccaccgtgccttcttcttgtgtctgtgtgtctctgtgttacggtctctatgtgtttgaaacgtgttctttattttattcgtttaattcatttactaatctctcttattttgttaatgaaaagaataaagtcttttttatattttcccatttccaaactccc

SEQ ID NO: 157776 - DNA, 254 bp, Homo sapiens
ctccagtcaacagaattaactgagccttccttgaatcatcccagcccaggtgccagaagtgtgagtgaggaaaccttcaggtgatcacaacccccagctgttcccatcccccacagcttttgtgtcttcccagctgaggccgcaaacgtcatgaaacaaagacgagtcatccccactgtgtcctgccgaaattcatgacccacagaatccatgaacttcataaaatggttattgctttatgccactaagtttgg

SEQ ID NO: 157777 - DNA, 491 bp, Homo sapiens
accctgaattcattcacattgataatccaaatctctgttttacatcatctaattagtaaaacaaaaaccattaagctctgtatgtagtatatgaaatctgctaggaaatggaaattctagccataacttagctatgaaatactaattaagaaaaacaactcaaacaatctcagcgtatttgcaaagcacctcatatgcattttaaatacaggacccagagaaatagctgcgaaaggaaagccaaagttattaaatccaaagtttttcattttcttgacatgctctttctatttaatacagaaatgtactaatataggttgccttttggtattgtaatttggtcaaccaaaacttgggaaaaataggtccaaagtttttcattttcctgacatgctctttctatttactacagaaatgtactaatataggttgccttttggtattgtaatttggtcaaccaaaacttgggaaaaataggtttattaataaca

SEQ ID NO: 157778 - DNA, 615 bp, Homo sapiens
agccgaggtcatgccactgcactccagcctgggtgacaggcgagactccgtctcaaaacaaacaaacaaacaaacaaacaaacaaaacagagactttgacctgttactgaaaccaaacactgtccactagcaaacatggtgtttttcctccccgaaggtaggaggctgtaagagattattaggggcaatgtcagggaatttaaagtaaactactttggaaagaagaggctgttaacttttggtcaacgtcacacagaaagagactatgacctcttattttctcccaatgtctcctatattcactcttgtgagagaatgaaatattcctattaggcatttcacaacatcgaaagcaggagtgtccaattttttgccttctctgggccacattggaagaagaattgtcttgggccacacataaaatacactaacactaatgttagctggtgatacggttaggttttgtgtccccactgaaatctcatcttgagttgtagttcccataatccccagatgtcatggtggggacctggttcacaggaggtaatggaatcatggaggcagtttccaccatgctgttctcacgatagtgagtgagtttctcatgagatctga

SEQ ID NO: 157779 - DNA, 412 bp, Homo sapiens
ttctgtgactcattagacagggctagctacccttgctctccatctgaagagtccccttattttccttatcattgtattagtcaatcctgaagtatttattcaattagcagcccctatgctgtagacattaaactccataaaggcagggaccatttcagtcttattcaccacttgaatcccagtgcctatcaaagtacttggcacataaagatgcttaatgaatgtcagtttaatgagtgaatgatgcataacatgtggtaggtattaattaaatgtcatttatcgagcaataaaggccagtgcagtggctcatgcctgtaatcccagcactttgggaggccaaggtgggaggataacttcagctcaggagtttgagaccaacataggcagcataccgagaccctgtctctac

SEQ ID NO: 157780 - DNA, 507 bp, Homo sapiens
acagttactgcagtatgcttatttgactttgctttattgcttttattttctgcctgacatatgttaatgtggccaaatagggcatttcccagacaatccttatagtttcattctgtgctactttaaatgctgttctccttccctgaaatgtcctttttttttttcttttcttttttttttttggaaactcgcgtttccaaaaaaaagaaaaaatttgggagcagttctcccaagatgctgttcacgggtataccggtttgtgtttatgacgtccctccctccaagacaaacaacaacactgtgaacgtgggacccgggttcacaaagcaacggccaagggttatcggctccacggctatgtgtgtgtcggtgtccctccactttattaacttcgtgcactgcgggtgtaccccgcaaaacgaaacttccctatacgcttgtaatatcccatgcctcttacaactgacaatatattgtctctcttgctatcacattctcgcagggtcg

SEQ ID NO: 157781 - DNA, 430 bp, Homo sapiens
tttcataatcagtttggcatgttctataagaaatcttgtggggattttgatggaattgatctaattattataatttaattttatgtccaagaccatggaatacctctccttatattttactctactttaacgtctctcaaagttttgaaatcttccctgtaactttcttatgtgtagtcttggtactttaaaattcattttctacctcttgcttatataaagaaatgcagttgtcttttgtacatttttttatatatttgtttagaaagcttactaaacattctttttaaatctgataacatatttgtggattcttgggtatttttaaaagagatgatcattctcagcaaataataatgcttttgtttgttcttttccaaaccttatgccttttatttcttcttttgctttttgtgggctagaatctaca

SEQ ID NO: 157782 - DNA, 373 bp, Homo sapiens
agactgacatgttttattttcctcttaaatcatggctccttacagccttttacctctcagactgaaccatgaggcttcatgccctcggacggaggaccagtgatgcttagaataaataggccactggccagcttagaatcttaaaactttaaaacagccttaaaatgagacattatcaaggagggaaagggattttaaaaaattcccttagctcttttaactatggcaggacccaaccctggaggactagataacagagtttcaccacaggccctgtgtggagagcgctcgaagaagccaggcccctccagtcttagagcgctatgggagaaaggagggaaatcagaggccacagagttggattttgagaccc

SEQ ID NO: 157783 - DNA, 164 bp, Homo sapiens
aaagaccaggacattctatgattagctgccagattaatgatagaggcaacagaatgtcctagggatttggagagggagatgatcatgttagaatcatgggtcaacaactgctgtagagcaatggaattgactttattgatttttaaagaaatggctaaattcag

SEQ ID NO: 157784 - DNA, 125 bp, Homo sapiens
tcattgcccaggtccaggctttcattggctctcatttggactatcaccagaccattcgatctctgctcattccatcttctacgttacggccagatagcagtcctccttcaacacatatgtcatat

SEQ ID NO: 157785 - DNA, 231 bp, Homo sapiens
ctgtgggtccccaaagcctgaccaggggtttggctgatgttcctctgcagagcaggccagctgcctgtcatgttgttttgtgtcgtggaaatcccgcaaagagccagaagtaaggggctcataaaacacaatggagcctcttataatccataaaaagaacaggagttatcccctcctccccaaaacctaccatcatcattgctatcccctcagcaattttgtccaggtgca

SEQ ID NO: 157786 - DNA, 589 bp, Homo sapiens
tgagggtgagaggagtcctttgacagtgtccacagatgaagccaaagggaaatctttcttgctgtagcgacctgtgccatttctcatctgtactctggcaaagtccttttctctgacaccttggaggcgaatggaagggaaagcatttcactttctccttagtctgttccccttaatccctccctcctccagtatttactgcgttccaaaggtggtcccgggttaacccgggacctcctttgcacccgtcagaaaagtctagtcagtgtgccccagaaaggccatctcccactcccaggacccagaaccttccagtcccacagcttaggaaaaaaatcccaactgccaacctctgccaataagggtctgccaggcctggccctttgccttggtctcccacgattctccctctggcttccctgtgctggagtcccactgccctttttactcctggaacatcaagctcgcttctctgctcctcctgtcaggcgctgtcttcagctgattcttcccctaactcctcctcattggatctcaccaaaggcggtcccgggttaacccgcgaccgcattggctgtgccggccacag

SEQ ID NO: 157787 - DNA, 671 bp, Homo sapiens
attccattccaatttcaccactttaaaatttaattgaaattgctcttctggctcaaaagcaggagagcacacatagaaaacactcttaatagccacaaatgcaacaggttaacagactgacatctgttttttggccattcatatcagggaaaatcattaaaaaccactagtcaactcatcaaatgcacgtaaaaatatgcccactagtgagtctttagggaaacatgaaataaaatagagatttaggttagaggtctgaaaggaagtaaacatgaataattattctaaaaggcactaaagcacagagatcaatgtttacttaaaacagactttaagatactttggcccatcagctgatttttcattttgagaatatcctcacacaaaagtcaacttacttcttcgtaactggtgattctctggatggtctatacaaagtaatatcagaatgagcaaatgtaatccattaactcaacaaatagttaaatgcccaccaaatgttctgaaagcactccaaagtcaaatacagatggtccccggcttataatggtttgacttaatgattttccgactttaagatggtgcaaaagagatacgtgtttggtaggaaccatactttgagtacccatacaaccattcactttcactacagtacaaaaaattacaggaga

SEQ ID NO: 157788 - DNA, 367 bp, Homo sapiens
agctgccagaaagtagaggggtttagtaggcaaagcataagcagacccaggaatgggaggggagaaagtgattgacaggcagggtgaagggagtgaatgagtctattctggttgagatggtgtggctcagaggtagagaagagattgaggctcagtgatggggtttcccggatgccaggctgtggaatggaaatctgatccttttaggggaaggcggcatcaaagagtagggaattgacagggagttgctatttttgtatgtaactaagcagtaataaaaacaaggtttttgaatgagttttagaatggggtcttagaaagggatcagaagcatgctgcaaagtcagccagttaagaggtcaccttt

SEQ ID NO: 157789 - DNA, 716 bp, Homo sapiens
tttgtgatttatatttttctgtacttaagaaagtataggccatgtgtgctggtctccaactcctgggcttaagcgatcctcccacctcagcctcccaaagtgctgagattacaggtgtgagccaccatacccagcctattcaaacatgtaaagaatattacaaatattgattacctactggactacaaagcaaatcttaaccaataccaaaaaatattacatagattattttctctgaacacattacagtagaaatcaataacaatagcaacaaacttttagaaaacctcatatatacagaaatttgacttctgaataactctgggtaaaaaatctatggaaattagtaaaaacttagaaaaaatgatatttcaaaacatgaggaatagttaaaacaatacttaagaagaaatacatagctttaacggttatattagaaaagaagattgaaaatcagtgagataagagttcaacttaagaagttagaaaaagaacatgtaaacaaaaataaattagaagacaaataatttaaattacatatataaagcaaaaattaatacaataaaaaacaaagacacaatagagataagtggcaaaaccaaaaactgattatatgaagactactaagatacataaactattggcaagaatggttaagaaaaaacagaaggcacaaataaacaaagttaggaaccagaaagcagtaaaaaaaataa

SEQ ID NO: 157790 - DNA, 359 bp, Homo sapiens
ttggagttgtagaaccctggtattgatgagatcatttcctgttttaaaagacggcatgaattaaaagcaggaaggcaaagtcatcagaagattaggggagggagcagaaacagtcactagagaagggtgatagttgcctctgattttgctgtgagaagcaatttatagctttgggctcatgcagaggcacccacagttatgtcatatcctgaatccttgagaaaaacaagtgtcatttctttacctgaaaatccattcagaatgggattcaaggttatagctctaaaaatgtgggctagcagcccttcagccttatgttacataaacatacataaaagggaaggagctgttgcatttgt

SEQ ID NO: 157791 - DNA, 566 bp, Homo sapiens
gaaacacctcatttcttttctgtaccactaggaacagaaaatgttaaactcagaattagaaccatactagatatagaatgacactgacgtggaaaagttcatactttcaggaacaaaagagtggatcaaagtttttggccagcaagagatgtagcaaacaatttaacattgtggtggctgaggaaactttattttggtcaacaggccaatggacagtgaagctagcggtgataagggaggtaccatgcgaactccctgataccaccatagcagcattccatttctatcagccacgccacttagatctgacttatacttctagaactctcaattcctagcctataacctatgatcagttctcacagattatagctttgaataaaaatacatctgtaaacctgaattctaacctcccaaaataaagtagctatttttcattttcatttcattttactgggggcccttcagtctccttaaaaccacttaaagataacaaattgcttaaagtaatacttccccaaaatccagctcttcaccactatacctgtaggtcacttagtctgtat

SEQ ID NO: 157792 - DNA, 230 bp, Homo sapiens
tgatacttagcgcccagagcagagataagagggggccacgttgtcatgaggaacacctcaggagcagcccaaggagtgggggtttccttctgcggtgtccctgccaatcaggcagaaaggctctgggacaggttcacctcctcccttccccgaattcgtgttaaaaggaaatcacagctgggcacagtggctcacacctgtaatcccagaactccaggaggccaagatgg

SEQ ID NO: 157793 - DNA, 375 bp, Homo sapiens
gtgtggttctgggtgtctttgtcctgggcagtggtggtgatgacaggctccccaccaccccagctcaggcacaggtgatgccaccaatggctccttatttctcagacgcttgagacagggtctcacctgttgcccaccctggagaccagtggtgtgatcacagctcactgcagcttcaacctcttgggctcaagggattctcccacctcagcctcatgctaccatgcctggctaatttttgtattttttgtagagacagggttttgtgatgttgcctaggatggtcttgagctcctgatttcaagcaatccatccgccttggcctcccaaagtgctggaattacaaaaacggtgcccagcctatttttttttttc

SEQ ID NO: 157794 - DNA, 523 bp, Homo sapiens
tactggacatcccacaccactactggcaagactgctgcaaatagtactggatgctgttgctggtactagcacctctgctcaatagataccactactagtactggaattggccaaatgaatactcaacagacacctgctttgttgtactatttgcttcagatttaaagtccacaaacagctttagctgctaggactagagtacctgcctcttctagcttcatacagtagtagtgtggaagatgctgctagttgcctacacaatatccattcttcccttctgaaatagatgtccatcagaactgtctgcatttaaaaatccaagataatctacagagtattagaacaaataaaagggttttttgttttttaaatcaatccaaaaatgactcactgtatattgaatttctatataccaaccatagctgattggaaactacaataaaaatatatagcaacagaaatataagatatgtagaaacagatctaataaagtatatgaaagacattaaaccacaaattctta

SEQ ID NO: 157795 - DNA, 597 bp, Homo sapiens
ctgatcatatcaaactactcctgacttcgcaaacaagtccagcactctccatccacaggactccatctaaacgtgtcttccctcagcctgaaatgtctttccttcacttgcccttcaagagccaccctaagagtaaactctggaaagcctttccttctacatactatttcaaccatctcaccccatcccaccaagcccctaggtttatgccccaggcatacctctatcacctggcatttatcacactagactaggtattttatgaccatggaaaatggtaagtaccataaatgatgtctaatatacaaagttattttctaaaatgtacaaacgtcacttaaaagcaaattactaaacttcagccagagaaatttgtttagtttagttttgagacagggtcgactttcttgcccaggctggagtacattggcatgggcatgatgacggctcatggcagccttttgtgtgctgcctctgggtacccccagcccaacgtgacatggctgcagtgcagtggccacacttgataggtgtgatgaggcccaagtgctgcaggtctgggatgacccatatcctgagtcctgataccaggagccc

SEQ ID NO: 157796 - DNA, 519 bp, Homo sapiens
tgcttattatgtgttgatgagataaataaatgaatgagtaaataaatggacgaaggccttcaaaaatgtcctggggaggataagccttaattccaaagaaaaatgggagcagaaagtgtccagttaaaagtgtgcattctaaggagtgtgtgttcctcctgcaactaggagagcagcccccctcgcctccacccgcctggggtcctctcacgaggcaagcacccagccccctgcccactcctgccctttgtccaagcagtcctcaagctagctgtgcagcgtgtgtcttggggtgcttctgaattaacacatcacaggatgggagctgacagaggagggcagaaatccccacctcctcccaggctgctggcagctgtgtgctccagttatgccttctccattaggtgccactaatttccatgattactgttatgtctaaatggcatcctggtgtaatacaatttatattatctctgcttggtgtcggttaccattgttttcatgatattcaatgggatc

SEQ ID NO: 157797 - DNA, 501 bp, Homo sapiens
ccagttaagcccctctttcttgtctgaatcagctcccaggccatcagctcttctgctgagcctgatgactaacttactctcaggccgttcacctggaccaggttaatagctctacccattgccaggtacttagatgctccaaaagagtttatttctgtcaccagcaataagcatgagatgggacaactctaatggccagtaggataagaaattctgcccatgtttggaaatcactggtagctgtttatggtacatattttgcatattgaactctgtggctacacctgaacattagcatatttcactatttgacttgaattttgtttcttctttttttgatttttgtttttttcttttgctacattagaaggatggaaaaaatatttctcttcaccttccgaaaagtttaaactttaagcttttcctagcctcaaggaaaaaaggaaccctgatagttgagttgctaataattctggctttaggcttaatggaccataaagg

SEQ ID NO: 157798 - DNA, 207 bp, Homo sapiens
aaatgcgatatacacagttagcaatagtaacacagacacacaccgtgaacaaacatgccaggatcagggacatggattctcattttatgcgcgtgttaagtagacaaagacagatatatatgcatactgggttgcaaagtacaatgtctttggccaaaacctgaaaatccagttcagttctatatgttctcaatgtcaggttcatta

SEQ ID NO: 157799 - DNA, 177 bp, Homo sapiens
tatggtgaagcacattttccctcctctttgagagcagagtcgtcactcagtgacatcactgccttcgtttactatatggtcagccctctgtatctgtgggttccacatccactcattcaaccaactggggatcaaaaatattcgaaaaagcaaaataaaaaatgacaatacaacaat

SEQ ID NO: 157800 - DNA, 545 bp, Homo sapiens
tataaaacagaaggatgcataactacctagagaatctggatcagcactgctattcaccctgagaagggtaagaagagcacctggctggttttagtaagttcacaggaagtgagcaaaaaaaaaaaaaaaaaaaaaaaaaaaaaaatgtgtgtgggggcgcgcccggcggcccccggagagaaggttttcgagagaaccccatcgcggtgtggggcgcgcgcggcgggcccccagtgtggtgtttagagtggaaccgggggggcacaaatggcgtgtggctccccagagagagggagacatcccgtgcggggctcacagagaccactaaggggggcggggcgaatctctctctacccccaaatataaaaaaagcgcccgcgggggggcgggcacgaagccggagagcggcttctgggggaaaaacacaactctccagacgagtggggagccacctccgggcggagggggcccaaacctagcgggggggatccttatactcacaaggggggagggtctcccaaggaggaaaccggcgaaaatactaa

SEQ ID NO: 157801 - DNA, 316 bp, Homo sapiens
accatcaagcttaactcttctctggattctctttataagtcctataccagctcacgatggtagcatgctttaaagtttgtaatttgtatcagctcagacgagttcatttgagccacacaggactctttatgggatacacagattagggattctcttcattttaaagatgttgaaaataaaatgtagacaagtccttgtataagatcacatggctcagcacattcagacctgcatggggctgcccaaggtggcacactgaggtctgcttctctgatctagtgactcaatgaggagtttttgtcatggcaacaccaca

SEQ ID NO: 157802 - DNA, 337 bp, Homo sapiens
tggtcctatgcggtgctctacttactccggttgcctctactcatctactgactgaatggatgactgggtgaatgactgccttagaaaagctaacaggcaaggaagaaagccctgaatgagcatgtgcttggaccctgactgtcttgctgagtgccaggccaggataccggccccaaatcaattgacccttactcttggtcttggatgtaggctagtctgaagggaaaaagccaccgggagggaattagttttcagctaatacctcatgggacaaagggctaggaaagtagtagttctaactttgggtatggcagagaaaaccttccaatggccaggc

SEQ ID NO: 157803 - DNA, 609 bp, Homo sapiens
gaattaaagtgcttgtaaatcagatctggagttaaataaagtaagcaccacaaagcatatggcttgtctctttaaaggttctatttatatccattggatgacaaccattaggaggtacatagctcccttagccggagttatagacgcctaaaaatatatttcctggcttccaccaggaactggcagggtctcaaaaagaagttcatggtttggccaaaatacaaccattctttcagacctatgttgcctgcattacagaatggctaggtcctattagtacaagaaggaaatatttagatttgtgttagaaaattaaccttttcctctttgcatttgtagtctaaggcaagcattgggaatcatcggccatttgcctagcacaagctttaaagtaggttccagaatcagtcttatccacagaagtgctgggcttgcttctagagttttccctaccgaacagaactcatctgttattactgtgctccagcaaacaccaaaactttatcttaggtcgtgatattttttaactgtttcaccacctgataatatgacctagccacctggaagctgagtgaaatcctatcacaaacccacagatagcatgcccgt

SEQ ID NO: 157804 - DNA, 742 bp, Homo sapiens
gatcattttatttttaaagcaaagcttgtaaatattaaagttgattaccattccgttattcatttattattcaaccatttattaagccctatgcatcaggctgtgggctagataataagacaaaaattaaggaaaattttcacttttaaggagctctcagtttagtggcaaatggggccaataccacttaacattgttcataaggaaacagcttctgtggatctgcagttgtttagagttagatgtgttcttggatatgtaactaaaaatagaaacctttgatctagaaattaacctttggtgagtagcaagaatttatctttttaaaattaactttttaaaataaggttgattttgagactccttttaaaaattcctttggctaaaatagctttggaaaaaaaggggaaaatgtaaaaaaagaagctctcttgttccctaagtgagaggcaaagatattgcaacaggcaaatcttgctctcacctgcactcattttcatttgacatggtgcaatttttagatctttttatttccttaagaaatttgcatttgccggaaagaaaagcatgcaaatatctgtaaatctctaaccctgtttcctcatgttgggtatattctcacaaagccttctagattacaaagacattaagaataatataattcagctctattttctttgttttgagcagcaaatgtttctggcaattagcatgcatccattaattttctatgcttagagtt

SEQ ID NO: 157805 - DNA, 288 bp, Homo sapiens
tccttaactttcaaatgggtgccaaactccctcccttgctaccagccaactgtaactgctatgatttccatactcttgtgcagagctttttacttccccgtgatgctttacagttttgagttataataaagcttttcttttttttttttttttttttttacttttctgttgtgtcatttttcttgttaagtttatgctttaaggagttgatgccttgcgtatagtttggggtttggtaggatggacggcagtctgtgtgagcctatatgggtgtgtcaaatccagtcg

SEQ ID NO: 157806 - DNA, 402 bp, Homo sapiens
tttttgccagtaactactgagtaattatccagattactgcacgaaaagcaaattaaattaacgacatcacctgtgtaacatggatttggatccctgccagtttcctaaccttttaaactgagctcaagttaattaaacattttttcaatcactttgatggggatatgggggaggacggaagagaggagagggaggttggggcagtgaggaagccccttgccacacactcctttggaaatgagtatctgtccttcttgggaagaacaccagcaagggagaggggttgtccttgtgaaagcgctagatgtgtactgtgttagcacgttaagtttgtgaggttggaacatggatctgtctctggaaaagagagggtgacagctgaggccagggaatggattccac

SEQ ID NO: 157807 - DNA, 783 bp, Homo sapiens
aggatccacatggtagttccggttgtagtttcttttactttttttttagcaaaagacaaagggaaacaacaaccagaactaccatgtattgagggcttcctatatcccaggcactgaaagaaagtgaacttgctcgggcatgcttggggcccagtaagcaagccaaattaaatacaggcggcctggcatggaatccgagactgtcatcgacaataaagaggtgaaaactgtttgcagagagatttaaataaactgtttgaaagtacatccagtcatgcacagtccttcgctaacttcaagaagagcacattggtgttaagtaaggggaaagcatcagattgataagtaactgataatgatcagcactgatgtttcggaggaaatatgtgttgcagagaggcagagaaccatggtggcattttgcccagtgagatgtgtcatgcccactacaggcccctcctttagagagggcaccttctgccatcttcatctctccccttggtttttattcattgttccttccagtgcaagaggatgtcacatttcatagatatatgtgaaccacagagacccaccttcatccagggaactgcaattcttaggaaggcactggggcatactcaaggcaatgagaattttttcacaacagaactcctgtggcaacaggatggaacttaacaaaggggactgccctttcagaaacagtctgtcctgcaacagcatggagatgacaacagggacaggttctacttagtgatgacagggatacaggcatcctggctc

SEQ ID NO: 157808 - DNA, 537 bp, Homo sapiens
ctttgtatgacttttgcaagcttcctttctccttcagactcagtttcctcatttctggaaaatgggaagccaggtgccatagcacatggctatagtcccagctacccaggaggctgagacaggaggatcgtttgagcctagcaatttaggtctactgtgcaccatgattgcaccggtgaataaccactgcactccagcctgggcaaaagagcaagaccccatttctttaaaaatttatttattttttgagacagagtcttgctctgttgttcaggctggagtgcagtagggccacctcagctcactgcaactccagcctaggcgacagagcgagactctgtctcaaaaacaaaaacaaaaacaaaacattaccaacaaccagtagctgaacttgtttttagtcatacgagagttagtgggtttcatctgaatcaagagactcatgcctaattacataaaaactaccatctagatgtccttctcactttaggcatttatttttccacttattttccaataggattgtaaactttccga

SEQ ID NO: 157809 - DNA, 180 bp, Homo sapiens
aaacagttcagactaaaataaacaaatcattatctgcttgataaatcttcttggctaaaaccaatgtaagtgggaagaaagccacatgtagattgtagtttgaagaataaaatggtgaaaagggatggggcatggtggctcacttctctaatcccagcactttggtaggctgaggagggc

SEQ ID NO: 157810 - DNA, 299 bp, Homo sapiens
tctagttcttcaaggacaaaatccagaaaacttagctaagaccatgagccccttcattagccaacccttgcccatctttcatgtctcatttcttgtcatccacctgcaccacttttactctggccacactaacatgctaggctttcttttcctctttattctcctatgtacatatatttaaaataaatttccccatctcccatcctttaaaattcatctcaggcactgtttcctcttggagccctcctggacctccaaggttagcaccatccatgctcccagagcaccgtaggtttgcc

SEQ ID NO: 157811 - DNA, 461 bp, Homo sapiens
tgcagagagattaagtaactcgctacaagaagtcctcaaaccatttcatccctgcccatgagcctgtgcctttgactcaacaccttatttggggctctccagggatcagagatctgtgaactctcaatcccacaggatgcacttgcagacacagtactggcacagaagcattggccacccaggctagaacaggcctgcctcaaaagtcacagagtccgaaccagaatgtcatccttgactcttctgctcctcatttgtccagcgcctgctcacacctctgatgatggagagctcactacctttctaagataaagcttccattcttggcccagcctggctgcttctgaaagccatatgttgcattcagccataatctgcctcctgcagcttcctttaaccagccccagctcttcctccagaggccacagagatcttacctgctgctgaagaacagttcatct

SEQ ID NO: 157812 - DNA, 432 bp, Homo sapiens
accacaggtatgtgccaccatgcccggccaattttgtttatttttttgtagaggcggggtctccctatgttgcccaggctagaactcctggactcaagcaatcctcccacctcagcttcccaaagtgttgggattacagacgtgagccaacacgcctaacttagttacaatattttaaacttacgatgtatttatcaagatgtagccccatcatatgttgaggagcatctgtatattctcaatatatttcttttctctggcgagaccccagttcctaaaatgacccaaccttcttatttaccaacgggcaacttggggagaggatgttgaatttgacctctggcccctaactcagggttctctaaagtagaatttgggcttcgtgaactacagtgtgttttaaaagtccagcggaagttgctcctcatcccc

SEQ ID NO: 157813 - DNA, 406 bp, Homo sapiens
tgtcaattaatgaatcagcctacatgtggcttaaaaaaaaaggtgaaataataaagtaattaaattttaaaaagaagagaagagttattaaaccttgcaacctagtcccgttgaacacaattatggctctgaagcagaccttcccattgaatgggtgaagaaacctagtgagagctcattaaaagctgatgtaaactcaatacccagcctctggtgttcagtgaggacagcactcatagatgatgggttctttctttctttttctttttcttttcttttcttttttctctcctctctcccctctctcttctctctcatccagactgggtctctgttgcccaggctggagtacagtggcacaaccatagctcactgtaacctcaaatatcctgggctcaagtaattc

SEQ ID NO: 157814 - DNA, 185 bp, Homo sapiens
ttcagtggattggagtgggtttgatttaaagtatttcaagtctctttactattaaatataaagctaatttttaagattcagattttgaaggattgtaagagacccaaaagattgccttattgagttgaggaagttccctttattcctaagtttgctgactgtttttattgtgattgggtgttgga

SEQ ID NO: 157815 - DNA, 446 bp, Homo sapiens
caagctctcaccatggagaggacacactcccacctgaacagtgtacccgaactctcactgtggagaggacactctgccacctgaatagtccacccaagctctcaccgtggagaggacactctgccacctgcatagtgtacgcaagctctcactgtggagaggacactctgccacctgaatagtgcacccaggttctaactgtggagaggacactctcccacctgaatagtgcacccaggttcttaccgtggagaggatactctgccacctgaatggtacacccaagctctcaccatgaggagacactctcccacctgatcagctagacaggcagagctgtgggcagtccctcttgcctttcactgtgccatttctcttctcccttccctgggagtggaggtgttcctgcatgatctgctgctgcagggcaggggacggcagcttga

SEQ ID NO: 157816 - DNA, 286 bp, Homo sapiens
ctcgccgcggaacgggaatttcgggactcgtctacaaggggagccaggatacagagcgtgacaccaggaggggtcctggggcgatattgggaagcactcacagacagcggagtcgatggcaatgaggccttgaactgcgagaggattgtgggtgagaaggaggagcagggaattatttataaaaggaatagatagggatgaggtatccggagggtgatcaggaagtgtacctgggagatttacgggggtaaggaggagccagtatagtgatgagaccgtctagggt

SEQ ID NO: 157817 - DNA, 497 bp, Homo sapiens
aagcgagtctcctgcctcagcctcccgagtagctgggactacaggcacctgccaccatgcccggctaattttttgtattttcagtagagacggggtttcactgtgttagccaggatggtctcaatctcctgacctcatgatccgcccgcgtcggcctcttaaagtgcttcttttcgaaagcagctccaccagcaaaaggtaggaggaaagcgaggaaaccattcctcgcttggttaactcttgggtgaaaggacgccaaatgagatgatctaagaagcctcaaagaaagacagacaggcacagaaaaatcacagcaactctttggactgcaaacaccaacaccacagtccaacctaccagaaatcctgtggttaattggaggcttgccccgctagtcatgagatgattcagtgatcgctacaaacgctcctcacatgcatcctggacctggcacacctggcttgcccatcaccagcctggagacaccgccaggagca

SEQ ID NO: 157818 - DNA, 428 bp, Homo sapiens
gctatccgagcggacctgcgctatgcatcggcaccgtcgctatgcatcggcacctcgctattcatcggcacctgagacctgagactaagtaggaattactagagacagaaagagaaaacccatccagcagggaaaacagcttgtgcaaaggccctgtggctagagtatgggaagagaaaggaaaaatagtctgagatgtggctggagaggcaggcaggggccccatgatgtaggggcttgtgggtcacgtagagagcatggccttaaactctgctggattttctggcaggggatgacataagatgacttgtgggtaggccagtctgaggctggggaggtggcagggcaaatggagaagcatgtgtggacttaagagaggttgggaaggtatgtttgagtggacttggagtggccgtgagagggaggaa

SEQ ID NO: 157819 - DNA, 427 bp, Homo sapiens
gtagcaggagtaacatgactgagtttgaggaggaggtcagagaagctttccctgaagaagtcatgtttaaatgagacctgagactaagtaggaattactagagacagaaagagaaaacccatccagcagggaaaacagcttgtgcaaaggccctgtggctagagtatgggaagagaaaggaaaaatagtctgagatgtggctggagaggcaggcaggggccccatgatgtaggggcttgtgggtcacgtagagagcatggccttaaactctgctggattttctggcaggggatgacataagatgacttgtgggtaggccagtctgaggctggggaggtggcagggcaaatggagaagcatgtgtggacttaagagaggttgggaaggtatgtttgagtggacttggagtggccgtgagagggaggaa

SEQ ID NO: 157820 - DNA, 371 bp, Homo sapiens
gtaaaatctgtcaatccattatctacattcataattacaatattatgaatacaaatgaatctttttagcatgattcttatgttctgaacatataatctgtcaaagtgacctcattccctggtagataaactatacaagtcttactccaaaacagatggggcttccttcaggatctgactctagcctatgtttcctgtgactccccaccgcagactctaagctctagccttataaattattttcatttgctgggtattttgtgtctttctcatccctgtagcttttcccatagagtcagagtggtttttcagactacaaatttcatggttccacttctctctctttttcaatccttcaatgtcttcattgag

SEQ ID NO: 157821 - DNA, 331 bp, Homo sapiens
acgctgtctctttcttgccgtgtattattaaggtcacacgtggagattctgggcaattacagatagtgccttctcctcccacagaaatctccatgtcagacatgtagtagagaaaaatctgaagggaagtactgaaggtctaccaaaacttttcaagccatcagagaatgtccttttatgtactttcgtcagtcactgtcattcagatgcataagtagccagctgatggaaaaaatacacagctgggttggggaattctgagtttcaggattttgactaactggctcaaattcaatgcgttttgtcaccaatactggagatagtctccagc

SEQ ID NO: 157822 - DNA, 416 bp, Homo sapiens
aggaaaatgaatttcatactccagtagtgttaccaaactacatttccccatcatggtagcctaagccaggaagtggagaaaagagaaggatgtcattaagtggaaaataatcaggtaatttactcactctctacattttcccagaaagattgtcaatatttcttcagcaaacattattatgcacctgctaagtgccagcttctcttctcctttctacagataaaaagataatttagacatgattcttgccctcaaggacatgcataaaaaggtactctcttctcactgaaaaatgtgttcccactttcacttaaacctaggaaagttaaaaccacccccaggaggtttctttatattgtctgcagtcttttctcctgaatattttctttccagtattctggtcacaaagcagacag

SEQ ID NO: 157823 - DNA, 235 bp, Homo sapiens
ccatgcccagctagtttttgtatttttagtagagatggtgtttcaccatgttggccaggctggtctcgaactcctgacctcaaatgatccacccacctcggccttctaaattgctgagattacaggcatgagccaccgcacccgcctactctgattctttaatactggaaatgagagatggttaacatgacttctttcttgtcaacaaattgttaatgacttacagttgtattgt

SEQ ID NO: 157824 - DNA, 437 bp, Homo sapiens
attttgtcacttgtagtcaaaatccacccataagtggaaaaataacgaaaaatgaggaaagaaaaggcaaaacagtaaaagaaaagatagaaaagatatgactgtgagacagaaaagtagcaggaggttctcttgaaagaaaaataaagggtaaatttaaaaagaaatttaatagtcaacttgaaaatgaatacaatttttattcttaaccatctgcattcatctgtgtgccataatttattcaaatgtttttaaatgcctgtgaaataacagttaacactgttttataaagatgtggtcatttaattttgggaagaaggtggtgaagcttggaggagtaaacacaatctgaattagtgaatgtgaatttccacgggataggtctgttcactctgtggacattctcttctgggttttctgagacaaaacacattttt

SEQ ID NO: 157825 - DNA, 311 bp, Homo sapiens
ataacctccatggctagtaaacacaaatgtgtacatacacatatacacatatacgtatgcacataaatactttgctcccacaaactgatttcgtttttatttgccatgttttcagttcactaaatgcaatcatattttaaagataattaatgaatccaaaagttgaatctaggtattctgatgactatttatgtaacaagttagaaaagggtccccaatttttaagtagcacataccataaaacttcgttttaacttctacgtagccattaaaaaaaaaatgagatcatgttttttgcgagaacatggatg

SEQ ID NO: 157826 - DNA, 175 bp, Homo sapiens
ctaggtagaccttattattatgtttatccctattttgtattgttgaggaactgaggcatagacaggttaaatgacttgtccaatgattacagctaataaatggcagagttggaattctaactcagacaatctggttccagagtttatgctcataatcactaaataaataagatag

SEQ ID NO: 157827 - DNA, 405 bp, Homo sapiens
tttctttttccggaaagtctaaactagcatttagctcgtcctgattagagtcaggcaccgccaaggcatgggttggcatcttccagatcccgctcccccaaccgcggccacagcagatctggaggaccgggagaggacgcaaggaggaaaagccctgctctgcgagctgacagccggactctgcccacattgccaatggaaccacgtcttcaagccggaaactcagctggacctctcgcagcgctctctgcgagggggcacaggggttattttctccgatgttgtccacacccagaaaagcttgtctctcggggctactgtgctgagccccgactggtcaggttaggccaccggggttagctctgcaactcttgcttcacggttaacagcccggagagctttctt

SEQ ID NO: 157828 - DNA, 507 bp, Homo sapiens
tagaggccatggatggtggttcacgcctgtaattccaagactctggaatgctgaagcgggtagatcacttgaggtcaggagttcaagaccagcctggccagcatgaccccgtctctactaaaaatataaaaattagccggctgtggtggcgcgggcttgtaatcccagctactcaagaggctgaggcagaagaatcgcttgaattggggtggcggggcagacaccctgggagacagagcgagactccatcacaaaaaaaagcatgttagagttaatacggtgctgaatcatataggtgaagaagctaaagccttatacatataagtggggtgttgtgactcaaggttagataactatttagaattggagttgagattgagatccagtattgtttctacttatgattgagagtatgacagcatgaaattttatgaatgtctttgttctcaaattttgctggatctggaataaagatggaatatttcaagttctgaaaagttctaaaat

SEQ ID NO: 157829 - DNA, 394 bp, Homo sapiens
aagctgtacccctgagaagctgagaagtaagttggataccacctgcctcaactgggagcgatccacagctcaacaaggccatatactgcactcagtgcaggctcagctcattatttctgtgtggcatcctccgtggaggtgggctgagcaaaggacaccctgaaggacgtcagccaaacacagacacaccagtcacagggaagcacttgaaacacaagctatatttcattcagttctaaggtatggaggctcctctggctagcagaaactcaccagctctttgagatgagtgttctacccaagacacatgctaattaactccatgctcctcacatatgcacagctcttgtttatagtgtgggtgatacagagagatcagctttgaaggcacaca

SEQ ID NO: 157830 - DNA, 533 bp, Homo sapiens
agtaataaacaagattacaagaagataaacaagattaaaatgaaattatttcttactccaaatcaggattttccgccgtgtttgcagcagcgactctgagggaaatgtggcctgcaaagagtttactgtcatggtgccagtttcgtgtttgtccagtgataaatcagtggatttatgggtttaattacctcttattgccaactcccttcctatctgaatatacgaatttaaaagttaggatgtgtatctacaggtagtaaaataccattttgttctttctcagtggctgaatcctgcatggaatgaaaatcaaaggaaaatcttaaagatgcgtcagtgcattacgctgtagagattcatgtgcagaagactagctggctatgcactagttctgtcctgggaagggcttcgttctaacaattgttttctctggaaggtgatgggtgactccgtcttttcagatcacatccacacccatggtagctgccccagcattttggtctggctcctccaactttttttttttttttttt

SEQ ID NO: 157831 - DNA, 614 bp, Homo sapiens
tcttgaacacgttatatgaagtaaaataagccagtaacaaaaagacaaatactatatgattgcacttacatgaggtacctaagacaatcggatccatagagacagaaagttgaatggtggttgccaggagctccggggagcaggaatggggggtcagtgccaggagctccggggagcaggaatggggggtcagtgacgaatgggcacagagtttccgttggggaagataagaaagttctggagatggacaacggtgatggttgtacaacaatatgaaggtacctaatgccactgaactcttaaaaatggttttaaaatggtaaatttggccaggcacggtggctcacgcctgtaattccagcactttgggaggccaaggcaggcggatcacttgaggccagaagttcgagaccagcctgggggagatcccatctctacaaaaactaaaaaactagctgagcatggtggtgcattcctgtagtcccaggtacttgggaggctgaggcaggaagatcacttgagcacttgagcccagaaggttgagcctgcagtgaagcatgatcgtgccagtgcactccaggctggacgaaagggcaggaccctgtctgtgaaaa

SEQ ID NO: 157832 - DNA, 531 bp, Homo sapiens
gcacctagggagatagaatcaggaatcaggctctttgtttccattgcccacaagagtgctcaaaagccatttgtggaggtgggctgtgttttcagaggccctgtcaatagttaagatctgtacatgtcagaggccatgcatgccacctagactagggggcctttcacctctttgccatctctgataggttggaagaagcttgactgctggagtactgatcagtgggtgggcatatgcactcgattagccacgcctgccatggccagggcatgggggtggcagcatgcttactgtctgttgccatctcttcagcttataccaccaactgagatgatgacgatgcctggagactcttatttcaggcattttgaaaaaaggagacataacttctgtccctgggaaaattttaaccccatcagaaaggcagaatatatgcacaaggaggccttaatgcctaaagaatctcaacaatctcaattagcattagcattattagcataatttagtaataaccacccattacactctatc

SEQ ID NO: 157833 - DNA, 269 bp, Homo sapiens
ccacccactaggcttctggtatacacagacagatctgaatcccagtggtggaaacaacctaggctgattctgagtttcccactgcatttcttcttctaattgtccctcttttccattcctgtcctttccctcatcccttacctgctgaaaatgaatcttaccatttctaaaattccactcttccgggggcatccacagctggatcctcttcttcactgccattcctcaggccttagaacaggtccccttcttacacccacccatcggcg

SEQ ID NO: 157834 - DNA, 202 bp, Homo sapiens
tgtattccctgccataacatcttttgccacctatagctacttgaagtatggtcttggagcctgttgtacatttaagaataaattttcatttaaaaaaaaaaaaaaaaagtggttgggtactgtggctcaggccaggcgcatggctcatgcctgaaatctcagcactttgggaggctgaggtgggtggatcacctgaggtcag

SEQ ID NO: 157835 - DNA, 411 bp, Homo sapiens
gtggttgctacagtagttttaaacgccctttaaaataaagtcaaaaatactgaatgtcataaattccatctgtgctgccctctgctggctacatgaaaagattgttaaaagattgacatagaaattgcaccaaaaaattccattacctggctgggcgcagtggctcacccctgtaatcccggcgctttgggaggccgaggcgggtggatcacaaggtcaagagatctagaccatcttggccaacatggtgaaaccccgtctctactgaaaatacaaaaattagccaggcatggtggcacacacttgtagtcccagctactcgggaggctgaggcaagagaattgcttcaatccaggaggcagaggttgcagtgagccgacattgtgctactgcactccagcctgccaacag

SEQ ID NO: 157836 - DNA, 275 bp, Homo sapiens
aagattattcctgtttatttttatttctaatctttcaggacagctgccacttcccaagggcttaatatcttttcctactaggttctaccaatcacttttacaaagagaatggactccattccacaaggctcctaggaacccccacagtccaaatgtggttctgccaacccttacatagaccctctagtttcatctataaaaatgatcagcctgaacttcttattgaaaaaattcttatcttataaacttctgtttatggtcatgaatatgcttca

SEQ ID NO: 157837 - DNA, 444 bp, Homo sapiens
gaggtatttgactctatttgaaatcccacatgagcactttatttcaaagctgaaataattggtctaaaataatttggtctttatattctttatacacctttatactcttaaaaattttactgaggatacaatagagcttttgtttacatcagagtttctcatccttgacactactgacattttggaccaaataattatttgttgcggaggttgtcctatgtattatatttagtagcatctttggtcttgacccacttagatgccagtagcaccctcccaatcaaaattatcagttgggcatggtggctcatgcctgtaatcccaacattttgggaggctgaggtgggaggattgcttgagcccaggagttcaaggctgtagtaagctatgatcatgccactgcactccagcctgggcaacagagcaagactcttatctctaaaa

SEQ ID NO: 157838 - DNA, 104 bp, Homo sapiens
aaagcagttctaagaggcaagtttatagcaataagtgcctaaattaagaaaaaattaagactgcaaataacctaacttttgatctgaaagaactagagaagaaa

SEQ ID NO: 157839 - DNA, 532 bp, Homo sapiens
aagcagacttcaaaaagaattaaaccaaaatgccatttcttatcaattatttggcaaaaaaaaccctcctaaaatattgacaatatactctgttggcaaggctgtggggaagtgggtactttacacattattggtgggcatgcaaaatgatacaaacactatcaacatctatgtcttactgtcttcccattaaacgaagaccaggcctatacatattagagccaaattctattaaactttcaaggaacagattatttcaaatgtctagaaagtttttctgattaaaaagaaggaagtattatccaaaatgattaagcaggtaaacatgactttgaattaaaattagacaaagaccgtatagaaaaaaaatagactatcactcataaacatagattcaaaacaatcacaagattttgacagaataaatatgaaaaagcataacatatcctgatgagatagaatttgttccagaattgcaagcttggcttattgcagacaaaacaaaaaacctactgagataattcacctcata

SEQ ID NO: 157840 - DNA, 556 bp, Homo sapiens
tcactttcctcactagcctcattaaactgctctttgttttctacacaggctgtgctttcttagttctttttgcttttcttcttctgagaatgcccattagcccttttatctctggcaaattcctattaattagtgtttagaaatgggagtatagttgtccctctgtatctgcaggttccacatgcattcagccaaccttgattgaaaatatgtggggaaaaaaggcaaaaaaaaaaggtaaaaataatacaaataaaaaatatagtgtaacaactgtttagatatcatttacattgtattcagtattataagtaatctggagatgatttaaactatacaggaagatgtgagtagcttatatgcaaatactgtgccattttatgtaagggaagggacttgaatatctgtgaattttggcatgggtgaggcgggggtaggggtcttggaaccaatcccttgcagatatcaagagatgattttatggcacagtgcctgggcttatagaatcaaaccacttgtgttccagtccttacttggatacctattaactatgtga

SEQ ID NO: 157841 - DNA, 380 bp, Homo sapiens
acatgctgaaagatgtctggtcaatgggatgcatgcccctttgtttcccttacttttctgtagggcttgactccggaaaaaagtcaacaccatgagtaaattattcatgagcactgtctggccttccaatcggccaagaagcccaggacaaaagaatgaatagtcttctttttttccccttgggagaactgacttgatgactgcctccttcccagcctactcttcttggtttctgggccatggcaggttccagaccctccaaccaaaggcagagaggcaggcccttcccttgctgagtctcctaggaactgggcttctgttcctccacaaaatacaagtgaatacatctgagaatcagggtcagaacacaagacggaatg

SEQ ID NO: 157842 - DNA, 721 bp, Homo sapiens
agtagatctgggatgggttgagagtctgcctttctaacaggcttttgggtgatgtcgatgctgctggtccagggaccatacctctactcagaaggcctaacactgtatgccactttggtgtgacaagatgaaacactttgagcttcctcaggatcttcctttcccatttgcccagatgttcttcctctggatcttttctgttttttgtattttttgttttttatttttctttgagacaggtcttactctgtcacccaggctgcagtgcagtggcatgatcacagctcactgtagccttgacctcctgggctcaagccatcctcccacctcagcctcctgagtagctgggactacaggcgcacaccaccacacctggctaatttttcatttttttgtagagatgaggtctcactatattgcccaggctggtctcaaactcctgggctcaagtgatcctcctaccttggcctaccacagtgctaggattacaggtgtgagccaccgcgcccagacttcctctagatctttactcggctgtcttcctttcattcctatctcagcaaaaacgtcaccacctagagaaactttgttttctcccatggcccaaatctaaagtagctcccattgcctgttttagctcttagaagacagcctctgagatgatcttgttttgtatttctctctgtctctatgagaagaggagttctgcgagaacaaagcc

SEQ ID NO: 157843 - DNA, 131 bp, Homo sapiens
aacctcagggggttatatcgcaggggctaacacccagaacagcccagctgaatgccagttgctttggaagtactgattaacacagagatgaagctgcctcctttgcctccaaccagataggaacgattttg

SEQ ID NO: 157844 - DNA, 716 bp, Homo sapiens
aggaaagagttctgtggaaacaacccaaatatggagccatcttcaaacataaagatacctgacccagcatcgtttataactctaaaataaacaaagctaaatttttctccatcagggaatgataaattatccactagatcatttattattaagtctctaaaatgaatgaagtggcataaatatgcttataacatcagtggttaaaaaaagcaagatacgacattatacaaattctacaaagtctgaagaattgtacaaatatatatatttgtactatatatacatgtatttgtacatatacacatatatatttgtacaaatatatatatattccttgccaaccctaagcatggaaaaaaatacaaaggcttggaaatacatgccttaaagaatgaatagttcttatatttgtgtgataggtccctgggtgatttattttcttatttttttctttttctgaatttttctcattttacttagttagactttattaccttcttggtcagcccacaaatttataaactaatttttaaaaaaacatttccaacatcactggttgaaaaataggttgttgtcagttgtttaatctgaaagaaattattgataaatatgctgaagtttctgttcaatggttttggccaaaatgaagtcttgatttcccatttctttgaaccattttaaggatcctatactatacttacataaatcatgccaaa

SEQ ID NO: 157845 - DNA, 304 bp, Homo sapiens
tcagttctcatgaagccttccccaatttgcagcacattcccctttgcacacttcttctcgcactgaaaaatgtccttgtctttcatttgtgtctatgtatccgatttctttgaggctgcaacacctctgtcagggtgtgggtggtgtgggtcccttgtggtattgcaagttccatactgggtgctcagaatgtttaatgagctcattgaataaaattggcacactagactaacgatataggaagctggtgaggccgggtgtggtggtctcatgcctgtaatcccagcactttgggaggctgaga

SEQ ID NO: 157846 - DNA, 571 bp, Homo sapiens
tgtagcgatgattccagatccagtcagactgcttccttagttccgtgggtgaccccggaccccgcactcagtctggaggtgtggagcctgggggcccagggagatgctgggcggccaaattcagcaggcaagagcctgctagaggaacctcactggtgcccctgggtaaggaggttgacgcggttggtctcgtgatgttctgaagagacaacgcggcccgccaggttgctgaggactaacttagcaggagccaggggggctctgcttggtggggcaggagtccggtgtgagtctctgactcaggctactgacccggtgttgggacagagtgggggcgggtgtgatttggaaacgctagacagcctttgatctggtccttaccatggctcccttcaggctgtgtagatggcagagatggtgcatgggatctgggcaggagggtcccttgcaaaggcaggtgcaagggttctcacccccggcagagcctgtctccatagctgagtagaattcctgccctgatttcgggctgcccagctcgaggtccttcccaggagacgcctgtagccctccg

SEQ ID NO: 157847 - DNA, 169 bp, Homo sapiens
gagaagcactccccacttggagcagcgtgggaggtggcagacttccagccagagcaggtggagacccaacccagggcggtgtctcgggaggaacctggaagcctccactcaggacaccaggaacagctgaaccgaaagcgagaacgtcggcccttacccaagaatggta

SEQ ID NO: 157848 - DNA, 448 bp, Homo sapiens
taaaaagaaaactcatttcaattcttatggttgaactcaattaataggtctatactctacaaccacatagcttcaggcaagttatatacagctatttaaacctttcttttcctatattctatgaaattctgtctccactgagatggaattttttcattttacttttttttcagtgttgcaagtgaggactcttcattcctctagacctcagttttcttatatgtaaactactaaaaactacttcatatgctattgtgtaagtaaataagaacatatgtaaaagcatccactatagtgcctggtatacagcataaaagaatccaatctatctcctccctttcatttggataagtacaacagaggccaaacacccttttggtaactaaagagcttgcagtgtctttgcgatcctcccacttcagcctcccaaagtgctgggattacaagc

SEQ ID NO: 157849 - DNA, 657 bp, Homo sapiens
ggaggtgcaacgctccaatctctgcctccatcatagcacgagcttcttccttgtgtgtgtgtctcagtgttcaattgcacacactttataaagacatcagtcatcatggatttgtgccccacccgaaaccagtaggaccccattttaacttgcttccatctgcaaagaccctatttccaaataaggtcatattcacaggttatgtgtaggcatgaattttgaggagacactgttcagtcctagtacaagaactgatggtactattctcggtgggaggaaaggatcagatagcaggagggccaccctctcctcatcctcctgtcctgtgggctagccacgtctcagagctcaaggaggctgctgtgggaaatgggaatgtgcagggtaaggtgtgtgtgtcttggaggtacgtatggggtgaggtgtgtatggagcatgagaggtgtgtgcagctgtgtgtgtgtgtgtgtgtgtgtgcgcacgcgcgcacgcgtgtggacacacagcccagaaggagaccgggatggcgtgctgtgttctagcccactcattagctgctgttgtcagtatggctcccaggccttcctgggtaggagtccacatgctatagacaaagggaaacacggggttccctgtgtctgtatcgtgtgagagagg

SEQ ID NO: 157850 - DNA, 233 bp, Homo sapiens
cagctgatcttgtttccccctttacttaaaaaagatcaaggccacaaacccaaagtctcttgattccatctcagcattttacacccatttcacttccttcatcttccgcattaataaaagaagtgtccttcctctttttcaaagtagattccttcacttgtgtctggatcccttctgccgttgcttcaggattcaactttaaacctctacaaacactcaaagggtctcggaca

SEQ ID NO: 157851 - DNA, 557 bp, Homo sapiens
agaaaaataaatgttttccaggcctgcttgtgcatgactaagaaatttcctatcaacccagccaaatttaatctagctgcagctgagttcaagaaagttaatgcagctctgatgcctctagttctctcatttctcccaggtgggtcatcacagcttctaactaagaatcttaagtcaatccgtgattcctactaaagggcagaaaagtcctttggttccttcaatgccaagtaaatatttacatgcttgagcagtcggtgtaggttggtgagccctggactcacacagatccatgtggacctcacctcactaagcctcagctttgccagccgtgaagtgggaccaatagaaataaaaatcataccttaaatgtctagatttgtgcctggcctgtattgggcactgaataaagtgtatcgaatatttcagactgtccttttgttctgtgttgagttggtacagtagtttgttgcaacaaccctggaagtcaattgatactttcacctttgagataaagaatttgttctctaatcaactagcttttccattggcccaag

SEQ ID NO: 157852 - DNA, 458 bp, Homo sapiens
aaaaagttatataggtggtcttatttctgtcatattttaatatttctctttttaatgttttaatgttatttttgtctattttttttcttctgccttctattttggaaggcatcgtaacggcttttagttccaatatttacccataagttttcccaatgcattttgacttatttttttaatgtcaaagtcaaaaataaaatatctgtaatgtgtcacatacttaaggcaatgcgtttatcactttgatacctctcagctcccttattcctgtcttttcactctcttgaaatacagacatgaattagtattaatttttttgcttttactctataatgtttattctattcaattatattatgtcattatttgttagtttcacattatgtaaattatttgtcatgtcctatgtcatataaagtaattcaaaagcaaaaattaaaagtgtgtgttacgtgata

SEQ ID NO: 157853 - DNA, 618 bp, Homo sapiens
agcccacggctggagcgtccttctagggccttctgcctagcagtggctttgtgctaactctcccatcttccctcacagatcgccctttaccatcccctgatctggatctggagtcagccagtccttccccattttgtttataggctaatgcagggaatgtctgcagcttaaagcaggcctttgtggaggcagaatgccctcacctaacagagggagcctaagggttagggttctgggaaccgtgggagctgtgtgggggatgcaagacagcctggtggcatccgtgaatctaattacgtagtctacctggtgcaagagaagagtctctggagttagactggcttcatttctactgacaagctgtgcaaccctgagcaggttacttaacctctctgtgtttggttttctgttctataaattggggctatttatagtacatagcccagaaggctggtataaggatcaactaccatataaacaattaacccagtcccgaatacattgtaagtgcttaattaatataggataaataaaaagtaaaacatcattatacttttatgttcagtaacagccctctggggctgaccttgggctggcaaggatcatgccatcttattt

SEQ ID NO: 157854 - DNA, 561 bp, Homo sapiens
tcccaaagtgttcggattacaggcgtgagacaccacgcccgggctcaaatgttcatctctttcagaaataccctcagaggaacacccagaggaatgtttgactaactgtctgaacacattgcaacccagtcaagctgacacatagaattaaccctcacagaaccaataaggaagtggaagaaagtgcttcttttgctacaggatgaggtgggagcaggaattgtgagaggccccctggccaccatctccagtgtattgggttcagctcatttcctccccagcactgctactaatgttcaaggcattatttgttgaagccaggtgccgtctaagcaggctgtcgagggagagcaattttttttttgagacaggatctctttctgttgcccaggctggagtgcagtgacatgatcttggctcaccgcagcctcgacctcccaagtagctggaaccacaagtgatcctcaggtaatcaggtgattctttcacctcagcctcttgagtagctgggaccacaagtgtgtgccaccacacctggctaattttctttctttttaatag

SEQ ID NO: 157855 - DNA, 631 bp, Homo sapiens
agctcggtaccccacaccacctgagtccaatcattgtaacttcatcattcaacagttcaggtcaggtaggaggaacacaaaagtctccacactcaagtgcacacacacacacacacacacacacacccacacctgcttataatgtcctctcattcttaggttatgacccaatatcagaaaggggcaaaaataaattctgttcaaaatgtggcaggatttgaaacataattcatgatatcagctacataaatcataaaatcccaagtttgtcaattgcaaaatgtcctattaagcattaagctacaaattaggagtgccatcttgtggacacatccaccacttccacatcatgtcacctcctagccaactccgtggctgttctcactgtggaggtctctgccacaactccagcattttattgcagaagaaaacccagtccttgaactggtttctgcgtagaacacactgaaagccctgggagaggaaaccagcagacaggaaaagagtagacatggaagagcagatgagttcattgctggaaagctcgaattgttagtttcgttaatgtggggtccaatttgactctatggagcctaactacctagcctgagcgctcgcggtgagtatgggg

SEQ ID NO: 157856 - DNA, 245 bp, Homo sapiens
tctctacagactctgtctgtggggaggaagtgggccttcacataaataaattggatcattattaaggaaagagtgagaagggatgtggtggggattccttggagaagagagtgtggaagtgctgttaggatacagaagggcacatggagaggagagatccagggccatatctcagccacatcatctttgcagtcatttggttgttgcactgcaaggaggtcatctggaaacagctgcaccatcag

SEQ ID NO: 157857 - DNA, 382 bp, Homo sapiens
ctccatgttgaccaagatggtcttgatctcctgacctcgtgatccatacaccttggcctcccaaagtgctgggattacaggcgtgagccaccacacccagccgagttagtctttttggaaagggaaaggactttactcctctgcccctacccacctccaatacacaacacacttttacctgtttttattttgggccaggcacagtggcttacgtgcccagcactttgggtggccaaggtgttaccagatggaaagtcttgactgtgagttgtccaagttcttggtgccttgagcaaagaattgaacaaaacgcacaaagcaatggaagacgaaggcatagatttgttgaagtgaaagtacactccacagagtgggagcgggc

SEQ ID NO: 157858 - DNA, 126 bp, Homo sapiens
tgaggagaaaagcctcccatttcctatttatgaaagtgatattaaggtgtgtgtcacaatttcatcaagaagtggcttatgacaatacagctttggtttaggtattaaaataggactcttttctgc

SEQ ID NO: 157859 - DNA, 207 bp, Homo sapiens
  misc_feature (13)..(13): n is a, c, g, or t
ctctagctcggcncccccacctgagtctcctggaaatctggttggaaatccccggccaggttgcttcatactgctaagtttgacagacaggactgaccctctgagttgcttgagtggccttatgcctatcattaatcttatagccataatatatctcattgtataccacactccacccctgaccctgagggggtcaataattgagag

SEQ ID NO: 157860 - DNA, 356 bp, Homo sapiens
aagctcggtaccggagacacttacggtggatcaatgaatcagatgaagtatatcaccgaagaagtttgcttctttttgctttatttcccattacccccactgatcacattatttttctttaacaatcgttcaggtttagctcttcctcgccttgcccagaccactagcctagttctgaactctacgccatggacttcacacaaagcctcttggtcatttgtcctcttttctcacttccctttaccccctgagttcagccactcagttttcccaaattaccggctttgtcagggtgctcctgtgctaaagacagtacatcaagtggaaacttctgtcgtaagtgtctccggtttttc

SEQ ID NO: 157861 - DNA, 203 bp, Homo sapiens
attgatgttgctgttaaagtaaaaatgtccatgggcccttaaagcaagaacgggagctgtgtgaggacagggataaatatgtaggtttgggactgaccacttttagaggtttgggagtaggaagaacaggagactccaggaaggaaatatgaaataaacttttaaggaggcagttgaaagcaggggcaggaaatcctaagagg

SEQ ID NO: 157862 - DNA, 410 bp, Homo sapiens
atatgtgtgactccagagcccaagctgtaaatcactgtattactttatatgtgtgagttaatttcatcctaccaactctctttgaaagaagtgatggttttcccctttataaataagaaaatagaggcccaaaggggttatgtggcttggccaaggtcacattgctgaagcatgaccaaccaggaagagaatccctagaaaggatgtacaattgctggggtctgtagctgcaagttctcactagaagagaacccttctcaataggatagaggggaaaggctgttgtcctgtgtaaaggcagggaccatcatgtcagctgattgcccagtttctggcatagcatctggtacatgctgagcacctgaaaactttggaaggaagagagggaatgaggaaaggcaatgctgacc

SEQ ID NO: 157863 - DNA, 634 bp, Homo sapiens
tcccttcccagttatgacaataaaaaatgtctccagacattgtcaattgaccagtcctagctggtcaaaatctcctctggttgagaactactgccttgcaagaattattgaagttgtcacttgtggaaaatttgcttgcagggacaaatctttccctgcaactcgtctgtctatgctctgctagcatatcaatcaaatctttgtgaggtgttggtggtggtgcggggcagctgattgaggttccttttcagtggaaagttgtgagtggttgtactgaagaaatggtacatgccaccacacacacacacacacacacacacacacacacacatatctttgtctaagtctgaacaatcatgtgacgtacacttttcttagagggatcacaagagagattatggaaagagtgccaaagtaaccatctctgtcaagccatccaaattctccacccaccaggcagtggtggctcacgcctgtaatcccagcactttgggaggcaaggcaggaggatcgcttgaacccaggagttcaagactagcttgggcaacgtattgagaccactgtctctacaaaaacaaaaatttttttaattagccagttgtggtggcatgcgtctgtagtcccagctactcag

SEQ ID NO: 157864 - DNA, 142 bp, Homo sapiens
taagttcaaacataaagttaatttatcaacattcaaagatacaaacagatacccaaagaattgtccacatttatttgtgagtggtaaatcatagcctttcttaaaggaaacagaaaattagaattagtcctttaaatgggct

SEQ ID NO: 157865 - DNA, 281 bp, Homo sapiens
cccttaaattgccaaactaaaataattttatacctttaaataaaaataccagaagttttccagaaacaattttttccttagctagactgtaggagtcacataaaataactgactggagaaatccttctgcaaagcgaaagaaagtagtgtgaagaattcatctgttactcctcttgagattaaggatagagagcattaaggatcagagagcattcaaggcatggcagcagcattcaaggatagcagcagcattcaaggcataacagcagcattaaggctca

SEQ ID NO: 157866 - DNA, 295 bp, Homo sapiens
ctttctaccccagagccacctagaccatccatcagaggcctccctctaatgaggagtagggtgggggcaccccatggtgtcctttgtgccctaaaccctttacaataacaggtgttggctgtcacctgaagcaggtttcaaccatcactcccttcccaccatacacacactcccagctcattttgattccttttcctgcaataaataacagattcttgcaaagtggttagaagaaattagtaagttaagcctcacactagggttattttgccaggagaccttcctttcctaggta

SEQ ID NO: 157867 - DNA, 406 bp, Homo sapiens
tcatgctcacctgctgttctctgcactccaccagccgcctttcaggccatcaggcagcctggaatccactatcagcctcaggagtctaaaaagcacatcagaccttggtaacccttcttgtccaaactgtcaaacaaaacctgccctgcgcttttgcacctgacttacagttagccagctgagtcctgctggccagctcccactgccagccccctttcagaatgtcacctcaccccacggtgcttcaggcagagctcatgacaggctcctcatggcctccctgcatctccctaacagcactcaccctgccctggagccgtcagtcctgccggtgggactctgcccgccgcctgcgagacgacgtgagtgtgttcacttttatacacacccagaagtggccctagtg

SEQ ID NO: 157868 - DNA, 405 bp, Homo sapiens
tgggtcgaggccagggatgctgcttagcaccctgcagtgcccaggacagcccctccccagggaacgagccagccccaatgtctacagtgctgaggctgagaaacctgtattaattatgtagaaaaaaattgaggctgagtgtggtggctcacacctgtaatcccagcactttgggaggccaaggctggaggatcgcttgagcctagtagtttgataacatagggaaaccctgtctctacaaaaaaataccaaattagctgcatgtggtggcgtgtgcctgtagtcccagctactcgagaggctgaggttgggaggatcgcttgagcccaggaggtcaaggctgcagtaagctatgattgcaccagtgcactccagtctgggcaacagcgtgagaccctatctcaa

SEQ ID NO: 157869 - DNA, 334 bp, Homo sapiens
atacactgaaattgtttatcccaaatggcattaatgcccttacattttgatatttagatctgcctcaaaagacctttgaagctacatgataaacttcatgcctacaaagcttgagttagaggttatctttgttaaaataatactgtttggatgctcagttttggaagtttcctcataattctaaattaagatatttagccgtaagagtaatacacttatgtgtatgattctatagcacttgttctatagcacttgtacaagcataatgatcttgagtggaacaggctttataatgagcaagctatgatctgtctaacagcgatactctgcaaac

SEQ ID NO: 157870 - DNA, 315 bp, Homo sapiens
cagacagagagaaaaagggagaaggtgagaatacatgcatgctgtgtgcatatgaatgaaaaagatgagtaagaattatttttccagtcctctccctcaccagggtgtgaggctgttacacccaggaaatcctagagcacactcaggacacacacacactgtacgtgctacttttcaccctgagacacatcaagtccatgctcagtgtaaactagcacacacatgcctggaagcatccctgccacctcacagacactgtacgcacatgtgcacacccaggcacacatgcatacatgcctgacaaacacagatgca

SEQ ID NO: 157871 - DNA, 607 bp, Homo sapiens
actctaaaattacctacgatcgtgttatcccaatggtataacatgtcaatggcttacaatgtatcatttattttcataatccatccttcatgaaaaatattacctaaagtgtttaccataaaagtgagtgaaacctaaggcaaagaaaaataacaaaaatagaattaaagagaaatgactcagaggatggaagacattgatttaggaagaatgaatgaaggagttataggaggatcctataatgttaagttgttacatcttgctaaaggccaagctcattctgcatatgtgaagagttgattgcattatttacatagatgtatcctgggatttgaacaaagttgtaagtcagtatagaggaagttgggcattccagggtgagcctattagcgtactccagagtagaaatattggaatggtctcatacagaagagagagaatataggataattcgtcattgatgacttcctctgaattaggatatatttataatactgtttttaaaccagataaaactagagaaaatctcaagtaattagtcaatttattgtattccccatctttcttctctgaaacattccctaggtatacagtagtgcaaatataa

SEQ ID NO: 157872 - DNA, 515 bp, Homo sapiens
aaaaaaaaggtcaatgtaaataattctaagtatagtaggccaatcttagtgtagggatctcaaacatctgagtgtggaagaatcaccaagaagccttgttgaaaatacagatctgtaggttcgaactcagcaagtctgtagtatgcttggtgttctgtactttaatgagtgtcccagatgattctgataccagacacttatgggccactctttgagatacagtcagagatttttggatacacaggaagcagagcgagtgattcagaagcagctgcagagtccatggccatgtctggcggggcccaggaaggaacgtgtatgcagtagagtgtctgggagagggagacgggagacagcaatggtggggtccacatgccaggtggggataacaagaagcaccccccaccacggaataccaagttcagcctggaaagaaagaaggggatggtgggctggggcagaaggatctgtctgtcttacgaggtcttagcttatttgcagacaggaagaatcta

SEQ ID NO: 157873 - DNA, 209 bp, Homo sapiens
gcggccctcctcaagactattgagaagtagccttttcctgcagaccgcgcccttctagggaggaaaccaagcatgggggcaggagaggctggaggctcagcagtccttccacatctttctgagtcagacactggactgtcacaagtctgggcaacagaggtgcagttacccccattttacaagtgaggatgaaaacgtccagaagagaa

SEQ ID NO: 157874 - DNA, 491 bp, Homo sapiens
tgtaaattagcatattgtaatttttttctacacatcccccattcataagcagtcagaaaggtgtattagcatgggactgccattcagttagtggtctgctgggaagatcatcagcctgtggctttctagcatgtatgtacaagctaaaattttctttcttaaagcatcagaaagctttccaagtagctgagtcacacctcttataagatctcaccctacatttgaagtgcccagtagtttcaaggaaactttacagaatctctggacttgtcagtcctcttccagaatactgggccctttgagtccatttttatctaccaaaatgtttcttccccctcttatccaacaggtttttaatgatgcaaacaggggaactgtttattataaagcaccttaaagagaaatgaacagtaatgctgactgagctaatcattgttttcttttattacagaacacaaaaactatattttaataatatacctgggtaacta

SEQ ID NO: 157875 - DNA, 673 bp, Homo sapiens
gcagctgttattaagattgagataatgtctcaaagccgtgcattacattctcagctattaagaaactgccgaggacagtatcttatatgtagtaaatgctccgaattggaagtctcattaataagagcactctccattcaattgcagcagaagtcttaccatcacagtgttttgctcacattaatccaccaaacacctctgggaagtgggcacccatctcctttggagaggtttctgccaagacacattttattacaatgaaaagggagatgaaaacagccgcttatacctgttttaactgtaattgaccttcagccaccattttgctgcatcagattcgagagcttctaaagcttccaccctgcttcatgttgaggtgtgaatttgtcaccttaggagcctgttgtcacagtctttaggatgtatttatgtgctctgatcttctggcctcctgacactaaatataactctttcttattggtactcagctgatatacacaactcaggctctttttgtgaatgtttgctgaatgagagatttgttaacacctactgtattctcagctctgagaatattaaacctctaagatacaatgcaagcctctgagagcaaacagtcttctctgtgctatcaaaaagctaagaacttggtcattagggaaatgcaaatcaa

SEQ ID NO: 157876 - DNA, 351 bp, Homo sapiens
ggaagtcgagattgcagtgagccgtgatcatgccactgcagtccagcctaggcgagagggtgacgccctgtctcaaaaaaataaaccaataaaaatttaaaaacatgcatcaacaagggactggctcaggaagttactgttaggttcatatcacaggacactgagagaggaggatggaacggcagctctgcaggtggtggcacggacagcgctgctctgctggtaagagacaaggattctcctttgcacagaaagaaccactgggcctaggtgtgcccagctgcacactgtatctgctaacgtctccttggcagtttctgtggtcacaagacaaaacattcactaactaat

SEQ ID NO: 157877 - DNA, 107 bp, Homo sapiens
cccctggaatgcattaaccagagtttctaatccataaacaacctctcctctcctagcaagagtcagagggtatgggcggctggggcgctgtttcctccacttcccca

SEQ ID NO: 157878 - DNA, 403 bp, Homo sapiens
tgggtttgcccaatttctatacattaacaaagaatttgaaatggagaccaggttgcggttttagaataagtcggagtatgttgtgctctttgtgatttgattaccatctgcagttgtttcttgtctagcaggattcatatgtcttctcacctgtgtttcttcgtctgcttttgtacacagtgttctttattttatgaggcagatgactttttaaaagaagactatatatagtacatacgttcttgtagtatggagttaagtaagttcccttccttccttctgtccgtatactttctttttcttgggttttgatcctccatgctaatgctgaacctgaaattcagcctgttctccttttcaacataaagtgtttctcatcctaagctttattgaagatgcctct

SEQ ID NO: 157879 - DNA, 443 bp, Homo sapiens
ggtgtctagagatcccctctggatgcagagtgccaagtgatgactgttgactagtgatcaggctgctccatccctcaagtactccgcctatactgcagagagaaggctgttgtgggcatggatcgccacacgtagggggatgatggtgaaagataagtagccatgcccatggccgaaaactttggtctattagggtcatagggatgacatgattgctcttaggagtctgtcttagactttcagtttttcctaattttgtttagtgatccattttaaaccttcttttaggaaaaccattttggttagtgtcttacaccctgaagagatggggggatggaaaggtaacaggctagggagtaaaggtcccatggtgttgcattgttagtttctttcctcatgcatctatgattagtgataactggaaacattcaaaacctgttcgt

SEQ ID NO: 157880 - DNA, 225 bp, Homo sapiens
tcatcctagagatgcgaccttgagctgctagaaatcatgttagtgttttgttcaaatctttataggtcaagattgaggctgagaaagggctccaaggagtctggctagagtttgatcaaggagaaaacctgtcaatggtgattactggttctatcagtgaaaaacaaccattatcaatatttgtattttcccttcaatgccaataataggacctacacactgacg

SEQ ID NO: 157881 - DNA, 347 bp, Homo sapiens
ctgagatcacgccactgcactccagcctgggcaacagagtaagactccgtctcagaaaaaaaatacaaaaaatacaaaaaacattagccacgtgtggtggtgggtgcctgtaatcccggctactcaggaggctgaggctggagaattgcttgaacccaggcggtggaggtcgcggtgagccaagattacgccattgcattccagcctgggtgacaagagtgaatctctgtctcaaaaaaaagaatgctcagtgaaattctgcaatacttaaaaattggaaaacaacccaaatttctatcagtaggatgatggttacataaatcatgctactgacattccatgactac

SEQ ID NO: 157882 - DNA, 172 bp, Homo sapiens
tcccctcaggaagagttttggaatctgtcttggcacacaggcaaaggagtgattagggccctgagtgtctacacttggctacagaaggcaagtttttagagatttatatccacatgcttgttttgggctctaaaaaagttaaatgaggctgagcacagttgctcacgcctga

SEQ ID NO: 157883 - DNA, 690 bp, Homo sapiens
aaaaagcaagggaggtggagagtgtgtgagagagggagtgagaaagggctcagccatttgtctgggcaggtctgcggaactcaaatccggctcatctgcatctcctcaaataaacttctgggaagtgaatgcctgaagcaggcagagtgcagagaagtcagcaaatatgtgcgtagtgaattccaagccttctgttcccagctcctgggaggggccgcagtgccttggggtgtcctgccgtgtctccatcgggtcccctgcctggctgctctaaccctgaggaatggcctccactgtgggcctgtggaaacagggagaagaatctcttatccagcaggtctgagggccacaggaacataagtaacactgaagagtgaggctgatccctggggtttgcgcgagcctgcaaatgcatgattcaacagcactcgcctggtgcctctgggaggcaagctggatgaggatgttgttcccattttatagatgaggaaactgaggctcattgggaagggactttcccaaggctatgttatgagttagttgcagagctttgaacttgggcccagactgagcctgaaacctgaccttacactgagtcccagccccagtccctgaacatggtctctgaacatggctcagattttgccccaaaagcatctggaccaggaggttggagcggcctgggatacc

SEQ ID NO: 157884 - DNA, 159 bp, Homo sapiens
acatggccttctagataggaatgtatttaattctgggagaagtattgaggataaagtgttggtattcgcatttgtatgggaatcctaaagtcattgacagtggaggctagctgctgcagaactggcagtcaagtcaatgaagtggagggtgaccaggga

SEQ ID NO: 157885 - DNA, 342 bp, Homo sapiens
ctctgaacaggggaattcacacacagactagcttagacagtgcaaggccagactgaaatactagtactttcacatcactgaaagttactggccagagatgagtaacttcttgtctttttttaacactgaaaaataaaaggtgattctgacaatataaaacaagcaaggttgagaatcaattaagtagaatcaaagtagatgggcctaaaagaaagctgaacatggcccaagaacagccttgtcactgcaagaaaatggaaatagtatgtgctaacacggtaagccaattgaagctttactgcttcccagctatttacttagtggattgtcctgtcaatatct

SEQ ID NO: 157886 - DNA, 486 bp, Homo sapiens
tagattggggtgggcaaactaccacccatgagccaaatccatcctgctcctgtttttataaataaagtttattgggacacagccatgcccattcatttacatattgcttaaggctgctttcatgctacaatggagttgagtagtttcacagagactgtctagtccacaaagcctaaaatattcactatcttgcccttcacagaaagagtttgctgattcttattctagataatgcattttttgaaaggaaaagccttgttttctattgatttagaaactacgacaatttaccttccatataagaccttgggaaagttacttcagctcaagtgataggaatttagtcatcttcaatttctgcaggatgcacttacactaggcatctggaacagtatcatgactgcaatggctggtgggtaacaagggaaacttttagccattcttctgagaacagtgaaaaactgtactaaaagtggacaaagggta

SEQ ID NO: 157887 - DNA, 1055 bp, Homo sapiens
cattttaacttcaaaattaaactatgtgctatgatttgaatatctgtcccctctaactcacattgacagaattcccaatgtggcagtattgagatgtgggacctttaagaggtgatagaattaggagggctctgccctcatgaatagattaattcaattacggattaatggattagtaaattatcatgagagaggaactggtggctttgtaagaattgagaaaactgagatatcacctaagatatcaccagtatgctcagccccctcactctgtgatagcctctatcaccccaggatgccccagagagtccccaccagcaagaagactctcaccagatgtaccgcctcaaccttaggcttcccagcctatgtaactctaagagataaatgtatttcttcttaagttacgcggttataggcattttgctacaagcagcagaaacagactaaagcaaaatgattacaattgcttacatgttattgaataaaatagaaacccatgagtccatacttgtatcaataaatagaaaaataaagatttaatgaaaattggaaatgtattaggctggtgcaaaattaatcggttttagtacaaaagccgtgattacttttgccccaacctaatacatagtttcaaggtatcttcccacaagtatttattaattataaaggaaaatagagtaactttacatggaagaagtgacagatacagctatttttctgagagatcaaattaaatattaccagtgttcatatacactgaaattctacatcatggttagcatgcaatgagaagaacatagcagcatttttgttatattattgccaaaccattagagtcagagtctaaccattagaaaatctaaaaaaaaaaaaaagaaaaaaaaagaaaaagctaagtgcatactcaaattgtttcccaaacctggaaatattctacaaaaacacttgttccatagttttagaaattatacagaataggaaagtcaaagtaatttcaaagaaaatgagacacatgacaactaaaagcaaacagttttattttgaactggata

SEQ ID NO: 157888 - DNA, 229 bp, Homo sapiens
tggaagagaagctgcgggcatgtggaagggagaggagagtccctgcaggaggagcaagcagtgtgcaagcatgtggggcagggagcacaggtagtgtgtgcacagtgtgtacacaaaacagtgagagatggggggggagtgggaaacacagccagtggcaatactggaggtctctgggtagcagatgaaagagtctagcctaattctttctttttctttcttttttttt

SEQ ID NO: 157889 - DNA, 166 bp, Homo sapiens
gcgagccgacagatccctgggagtggggggtgggacgaggcggggtggcttcccactgtgaccaggggctccctgggggatctggggctcccagccccccaccccacagccctgtgtccccgccctcccagctcccagggccattgatgtatcagtcctgtcttga

SEQ ID NO: 157890 - DNA, 565 bp, Homo sapiens
aggcttgcaagactgcattcctcgaacaagaggctctagatgtcaccatagataacctcagtaccagggagtgattgcctccagcaaaccttctgtcggcaggagcagtcgtgagtttgcccacatcctgcattcatgataaacagtttgctgtttgatcatatagcctccagtggaatgccgagttggtcatttcccatgggccttcggctccctgcaataaaactatgagcagtgattgaggacaggactggaggcaggctgggctcagatactgcaggttctggtagactgtgttagggaggcttttgttgttattactcattccaagtacaatgggcagcaattcagtgagcaaactgttatgtctgtcgaaatggcccatttttctgtgcttgaaaaagaaggaaaacagtcagaagcaagacactaggcttcctcgaaggaaggaggagagacgtggggcatcttatcctgggctccccaagaagcagaccttcagtcacggatttgagtgcaagtagtttatttcatgccaatcagtactgtaggggagtgtgaaccg

SEQ ID NO: 157891 - DNA, 571 bp, Homo sapiens
agtgcagccttcagtctgtggccaaaagcccgagagcccctggcaaaccactgatatagagtcaagtgtccaaaagctgaagaatttggagtctgatgttcaagggcaggaagcatccagcacaggagaaagacgaaggccagaggactcagcaagtctgatccttccaacttctgcctgctttattctagctgtgctggcagctgattagatggtgcccactcaggttgagggtgggtctgcctctcccagtccactgactcaaatattaatctgctttggcaacaccctcacagacacacctaggaacaatactttgcattcttcaatccaatcaagttgacactcaatattaaccatcacatatggatttacagaaatgttgcaaagaaaataaggaggattcctgtatatccttcatccattttcccttaatgttaacatcttacgtccatggcatgtttgtcacgactaagaaattaacatttttttgtatattatagaactttttcagatttcgccagtaatgcccctaaagtgctattctaggatttaatctaggatcctaaac

SEQ ID NO: 157892 - DNA, 398 bp, Homo sapiens
agtaacgttttaacacaattttacaatttttttttttgagacggagttttgctcttgttgcccaggctggagtgcagtggcacgatctcggctcactgcaacctctggctcccgggttcaagcgattctcctgcctcagtctcccgagtagctgggattacaggcatgcgccaccacgctcggctaattttgtatttttagtacagaaggggcttctctgttggtcaggctggtcgtgaactctcaacctcaggtgagccacccgcctgagcctcccaaagtgctgggattacaggtgtgagccaccacgcctggccttttttttgagacagagtctcgctctcgcccatgctgtactgcagtgacgcagtctgggctcactgtaacctccgcttccc

SEQ ID NO: 157893 - DNA, 266 bp, Homo sapiens
cccagctacccgggaggctgaggcaggagaattgcttgaacccgagaggcagaggttgtagtgagccgagattgcaccactgcactccagcctgggtgacacagcaagactctgtctaaaaaaaaaaaaagaaaatcagtgaatttcaaacatgagtgaccattctcccaggtgatggaaatttactcctcgtcataatgagagtgttcccctttctgacagcaagcagggagggctgtcatttagtgtcaaggcctccagaaagg

SEQ ID NO: 157894 - DNA, 246 bp, Homo sapiens
ccctgaaccaccatatggaagaccatcctatgtcagcatgaatgggaaacacattttccctgtgttaagccactttagttttgagattgttattggagcagtgaggactacagcagctgctgttgagagatgataggagcctaaatcagtgggtggaacagattcaagcaattttagggcaataccgtaattatcacttgacaatcaattccatgcaggatgtgacagagaggaaggcacatctag

SEQ ID NO: 157895 - DNA, 530 bp, Homo sapiens
aatcgagccggtcctgtttgagcctgctgagccagtacataagcttcatagaaaatttcagacatgcaatcataagatcaaagagtaaggtcctacacctttggccccaagccaaaaaacactactgaaaaaccattaccatttacttgctttaggaaaaaagccaagactacttagacctttcccacttgcagaaaaatttacatgtttctgaatatggatctaattttaagttccatcttaatgtgctctttctttcagaggtgaaacaactaatacatgtgcttctgagccacagcttaaaaaaaaaaaatctcctgatctcaatgtgtatcaacagccattaaaatatccacactcttggctgggcgtggtggctcacgtctgtaatcccaacactttgggaggccaagggtggatcacctgaggtcaggagtttgagaccagcctgaccaacatggagaaaccccatctctactaaaaatacaaaattagctgggcatggtggtgcatgcctgttatcccagcta

SEQ ID NO: 157896 - DNA, 234 bp, Homo sapiens
agatggttcccgctcacgcccacgtggactggtccaaggaaatcatggaggaatttggttccccagcaatgaaaggaagatgagaggaagtcaggagagtctacggcacagcgacagatggcgacttgggcactcaaggccaggctgacaagccgggagaggcttttaacgaagatggaggccggacatggtggctcacgcctgtagtcctagcactttgggaggtcaaggtgg

SEQ ID NO: 157897 - DNA, 111 bp, Homo sapiens
cctttaagaccatttagcagcaagaaaaagctagagaagccacatctgaactagaaaacacaaaggggcccaatgaaagtgcaaactagattttctcaaaaatgaccagaa

SEQ ID NO: 157898 - DNA, 167 bp, Homo sapiens
gtggatttggggatgtctgtgtgtagacagtcactaatggggtggagaactgaagagagccttgtgttcagggaaaccaagtcaggcttgagaaagtagaaggctgagtccttcaaggtagaagagcctgagctccagacataaaagggaaactggagacttgtttc

SEQ ID NO: 157899 - DNA, 302 bp, Homo sapiens
ttctttttcactataacaattaaaaataagtatatacaataaaaacaaaaactcctttcttctacatagagactcaattagccctttggtacatagttctgttttaaatctacattcctgattttaatctcacacaattaaaagtattaggaccacatttatggtcactggatttatgtaagattggggtttatatagaactaccttatttcaccataaacattttagggaatagtagtttaaacctcattttaatctgcaatgtgaattttcctattcttctatctcagtattgaattctc

SEQ ID NO: 157900 - DNA, 328 bp, Homo sapiens
acaatctcctttagggaaagaactgctttcaggaaaatattttaataagttacctgtaataaaagtgagaggcctttaaggaaggaaaaaaagaatatttatgctgcctctttatgggaaaacaagagggatttgtcacttattttttcctactgatggggagtggggctaaggaggaaagagagacaagagccagtgagctggtctgagttggggactgcgggaagtcatggtgggtgagtgataatattttaagcacagggacactcagagtttaatctgaagttccattgctgtgatgtaatccactctcttccttcccacatgt

SEQ ID NO: 157901 - DNA, 208 bp, Homo sapiens
gctatgaacaaatgtacttaaattcaacttttacagaaaataacagatccaagcactatttttgtggttggagtggagaggagggggaagagagacaggctacaaatatattagtgtctaaattatttcctgaatatgaatttattccacaaactagtgatttttttttaacattaggtttcatatacatttttaaagagttagggaa

SEQ ID NO: 157902 - DNA, 269 bp, Homo sapiens
agcatatgtttctttatttgtttcccttcatgttactttaaaaattgaattatctttttctgggaatatcagatatgctgttgttaacacgtttctccttggcaaaatgccattaacaaataaggcaaattataagagtatggtccacattgtccttccactgccctatagttccagcttagtccagtcctgctgtatattaaattagtagtagcttcagtagtgttttcttggtcaccaataaaacatgctccctttgtcttttccaa

SEQ ID NO: 157903 - DNA, 134 bp, Homo sapiens
tgctcacaacccactgagccttcttgggtgcttggtcaggccaaatcatgtccaggctggacaggtagcatcaatagctgtcacgatcctgttcaaatgacctggttattcctgttattgtacaccttgctgtt

SEQ ID NO: 157904 - DNA, 237 bp, Homo sapiens
cacatctgattagccccggccactctagtcacatctgaagagggctctggactgagcatgtacctaagtctagctctgccgggtgttatccagaaagatcagtcactgtgctttggagtccatgtcactgaagcactccttagatgaagcagaacccagatgactcttgtgtcaaggcaattccaagacaccatctcctgctcgcctgctgtataaacgaacctaacatagaacaaa

SEQ ID NO: 157905 - DNA, 768 bp, Homo sapiens
agtcagcagtgatcacgccactgcactccagcctgggcaacagagcgagggccctgtctccaaaacaaaaacaaaaacaaaaacaaaaaaatggtaagctctgtggagtgacgttagctaagagccatactattgtgtatatagggtctactaaatgtggctgtatcagacaggacttatggttatagttaccagagaacacttgtggtcataagttgtgaatggcacccagattcttcttgaatatctatcacatgtctatcagtaattctgaagtatgtaaaaatgaaacaaagatttatttgggagttagcactccagaagattagtgttaaaacagaacagcagaaggagttgtgacatgcatctataaacaattgtaatgatttgacagttatttagccctctattcctagccctttcattgaactgacagcatgcctgcaaagatagtgaggcctgtttcagccacattaatgtcctcttaaatggtagcctgcagtctggggaatgataaatgttcagtgattgatgatttttttagtccccggggattctgggtggtttcaggtttctgtgagccagggtagttttttctcttacttgggcttcgtatacgtttttccggtctttaccatgttggttttagattggcagagatatatatgacctgcagttttaattaatagagttcaaagccttgtttagaaacaatatgattttggaggtaatgctgtacttaaagagtgcgtaaaagtctgagaacca

SEQ ID NO: 157906 - DNA, 195 bp, Homo sapiens
ccgggagcccttaaccctccgcgagcccttaaccctccgggagcccttaaccctccgggagcccttaaccctccgggagccatgagatgagaatatctgcaggaggaaaatcctagctaggagagggaaaaaagcaagtgctaaaatcctgaggctggaacatgcttagtgtgtttaaagaacaggagagaggcc

SEQ ID NO: 157907 - DNA, 489 bp, Homo sapiens
gtgacaggatggaaggggagtgactggctggcaagcagggccaagggtgatctgtccgctccaggtttgggtgtacacagaatgttcatggacagacaggaggcagcagggtcacaagctggcttccagacttggggaagcggccccaggttcccttgtctttaaagctgggttcctgactttaccgactacataaccttcaaagttttttaaaaaggacttgtttttcaaaatgggatggttgagcagagaagccttcaagctgccttccaaactcccaaggccccagtgttgccccaggtggctgaggggataagtgtggccaggcagggaggcccatgcggtgctgcacccaaggggctacttggtaactacagacaagggttgggcaaataggctgctcagaaggagacagtgacaacgtccccatagctggaaacacacagagaaacagatattgcatctagcagccatcccctttgagagcaa

SEQ ID NO: 157908 - DNA, 318 bp, Homo sapiens
gcccacatgaggcatgcgtcatctgacccatcttagctggctagaagaggcaggtggaagaaggtgggataaccttgcttgctgagtctcttggctttcatttttatcccgtgctggatgcttccttccgttcctcctgcccttggaaatcagactccaagttcttcagcctttgcactctgggatttacataagtgtttggccaggggccctctgatagtcagtttggccacagactgaaggctgcactgttggcttccttcttttgaggcttttagactcagactcagctgctactggcttctttcttccccagcc

SEQ ID NO: 157909 - DNA, 554 bp, Homo sapiens
tttcttctaaccatatataatcaaacaaaatattaataaagcaaccatgaagctaaaatataagaattttgacttcctagagaatcttactcttttttcaattttccaacccattctattattacttcagtttttacatcttattattacattcatcatttatctaaggtaaatagtctttacgttccctttagagagattagagggaaggtgagagacaaagtaaggaacacaacagttagacaggattctatatggatactaactagatttttatccttagtgttcttcctaaaacagatagaaataaagttcctatactagtcaccgttctctgagcctcagactctcagtgggcatttgttctagtcttgctctgatcttatccctgaaatgcagcacagtacacaccatgttcattgctgttcctacgtctttgtgctttatttcctcacatattgcctacctccatctccaaaagaaggccctccctgtcttgtcatgtccatttaattcctactaatccttcatcaagactcctctgactactcaga

SEQ ID NO: 157910 - DNA, 242 bp, Homo sapiens
gagggactttcagacagaaggcattccaggagaatgaatccatgaaccagagatcagaagcctgaacagtgaggagaccttgtacacaaagggggagctaaaaagaaagggcttggaagagcttttagaaactatactaaagagtttaaatattgtaagtcattggaatccaacaaaggttttagataaagagacttacacagttagatctgactttgtaaagattaactgtagcaatgcca

SEQ ID NO: 157911 - DNA, 517 bp, Homo sapiens
tttaaagaatactctgtttatgttttatgactctaactgctttaggcaagttggttttctccttttgagtatatttgagtataatgtaaaaattataaaataatggttgcctcacaatggcctattaagatgtgacagtcgatgtttttgtaaaggaatcttatctattatatacaaatattacattaagtaatgatagccagccagccaggattgagaacagttgattcctgctaggaataacatgcgttaaaagttttaaggcagctaaattgatagaattgattaaacagcgaaggcaacagtgtaatgtagttgaaaaaacattgtgtggtcagatagaactctggtgttctttcttctcccagctctgccatgaactatgtgattctggatcagattgtcagcctctctgaaccctattgccatatgagaataactatttaggggggctatcagtctgtgattctccccacgctcatgttaaatgaatttgtatgcctttcctcttgttaaa

SEQ ID NO: 157912 - DNA, 601 bp, Homo sapiens
cctctcacctcagcctcctgagtagctgggactacagcctgccaccacacctggcttttttattattattatttttggagagatgacatcttgctatgttgtccaggccactctcaaactcctggaataaagggatcctcccacattggcctcccaaagtgctgggattatagataggtgtgaaccatcatacccagctttattttatttttttgtagagataggggtctcgttcacttgcccaggctggaatgtccggttttactttcctgttttttcttggtggcagataccatttgtttgctttcagatataacattcccctaagcacttcttgtaggccgagtctagtggtgatgcattccctcagtttttacttgtctgggaaacactttatttctccttttcttcttcagggagttttaatttttcttaaacatgtggtcactctctagaggtgggacacccccaccccatttttggcttagatcttctcgtgtgttgacttgtgtccccctagaaggagtgttgaagtcctaacccacagtacctgtgattgtgatcttttttggagatagggtgtgatttctaaaaaattata

SEQ ID NO: 157913 - DNA, 403 bp, Homo sapiens
ttaaatgattgttttcctcttttttaaaaaagtcataccattcatcaaatagttaaaatgcattctaacaccaatttagggtggacttaaggaaaaatgtcctttttactactgtcaaatatttggcccagctgatctggtgttttgaactctagttatttgttcatgggtctttctagcaaatgtcacattgcatttagtttgaattaattgggtaggtagaaactccatatggtatggtcaaggggtggcaagatcatcctcaccaaagagactatgtcctcttctggtccaacacctaaagtgactacctgtaaagggatttctttgcccaaagacattgaaaagcaagccgtagcctaactctctgacatgaccccggtatcatttcagcaataagaca

SEQ ID NO: 157914 - DNA, 450 bp, Homo sapiens
gtcattgctcccttcctcacaacagcaacaacaaaaagctaaacaaactgaaaatcaacaacctttacagagaattgaggtcacagcagaaaatgctgccctgaaaaatggagaaatggacagctatacacagagaaccaaagcctacggggagcagaggcccacagctaaaacctgtattggtagaaacaataaactgtaattgacaaattgctggaagctcagggagaactgacatgagaattaaaaaatatatccaaaggggagtgcagtctctggggacagagggcactatttggggagttttatttccaggagctctaacagtttctgctaattttttattgagagccagacataatgtatcagacaaaagaaagtgagattgagaggcctttaaaggaggtcttatacgtttaggaattaggttatgcttaccatttgctggag

SEQ ID NO: 157915 - DNA, 643 bp, Homo sapiens
gtggacttttctttcttcaatttcttcctggccttgtgtttgattgccttctctggagtgtgtcgtctgcctttctcattggaggttttcctcggatgtctggcgatgccatctgcctgtgtgtgatgggagtcagcaccagccggcctcagaggctgggtgtgtgcacccagggtggggcccgaggggcttcagagcaggtgtctgtgggcagcagccccttgcctgtggactccgtagaacgtgtgggtcagtcggtctcttctgggtggtcagtgtcccagccttcactcttgcccaggtctgtcccctggggctctgggaggtgagtgcgaaggggctaggtgactctcttctcagtgagtatttggcatccccgagacaggggcccctcggctccgtttccccagagccttctgctggcctggagtttggggctgaggatgcatcagggaggtcccgtttctctttgtaaagacatttgacagctcccctcaccaccttggtcttcaggctgcctggcccggtttggtctttggcaggtcctggcacctctcgggcttctctgtggctggtgcatttgttccctggcctccagcccccaggtttccttgctgtctctccgcggctgccttctcttctt

SEQ ID NO: 157916 - DNA, 161 bp, Homo sapiens
tctggcgtcgtgtaaatccttcactcttactccctgttccctcctgctccagcccctggccaaccaccaacctattttctgtctttctgaatttgactgctccaggtaactcagaagtggaatcatttcaatggctttttttttttttttttttttttttt

SEQ ID NO: 157917 - DNA, 551 bp, Homo sapiens
aaggggatggttttttgtgtgggactatcatactgttagatgtgggatagtagcaaaatcataggttttgttctgggcaatgggtttgcagatactcattaacatcattaaacataactacttacacaactaaagaaaaggaggctatgatggaaaacaaacagaaatgatcatccttgagaggcatgtaagattacaacatcggatgaccgcagttttcctcaagataggaatccagctcccattccaaaatgtccaccaaagttgcaacatagtagcatttgccatataaaagtactggagttattaactggattccagatgtctgaaactgatgtatcccttcactgaatcccgactaggatctattttgggtatagcacttcacacaggttgctgttcttaattaaaacttctctgccttaagagctttatgtctgtgagatagtcatccaaatgttctcctctccataaatgtgctcttatgttttattttcacagcaaaatgcttgcccagattttaataaacatgtccgcagtagtaatataca

SEQ ID NO: 157918 - DNA, 265 bp, Homo sapiens
ttcttggtcatgaacactttgcctaagccaatgtctagaagagtttttccaatcttatcttccacaggttttcagtttggggtcttagatttaagtctttgattcatcttgagtgttgtttttttttttaataaggtaagagatgaggacctagtttcattcttctacatatggcttgcaaattatcccagcaccatttgttgaatagggtgttctttcttcactttagggtttttgtaggttgtcaaagaacagttggctataa

SEQ ID NO: 157919 - DNA, 642 bp, Homo sapiens
acaggtggcttcttggtcaatgattttgtatgctgctgctggtgtgagcatgctgaattgctccatgcctgcagctccctctaaaactgatggagagccctgtgctgagatgaaatggggggaaaggagaaatttgttgccactttgagagtcaaaggcagtggtctttccaaggaagagtgaactagcagaatcactgcaggagaagcaaattctggaggctggatgccaagaggtgctgtaagaaaagttgtaaagatatatgtgggggaaaccactgctcccatcccccttgggagacaattggtaaacaatatagttggcaaaggatagggactgggagggaagtaaaagaggagacagagtacaatgaacagaatagatgccaatggccttatcagctttaacagatgatctgaaaactttaaagtaacaaggaagtttttattcccataattgttagtagtgtcttttgctagctcctccgatgtgacagtgattgaccattggcagctgggtcttcaaactctcttctaaaatgttgcatctctatggggacacatgaggaacttagttcttctatctggaagtaggtgtcctctaagatttcttgtgttgtgtactctgtatcctttttttttt

SEQ ID NO: 157920 - DNA, 362 bp, Homo sapiens
aagcaaggtagtttttaagtatatcagaagccatcatagaagagtgtcatataactgggcatgaaaaataggcaggatttggacatgtagtgacagggagtattatatctgaagtgtacagacagtgtcagcagaagcacaaaggcagaatataatgaaacatttttgggaaatgaagatgagcgcattattgcgcctgtagtgggaaacagagctggaaagacaagtaggggctagaccacagaatcttaaatatcaggctgagtttgtactttagtcaataagcattgggagtcacacatttggagttctagatgatagaatatttaggaagccgtgctgggatcgggggtaccgagctc

SEQ ID NO: 157921 - DNA, 966 bp, Homo sapiens
cccaagaggcggaggttgcagtgagccgagatggtgccgctgcagtccagcctcagtggcagagcaagactccatctcaaaaaaaaaaaaaaaacaacaccccacaaaagagggatatttactaacaggattccagagggcagggaacccaagatcaggagatggcctcagacctcacaaggcactggaagaggtcaaaaagcaaggccctccctcattccctctggggccacagggtcccccatctccgcttcccactgcacatctgtgcttcatctgggagacctgatacccatgcttttccacacacctggcctgctcctgagtgtgcagagtgtcagttccagccagttccccaggctaatggacaggcctccgttccaaattcccaggaaagagaatcaccattggccacagccacaagaccaggttcccccaacagaaatgggtgggttggacttctctcccacccttgaagctgaaggctggcattgagccctcagcgtctcagacagcgctcaggtatggcaagacagtgtgcaccagggacaggaagtcccgggattggcacattttctgggatgacagtttttttgccaatattctgggagaaatcctaccatttttatattaaacatggctatgttatggagtagcatctaaagtgatatgaactaaaaaaaaaaggccaggtgcggtggctgaagcctataatcccagcactttgggaggccaaggcgggtggatcatgagatcaggagtttgagaccatcctgtccaacatagtgaaaccccgtctctactaaaaatacaaaaattagccgggcatggtggcgcgtgcctgtagtcccagctacttggtaggctgaggcaggagaatcgcttgaacccaggaggcggagcttgcagtgagccgagatcgcaccaatgcactgtagcctgggcaacagagccagactccgtctc

SEQ ID NO: 157922 - DNA, 665 bp, Homo sapiens
tcgatctcctgacctcatgatccatctgcctcggcctcccaaagtgctgggattacaggcgtgagccaccgcgcccagccctcttcctgtacatttcttgacccctgtgtgggtccctttcttgggaaatagtcttagagaccacagtctggagactggggtaagcgctgttattgggttgggacttacgaactatcgatctttactggcgtttttgtgaatttcctgagggacggacatgcgtgtttgacctgccatccctcctcagagctatggagagcacctcgcgctgaagctgacattcaaacgcctgaacggtcataactgagacccattccaaacgctgacttacatgtgatgtcattttcccccagtgttcttaactgaattgcaactgttgtatcataccatggtggggaggggcacgcatgcaaagtagagacgaggtagagaaagtagaagtattctttaaggtaaagatataaaaatattctgtagataacatgtaacttaagtggccctaccttggagcttcgtatgtaggtgagtttttatatgccacttctgtttctctcatttagatggatatatgcaatgccaaagacaaaagcttatgttaacaatcactgtaagttaaattatgcttgggtatgaacaacagtgca

SEQ ID NO: 157923 - DNA, 403 bp, Homo sapiens
cagttaacacctcagtgccaacctcaactcacccaccgggaacctgctctagcctattacttcatgcccacaggaagctcctagacttgggctccatcaagacctccacagttgtgacatcaaagggtccttgcccttagcagctggggtcctggctgggaatctggctctgtgggcagtgttatagcctgcagcttctctctgcctttgaagatacaatcgcacatctgagggtccttatatgagagaagcaaggttagactggttctacttgacctcagagagtcaaaccaagacagtagtagaatctacaaagaaaaagagttcaaccaacgagttcctgtgaataccaggtgctcaaaaagctagagtaaacatttaaaataaaaaaaaagtcaacccc

SEQ ID NO: 157924 - DNA, 530 bp, Homo sapiens
tcaaaatacggtagtattacacttattgagtgttttctacatgctagatattgcctttctctcatttgcataacaacctcacaaagtaggtttatcaacctgtaaaaaatctccgttttacaaaagaagatgaaattcatgaaggttaactaaattgccacagttaattataacatcccacattttaacattgctcaagcactttcttatacctcttttaatcctcacaataaaccaatgatgtggcaggccctgtatcattatttctatattacagataggaacctgagacgcagatagatgaaatgacttgcccaaggtcataatactagtgagtgacaatgtcaattctgaaagtcagactctcagcgtttctatcccaacacatcgcatccctaaagatggatttatccatacattcagtgggtatttgttgaacccctactgtaagtgggtacttgggtactgtgctagcgcctggggacacaatggtggacaaaagaacaaaagcatcagccaggcaatgtggc

SEQ ID NO: 157925 - DNA, 369 bp, Homo sapiens
catttgtgagaccgtgtgcagtgttgtacttggtgggcctgtcctttttccttgctgtattgtattccattgtatggccgtgctgcagcctcgtgtccctctacctcggtgcacgcttgctgaggaagtggccggtgcagctgtggcttgttgctctggaggcacctgtgtctgtgggttggctcttctgcaggttctgtgcccaggagtgagccggctattccagcagctgtgactgttccagtcagcagataccaacaaacagctttccaaaatgaaggtggccacggtgtgattttcaggttccttagttttgtgtcgagtagataatttatctacccagccctctctgaggagtcatcgtattta

SEQ ID NO: 157926 - DNA, 401 bp, Homo sapiens
tggtgactacatccttctcgttgttcaagccaaggacttggcagtcctcctggaagcctgtgtttctccaaaccctacatccaatcaggcagctcatcctgctgccttaacctttaaaacatccagaatccaatcactgctcgccacttccactgcaccacactggtctgagccaatgtcacctgtcacctacatgatgacatcagccccctaaccgttttccctgcttagcctggttcccctcccatctattcgtctactcccaatctcccagtgaagcagctaaagtcatttttttattttttatttttggagacagggtcttgctttcacccaggctggagtgcagtagtgcaatcacagttcactgcaccctcgaactcccgggttcaagcaattct

SEQ ID NO: 157927 - DNA, 741 bp, Homo sapiens
cagacacttcatactgaagagtaaattgaaactgaaataggaaataggtcaggtttaaggagaagctgcaagaaagccaacagtaagatctgaaaattatttaacatttttacaatatatagtttgtttaaagtatctttcaggcttaaaattcttggactcttggtgtgacctttgaagaacgggtaataacgctgactaggtttcccaggttgaaccacctgagcatgttaaaggtgaaaataggaatctaatcagaacatttattacaccgtaaagcaattttctgaaaatgttactcagttctatgacctcattaccaggcatctgttcgcaaggtcactgtacaagtttattttggctgagcaaagcataaacatttgaaggaccttcaaggattttgctgaggatgtacagcattccatagcttttcacatgagaaacataggtggtttcgtgcagatgagcaacactactgccagatgaaggacagatgaagaaaagtactgttagttgtattaaccatgtctttgaatttctctggcagcctttttttggtgaatttctttagcagatataagaaatcagttaccacagacttttgagctttacaggtaaaattgttgaaatctaattaactttaaatgatcccgattaggtcaaaaatccgaacatcttactgtctatgactttctgtttgtgaatggctttgaggatatacagcttagtattatacactta

SEQ ID NO: 157928 - DNA, 320 bp, Homo sapiens
gatagacagtgtccaatcccaaaagtccaggcaggcacacatggaaagggcatccttctcccatctctgcccctgccagctccccctctgaggcagtcactattcctagttcctaaccctccacagagggaatctaccaggggcatgtacttttcctttttttctggcttcttgtttacatctctgggctctgctggggtctgtacacatctaagaagctgtacccagccactcagcaaactacacatccatgagtggtcctgggaccactcactaccaagcccagcaaagcaaactcagccctaaatccagaccccaca

SEQ ID NO: 157929 - DNA, 523 bp, Homo sapiens
cacaagtgaaaacaagagggtttcatgtaattctgtagataaatttaggtccatccgagccacagcatccagtgatttaggcacagggactgtaaactgtaccctcaagcagcactggcttgatggatttctctaatatctaatttaataggaaggagaggctgggagaccagtaaatttagactgatgtagagcaagagctgagtttgtgggggaggaggtagatattgaaattcaagcactagggaaagaataggaccccaaagaattttgctagattgtaggagaagggagtaccaacacggtgcctgctctcactgactggtctcttgtttcccggcctgtgcccagccatcttctgggataaatttaaacacacctgcttatgagtgtctgcagcagggaaacagtgcttctgcagaggtcttccaccataacctcatggaagaaagggtttttacccagatttatgggactgtaactactcaaagctaaagggatcatggaaagaacaattggctgc

SEQ ID NO: 157930 - DNA, 632 bp, Homo sapiens
catgggatcaggtggctgaggaagctgaggaatagaaagattgaggatagatggatcatccacatggtgactgatgcctccaaaagcagagtcaggaacaggggctcaaaaggagcagtaagccaggtgttaaagtcatcagtgggtgagggacagaagatggggaatggggattcaagaccagtagaagaaaagctggggactggagtttcatctcagatttgtgtgttcacgttacggcctctagataatagcatcttaaagaagtgaaacagggaaggttttctgtcttttctcctactttgtctttccaccagatagcatgaagtctcttatgtcttatgtctcttatgaggtctaaggcggacatggtgatggggacacacagctttgtgaagactaatgctatcaggtttcactatgctttagagaagcaggatgaggcctagggttgggctaggcctagggttgacccagcatgggagttcctggcactgctctgtctgcccaggctgatgatggtccaagctgcagctgctgagggaacccaggcatcctggtggacccttttgattaaaatagagcagaaggaggccaggcgcaatggctcatgcctgtaatcttagcactct

SEQ ID NO: 157931 - DNA, 197 bp, Homo sapiens
ctatctggtgtttgaccacacgggggcagcagagacagcccctgcccatccaacggctgcctgggtggagcgcaagtctgcaggaagaagagctgacgttgactcaggtgttggggactaactagggagggccagctgtcactcaggcttcagaatcagatggcgcccactgacccagaataccttcctaccactca

SEQ ID NO: 157932 - DNA, 729 bp, Homo sapiens
gccactgcacctggctttatttatatgtgtatttatttatttatttatttatgagatggagtgttgctcttgtcgcccaggctggagtgcaatggcgtgatatcggctcactgcaacctctgcctcctgggttcaagcgattctcctgtctcagcctcccaagtagctgggattacaggtacctgccaccacacctggctaattttttgtatttttagtagagacgaggttttgccatgttggtcaggctggtcttgaatgaatgtgttttcttcacattcttgttccaatggaaaccgggctgttccccaagggcagtgcttattctgcattcctcaattgctggtttatgtgtctctcaactcatgtacctctctgtactgccatttcttctctcttctccatcagaaacttagctctaatcagtcatggttgcatacacacgtagtcctaggtactcaggaggctgaggggggaggatcacttgagcccaggagttcactgttacagtgagctatgatcacaattctgcactgcagcctaggtcacggagcaagaccctgtctcagaaacaaaacagtacaaaacaaaaaacccacaaaaacccaacccagtgcttttgaaatatatatcactaaactactgtgtattgctcattcttgttatttggtttcttgtctactcacatttattcacttacagttttagtaccctgaatattcctgagga

SEQ ID NO: 157933 - DNA, 500 bp, Homo sapiens
tagtgaatttttcatttcagttattgcacttttcagctccaaactttttatctggtctctttgtaaaatttctacctttttattgatgttctctatttggggaaacctgcaaccaccatcttctgaagctctgcccatgtcaagaggtctgtgcatacctctctcttccatcccccagttttccaactttattttgctcaagttcctgactgaccaagcaacccatgagccactgcccatgactcattcattcatgcactactggggcatcatttcacaccctccaccttgcatgggcctttttgggttttgattcctagttcctggctcaacagccatttccaaagctgttcttgcgttagctcccaagcctactgctcttgttgtagattctcctcttaatgtctgagtcacagcatttatttcatagatttttaataattggactaattttttccaatgcagcatttctaaggactttcagtaatggagattctata

SEQ ID NO: 157934 - DNA, 278 bp, Homo sapiens
taggttgtcctggtctgagctagtgtggttggagccaggtgctctagcaaggccttattacatgactgggactcagctgggataaccaggtccttcttcatgcacctcaaaaaggctagcctgggcttttcccatggtgacagtgttccaagtgaacaaggcctgtgagtgctagccttggaacatctatagcatcactcccttccatcctgttgctaaaagcaaatcaaggccagctgagattcgggggatggggaagtatatcctacttcctaaac

SEQ ID NO: 157935 - DNA, 306 bp, Homo sapiens
tgagagtagcttttacctcataacattttatggggtcagtgcatctgaataacacaagactaagaggaagaaaatggaatgcaaaatgttatcagtgccatccatgttcaacacagtgattacagatacaaaaggggagtgggtgggagccatagaaagggcagtccacagggacagaaggcctatggtgaaaaactactgcctctttgggactaaatatcactatgtggtgcagcattttgtgagaaaagctaatttgagcagcatttttttatcctgaaattttgctatggttttttttttttt

SEQ ID NO: 157936 - DNA, 382 bp, Homo sapiens
taaaagcagtaaaagcaaaacaaaataaaacttgctacgcaaggtggctcaggcctgtaatgcatcactctctcctgcaccctctttgccctttagccccacctggacagtttcaccgacggcccgcctggccccaagcccctgctctgcagcacagcttggtggttgagagatgaactctgaagccacactgcctgggtttggtctctggctctccacttgctggctggcaacctgggcaaattgctttacctctttgtgcctcatttgccatctagtagggttgtgatgaggactgaggaagttactatttgtaaaggacttgaaatgtgcatggcattcagtaagtactgagatgtaagtactaacatgaacatgtgtt

SEQ ID NO: 157937 - DNA, 584 bp, Homo sapiens
ctcccttttctcaagtgcttgggatggagagtaagagtaaagtttttaacacttgcctgctatgctgaacaggagtgtaatgagagagtgtcctcaggcacagaagtgtgccgcctctgtagtgtaaaatcgttggctcagctttcttctctcacattccagaatttctcaagctgtggccttcatggctgtgtgcatctttccattttgtaccctcctctctccttatcttttaatccagaagccacagtacctctagacaagtattattacttaaggctgcatggctgttttttgaaggttttatcccagtctctgcagatcctaagtgatcatcttctcacccatagtggtgttgcctacggagtgtgaaggaagagtcttttccaaagaggggcgtggtaccacttgggggatgtgaccctgtggtggttagggcaggagtacacgacgtcagagaacccacagcatccatgctggagtcagaggacggtaatgaagtaggaagcaatgctttctgtcccagttcttccagagatagggcctcaagtgaggagtttagcgtggccctttacatttactgg

SEQ ID NO: 157938 - DNA, 623 bp, Homo sapiens
cgtttcccctccttgtgcttttctctcgtgtgccatgtgaagaaccttgcttcctctttgccttccaccatgattactcttaccagttgttttaattgctaagacaacccagttctgcatgagctacagccaacttcacaaagcttcaggtgcctggatgttgaggggcaaataggactgttcactgaaggagctagagaatggaagagaaggttgtgtcagatagaaataacagaagctttctgaaatgaaaacagaaatgttacaacttgcaccacagtactggactgaaacgaagatgtaacacagccataataatttaaattaatagcaaataaataaagaaaaaaagaacttcattgtgaggaccatagtcatgggatagctctgtcttttcggggaaagtggagtagagggacagagtcaccccaggagaaaaaatgcttaaattaagactccctgagagactgaataagagtatgattagttcagccttgctttcatcctccacttccccctcccactgtagacttcagttttaataatgattaaagaataatgcagcatgcggcctgcaaacgtgggagtccttaaattgttcgacactcgtaacatgccgtcct

SEQ ID NO: 157939 - DNA, 660 bp, Homo sapiens
  misc_feature (17)..(17): n is a, c, g, or t
  misc_feature (23)..(23): n is a, c, g, or t
  misc_feature (34)..(34): n is a, c, g, or t
  misc_feature (38)..(38): n is a, c, g, or t
  misc_feature (40)..(40): n is a, c, g, or t
  misc_feature (42)..(42): n is a, c, g, or t
  misc_feature (59)..(59): n is a, c, g, or t
  misc_feature (61)..(61): n is a, c, g, or t
  misc_feature (75)..(76): n is a, c, g, or t
  misc_feature (87)..(87): n is a, c, g, or t
  misc_feature (93)..(93): n is a, c, g, or t
  misc_feature (101)..(101): n is a, c, g, or t
  misc_feature (103)..(103): n is a, c, g, or t
aggcctccgaggtgctnggcagngtcagtctcanccgntnanccgagaaggagtcagtnanagaccttgggccanngttccaggggntctggnagtgtctncnagactcttcagaggttcctgctgggcctcccactgctccagtgcttttgatgaagctagactattccctgcagcagttccttttcccatgttttggcctctgaggatcaacagtacagctctatcttctttttgatgagatctttagtctctcttgatagaaataacagaagctttctgaaatgaaaacagaaatgttacaacttgcaccacagtactggactgaaacgaagatgtaacacagccataataatttaaattaatagcaaataaataaagaaaaaaagaacttcattgtgaggaccatagtcatgggatagctctgtcttttcggggaaagtggagtagagggacagagtcaccccaggagaaaaaatgcttaaattaagactccctgagagactgaataagagtatgattagttcagccttgctttcatcctccacttccccctcccactgtagacttcagttttaataatgattaaagaataatgcagcatgcggcctgcaaacgtgggagtccttaaattgttcgacactcgtaacatgccgtcct

SEQ ID NO: 157940 - DNA, 258 bp, Homo sapiens
tgcatatacatatagataatattcccataaaacaaggagaccacggtgaggtgggacccgcacatattgaaggccttccttcttcctgcggctgacttgattctcagcactgctagggcaatgtagctataagagatgaggataagacacaaaggcatcaggacaattactaccgataaggtgaaaacagtgctctccatagccactgtgtccacacaggtgatttttattagagctggcatctcacacaggaaatgt

SEQ ID NO: 157941 - DNA, 638 bp, Homo sapiens
ccaagctggggctcccatacatgcagagggactcaccagcgtgtgctgagcctgaagctccacctccagggtgttcaccgagcagctcagctccaggatctccaaatgacagcactgcagctcctagagcaggacatggcctgcaggctgatgccttcagactggagcacagagagacacaattacctccctgcccaggtggatgccgagtcctccctactctgcagcctcccttcatctgggcttggaaccactgctccacatcctggcagctggtctccaccacggcctcatactggccccatatctcctctgactgctcaggtccgcagtgggctcagtccccaactcaatccggagcttgtcctctgcactcctcagagtgcaggcttcctatgtacacaaaaagagcagactctgcattcattcagccctccaccaaatgtcttgcccacctgaagcacagcatggtgactgctcaggcacttcaccccaggagagcagcagagccaccccagcagcccccttgtcagcatctctctccatgtctgaaatgatctaataattatctctatttttactttatcacaaagagtgacacccatacagagttgcctctgtttcaatcattatctggg

SEQ ID NO: 157942 - DNA, 283 bp, Homo sapiens
taaagagaatcaagagtgagtgcttttacatttgaatgcaaaagttctataggtcagtgatttccttcctgacttgtgtcccaaaatgtatataaaatgtgtttgattacaacatttcttcttttcttcataaattgccattatgaaaattttattgggaaattggagaaattggctattaagctactagaaaaatgtcagaatccatccataaggcttcatagtttaaaatacaggtttacaaatgtgtatgtgtgtgtaatttgggcgtacggggataact

SEQ ID NO: 157943 - DNA, 188 bp, Homo sapiens
caactgggctaacctgtaaggacaaagggaatattcctttaaggacacaggaattgactagggcactgaacatttgtttacacactgaccacagtccctgaatgctagaatttaagtgccatgaggtgtatactgcatatagagccgccgctaccaccaccatacatgggagcttaagccgcataaga

SEQ ID NO: 157944 - DNA, 941 bp, Homo sapiens
acgctgcacgagcgttcaaaataaaaataaaaagaaatcgtttctagaaactgttttcccgtgtgtaaactagtggcactgcagcctgaggcaggtgctgagatggggacctggaaaaggcaacaggcattttgagtcagaaacaatgtgactttcctgctccaaaatgtgcaattcaaaagtctttcttagttgtgactaaaacaaactttgaacttactatttcaacagtattataaggggaagacccaaggaatgggactggcactgggaaaacagctaggaagctgctctgcacggccagggagtctggaagcatcctggtactccagagcgaacaaggctgagcgcttgatgtggggcttagaggcttaaccaacttggttcgaatctagccactgccacttattagtgacagtgacgaaaggctcagtctcctgatatataaaatgttgggaggatgaaactaagttacacgaagtgccttatacagcgtgtcaggcatccaacagaggccattatcaacattaaccacactgacagcatttcaagcagagtatccgaacagttaccccatcttcaggcctactgagttccaatatttgcttaacaagagcagccagtaactcttacctggcctcaactggcagcagatattctgggcctcaaatatctatctaataggaaatggtcacagacacaaaataagcttaacaaaaggcagtttttttttgtttttttttgttttctgttttttgagataaggactcactctatcccccaggttggagtgcagtagtggcgtgatcacggctcactgcagactcaagtgatcctcctacttcagcctctcaagtagatgggaccacaggcgtgtgccatcacaccaggctaattatttttcttttcttttttttttttttgagacggagtttcgctct

SEQ ID NO: 157945 - DNA, 535 bp, Homo sapiens
tagctcggacccacaccacctgagttggtcaggagatcgagaccatcctggctaacatggtgaaaccccatctctactaaaaaagacaacaaaaattagccgggcgtggtgttgggcgcctgtaatcccagcactttgggaggctaaggtgggagggtcacgaggtcaggagttcaagaccagcctgaccaacatggtgaaaccccatctctactaaaaaaataaagacatgaattatttttctgactgtactatttgactttaaaagttgtagcaattttaatattgttacacatgatgacactgccattgcttcatgaaaaacttaagtggcatactacctatccagatactctgctgagttctcattctcatcagttgatttttttctctgtatgagcagtttccaatttacaccccatatatgtgtatcctctccatttattaatgaaaagatacataatagagaaaaatgaagaacttttacccttgatctggagccagatgcctgcaggggctggtggttacctgtgtg

SEQ ID NO: 157946 - DNA, 453 bp, Homo sapiens
taaaatcaagacatgggccaggcacggtggctcacgcctgtaatcccagcactttgggaggctaaggtgggagggtcacgaggtcaggagttcaagaccagcctgaccaacatggtgaaaccccatctctactaaaaaaataaagacatgaattatttttctgactgtactatttgactttaaaagttgtagcaattttaatattgttacacatgatgacactgccattgcttcatgaaaaacttaagtggcatactacctatccagatactctgctgagttctcattctcatcagttgatttttttctctgtatgagcagtttccaatttacaccccatatatgtgtatcctctccatttattaatgaaaagatacataatagagaaaaatgaagaacttttacccttgatctggagccagatgcctgcaggggctggtggttacctgtgtg

SEQ ID NO: 157947 - DNA, 351 bp, Homo sapiens
tgaaatttagcaaaatcaaaggaaatgaacaaataaaatatatcaagtgttctacggtagagatttctgattctgagcaaggaaacactagcacaggctccccttctgagggccaagatgacctccaaggcccctttcccagccccctccctggctctcttggctgccctcctttctgggccctggagggtggtaggaatccttgtaccctctgaggacaaatacctcacaaatgatggaaccaaacccctttgtttcagttcacttctctcagtgtctaagggacctaagggctccactgtccctttttgggtcagcctcagtgtcctcactacatgccatgggtaccga

SEQ ID NO: 157948 - DNA, 451 bp, Homo sapiens
  misc_feature (8)..(8): n is a, c, g, or t
cgctcggnaccccacaccacctgagtcagattcttgccttggattatgaattgaattttatgcttccccttcctgtctaatttaacacattttggcacaaataagcacaaggtcagtcctgggaagattctgggcctggaagagttgaagtgttaaacattagctgtgggaggatgtgtctgggggagactgttgcctgcagtcaggaatttttttcccactttgtatttagatagatgtacaattcaaactgaatttttaattgaattcctgctttggtttaaaactgcacagcgagcttctttttataaatttttaagtgtgtgtgtgtgtgtgtgtgtgtgtgtagagacagggtctcactatgttgccccggctggactcaaattcctggcctcaagcaatcctcctgcctcagcctcccgaagcactgggattacaggtgtgagcc

SEQ ID NO: 157949 - DNA, 413 bp, Homo sapiens
atcaagcttgaaaggaccacagtggaaaggaaagcatctacatgtttaacacgggcatcctgaaattagaagagatctgttcctccaagaaccaggaaccaagaagaaacatcccaagaacatgtaaggctcctaagaccaggggaccaaatgggagactaatagaaacaactactaaaaaaatgaaagatagtgagtaagaatcaaagttaggataagacaaaaggaagaaacaacagataaaacctcaaaaagaaaatcaactgtctctaaacatgaacaggacaatatgaggccaatcatggcctaatttcagcataatgagggaaaaaaaatacttttggtatctttgtaaaattaaagctttaatacctattccctattggttccaataaatcttaacccaaggcatc

SEQ ID NO: 157950 - DNA, 305 bp, Homo sapiens
tgcctgcgtgtttgctgggacacaggtgccctttgcaccagagggtggtttctcccacgtcagcctttcctgtggtcagcctctccccgggtctctacctgggttgtgtggcccgttggcagacgttttcccggcggttccagtttgggtttgtgaaggcctgggcaacatgggcacctgcgtcggacccgcagggattttcatcccctccctatcctgagcagcctctttgctgggatcaagacgaccacaccccagccaaggacaaagtcctcagaggggctcattgtccacccgcaggaggg

SEQ ID NO: 157951 - DNA, 237 bp, Homo sapiens
ttctgctatgccaggcctcagtttccccactgggatcatggggcgctcagtggcgagggagcagatcaggagaggctaagaggagagagtggagactcccaaaacagagggggaggcctccagcccgctggccacagcagcacctggtcctcagggagcccttctgagcatgtgactggcatcctgggattacgagctcctcaaagcaatggtgtacctcctccacctcccacatcc

SEQ ID NO: 157952 - DNA, 605 bp, Homo sapiens
cgtgagctgcagtgcactggctgaaaatgattttctgattaagtgaggaagctgcccagtttgctgataaacacgtggggctccagtgtccacttctgtctgacctgcgccaatgcctgtgacatcctctcacttaggtcagtgtcatgaaaatacagcccacacgcacgtcagaactgcacgcatttgtcagtcctgcgagtctcttgctgaatctgacagtgacgacgtttactcattgtctatttttgccaaatcttgcttgatttgcagccatagtgtgtcagcctgggttccatcaggagagagaaaccccacagtgatttgaacagggcaggttttatttaaaggtttgttcaatttaacagaggactgccgtaatgaggagttgaggattaaggagtacagagaactgcaaagaacatgagagaagctcatacaggcgccagcactgaagaagccaccagcccagcaccaccctacaagggggcccagccctgaccttctagcccagcccactggagctggcttagccgcaccttttctcctgccaggcctcctcggcgccctctgctcactgtgctcaacactgcactggcagacat

SEQ ID NO: 157953 - DNA, 341 bp, Homo sapiens
agagacaagatacgaatcgagccggaccccagagagggaggggcaagggcttctcactatgctcactacgtgggtaagagagtcaatcgttcctcaaaccacagcatcacacagtatacctttgtaacaaacctgtgtttgttacacaggggatacgtgtgtatccccgaatctaaaataaaaattgaaaaagaaaaaataattaaaaaaataaaaggtatgcgccaaatgttaacagtagttatttcaagaaagtggaaatatgaattgttcttatattcagttttgcttctgtatgctctactttttctataatgaccatggattatttgtaaaacaag

SEQ ID NO: 157954 - DNA, 177 bp, Homo sapiens
tctaaagtcttaggagacaataagattacccaggaagagtatttaaagtcaggagagggccaaagacagaaccttgagatccaacacttaaagatcaagaagaagagagtttcctatcttctgtttcttaaaaaataaataaataaataaagcatatcagcataattcagagtcaca

SEQ ID NO: 157955 - DNA, 367 bp, Homo sapiens
atcaagatggtgcttgcatttttctctagcacagagcctggcctggttctcccagggcaggaaggagccagtgccagggtgggcagacccgcagggctgggacctgccttcgagggaggctagggagcctcgaagcctccttaatgcgcctataactcattccctgggttcactaatgttcccggctattagtgccgagcacagctaagcaaactttcctctgactcaacgatcaatttccatattgttacaaatggagtccacgcctgccacggttcatttttcttataggccctttttctccccttcccttttcccagttcagtgaggaagtcattactgggagttatgaatttcacaacgtgct

SEQ ID NO: 157956 - DNA, 425 bp, Homo sapiens
ccccggactggatagaagggaatgggggtgtccactctttggtgcagcagtcgcgcctaccttctgggatgtactttggctgccaagtcccagacatagaccagggggtgggaggtggcctgcttcccccttcaggaaggccagggtaagggatgacgagttggttgccagggtttctgtaacctacacagaaggaacccgtttggaaagctgattcatacagaacaacagagccagaaggcaccctgaaaatcacccagagtaacccctcagcctgacagatgagcaaactgaggcccaggcccaggctgtctgcaggatcttcccatcgtcctggggcaggatgagcttcagaggttcagtgatggcctccacttgcgtgctgaatcctgggtgggctggaatttgggaggaagggccttaag

SEQ ID NO: 157957 - DNA, 151 bp, Homo sapiens
agaattgcttgaacccggtaggcagaggttgcagtgagccgagatggcaccattgcactccagcctgggcgacagagcaagactctgtcttaaaaaaaaaaacctgaaaaatcctaggacttctacaacaaatgaaacctggatgttttac

SEQ ID NO: 157958 - DNA, 368 bp, Homo sapiens
agtatgaatgtggtggctacaggagcagagagatactgagaaggctgttgcattgacagtatctctctgctactcaaaggctgactctctgctactcagcattgggagtcagttatctcaactctgcaggatgaggccacatgcgtgaatgggatggaagccagagggtctctacctagctggattgactctgcagtaataacctcaaagcccagtactacacatggtgcagaggtggacatctcacctaagactgtggaggggaacaatgtgattcaccataataaaatccatcaactcaaattatctgctctaataacatatgctctattgacaggaagggtagcaataaaactaatggcaattta

SEQ ID NO: 157959 - DNA, 536 bp, Homo sapiens
agacggtccctcgctatcatcggcacagagggtggaaagaaagggtcattcggtgttttatttcaatccccaaagtatagattaaggcagcagtattctaggtcttacacaatcataggaggtgggtaacatggcaggagaggaggaaataatattcgttgactgtttactatgggcaagacatcttaccaacagtttaatactctttgcaactctgagccagtgggctctctctgtatatcactttgggaaaagctgaaattggtaaattagtcccaaactctaggtcagagggtaggggagtgaaggaaggtttcattaaataaatggccctggggctagtaattaaagatgactatgagttacctgagtaacaaggggagggaacagtgttcttagtagagggaacaacatttgcaaagaatcttcagtgggatggagcttaaaaataaggcaaacatggctgaaggacagagagtgtgggagagtactatataagctaagagggaggatataggcaggagctagatcaggca

SEQ ID NO: 157960 - DNA, 600 bp, Homo sapiens
ggccactgtaggagcctccagggagttctctttgaggctggaatgcagtagcgtgatctctactcactgcagcctcaatctcctggtctcaagccattctcccacctctgtccttcaggtagctgagactacaggcgtgcaccatcacacccagtgctcgaatgtcccaacctgaagctgaagaagccgccctggctgcaagtgctgtcggccatgattgtgtatgctctgatggtggtgtcttacttcctcgtcactggaggaataatttatgatgttattgttgaacctccaagcattggctctatgactgatgaacacgggcatcagaggccagtagctttcttggcctacagagtaaatgaacaatgtattatggaaggacttgcatccagcttcctgtttacaataggaggtttaggtttcatattcctggaccgatggaatgcaccaaatatcccaaaactcaatagatttcttcttctattcattggattcgtttgtgtcctattgagctttttcatggctagagtattcatgagaatgaaactgccgggctatctgatgggttagagtgcctttgagaagggctatctgatg

SEQ ID NO: 157961 - DNA, 517 bp, Homo sapiens
tgctgggattacaggcatgagccaccgcacctggccgccttttcctttttttgagactgggtcttgctccgtcacccaggctggagtgcagtggctcgatcttggctcactgcaacctctgcctcccaggttcaagcgattctcatacctcagcctcccaagtagctgggattacaggcacccaccaccatgctgagctaatttttgtatttttagtagaggcggtgttttcaccatgttggccagtctggcctcaacctcctggtctcaagtaacccacccgtctcagcctcccagagtgccatgtttacaggtgtgagctaccgcgcccggccatatgtagccttttcagttcagcttctttcttttagcagtatgcccttaagattagcactaagacaacagataatgttctgttgtctgaatgtgccatggtttagttacctgttcacctactaaaggatgtctttgttgctttcaagttttggcaattatgaataaagctgctgtaaacatt

SEQ ID NO: 157962 - DNA, 693 bp, Homo sapiens
atcccagaactttgggaggccgaggcgggcggatcgcctgaggtcgggagttcgagaccagcctgatcaacacggagaaaccccatctctactaaacatacaaaattagccgggtgtggtggcgcatgtctttaatcccagctactttgggaggctgaggcaggagaattgcttgaacctgggaggcggaggttgtggtgagccgagatcgcaccattgcattccagcctgggcaacaagagcgaaactccgtctcaaaaaaaaaaagaaagaaaagaaaagaaaagaaaagggagagcagaatcaaggggccggaggaaatatcccatttcctccaagagtgaacactgctcctcgctcctcttcggctccaaggattcaggtggtcagacagtagccaagaattcctcaaaatgcctggcatggcagtcatccagtaaatatttgtaaaagttatgaattaaaaatacatgacctcaggttgagcacagtagctcaatgcctgtaatcccagaactttgggaagctgaggcaggtggatcacctgaggtcaggagttccagaccagcctgaccaacatggtgaaaccccgtctctactaaatacaaaaaattagccgggtgtggtggtgcatgcctgtaatcccagctacttgggaggcaggagaattgcttgaacctgggaggcggaggt

SEQ ID NO: 157963 - DNA, 389 bp, Homo sapiens
gcatataaaggattaacgattgtaagaatttcccagccaacatggtggctcacaactgtaatcccacacttcgaaaggccaagacgggcggaatgtttgagcccagaaatagcccaccaagacatctcccagtcacactcacccacaagggatccccttacctgagctttcttgctcttgctcagtgcctaaagtgggggtgggtgggaagagagctaaagtgaacagagatggactgccttactaggatatggagacaattgtgccaagcgttttgggaggacaaggatgacaggagttgcaggatgtgagcatcttcaaccacagaacatgtgtgacaatttggagcccagaggaatgatggaatgagtgtgtgagtgagtgaatga

SEQ ID NO: 157964 - DNA, 253 bp, Homo sapiens
ctgtagtcccaactacatgggaggattgcccaggaggttgaggcagtaattagctgtgatcatgccactgcattccagcctgaaattttaaaataacatattatgtaatagaagttatacgcattattcttgtttgttttgcagaatgattagaaactgacaaataaggtaatctgagtaacttcttatgcttcacaggcccttggggaaataacacgacagaggcaaggccccacacatcttatccatcaag

SEQ ID NO: 157965 - DNA, 314 bp, Homo sapiens
acacagagacacaccacacagacacagacacacacacacactttgctgagctgcctcacatcctctgtctcaccagctgccatggagggtggtttctggtgtttatatcatgctttgtatttgtttttatgggaaagttcagggcaaggaagggctctgaggtgctacaggagagcacagaaatggtatcgcagcttcccagtgccccaagtggtatattttgggacttttcctgtcatagaccttggccctgaactccgcgtgccagggattgaggggagaccccacccgtgccccagatgtcactcacccca

SEQ ID NO: 157966 - DNA, 374 bp, Homo sapiens
aagcagtgtccacactcagttggtgtgataatttcatgaagtgatagcagcatccctaaaattacacatagcttttgaaatataaaagtataaaaatgatgctttgctggactattaaaaatgtttatgaggttcaaagtttcatctgataaatacattctcagagtctttccaataaaaagaacttttcactgaaatgagtccaacccattttcattatattccaaacaagatagcaattttacctataatatttaactatgatttatataactttgaaactttctaacactgcaatagttcaaactgcttgtctttgaaaaatgctttgaaactacattttcttcaatagaatgagtctttcaaaatctgtg

SEQ ID NO: 157967 - DNA, 689 bp, Homo sapiens
gtactttgggagagacagagggttgagagagaggagaggtgagagaacatcatgttgaagtgaagttcagaccacatgaagaagccacacataggtgttccatccaacagccaacatcagctggtgtacatgttgtttctcctagatcgtgtttcctgagaagcaaattttgagatggttttgagtgatggatgtctacttaagagtgctcctgggaataacatctataaaatcctggtggaggcagagaggaggagactttggactgggagggagttaatatacaagtttccactgatcctgtgagactggaatgacccctcaaatttgtctcaatttgaggcaacttggtcaagcattagtatcctacaattgataggttattgggtgcccagagagagagagagagagagagtgagagcaagaatgagagtgagactgaatatgagataacgagagatgtagatatacctcaggatataaaatttattcattttttgtgtgaagtgtaagatttgcatctagtatctttattttgcataaggacatcccattgttccatcaccatttgttgaaaaggtatctgtcctctgaattaccactatactttgtcaaaaatcagttgactatatttgtgtgggcccatttttggatgctatattttatctttgaagataatctttccaaat

SEQ ID NO: 157968 - DNA, 566 bp, Homo sapiens
agtagggaaaaaaataacatttccactcaacaaggtctttacatacctacctgccagaccccccttctcaggaagctattgccagctgtgttttgggctcttctctcatgagtcattctggagggaagaagtcattctcgtgtgctgttcccaaaatgagggaatgactcaggagagaagaggacttggatccaggaaatggaatgccttcatcctacaaagaggaaggaagttcaccatgtgtcaggcatgggtctagaccctcggagacagtggggaagaagaggccccccactcccagattccagaagacaaaccacacagaagacggacaagtaaatgacatggatatgtgaagttgttgaatgctggataatccacgtcaaggaatgaaccaacacaggtcctattaaaacaacagaggcgagagtgggatttgtatcgactcctcaacagccttagttgatggagagagaaaaatcctcccatggtctccctgctggaacagatgtgataagtttgactgtgaaatccagttaggttacgtgcacaacagaggattaaaa

SEQ ID NO: 157969 - DNA, 152 bp, Homo sapiens
cattgcaacgctgatttttttttttcaggtagaagcatttcttagtactttgaattccctgaatcttgaatcatttaggacttttaaaatagtagctttgaaacccatccaatcttaattaatgcaaatcatagtaacatatgtttaaaaag

SEQ ID NO: 157970 - DNA, 609 bp, Homo sapiens
ccaatatacacattcacaccattgagacagcataggcctgtgaagcctgacaaacttgaattcagatattgtttcaacagttcatatctgtgtccttgatcacttcataagcctcagtttcctcctctataaaatcagaaaaataattgctactttacatggttgttagagataacgagtatgaagtacctcacactgagcctgtatatagttgatcctcagtaaaacagttatcattataagtaaaatgaggttgagaatgttgctctgttatactgatctccaaatggggctaaaacaatttgcataatctgattcctctatctgtccatgcgtatatatttatatcagtgtggacagacttttccactctgcaatatattacttaaatatatatcagaaagtttgcctatcttattattcctaatctcctgaaaaaaaaattcacaataaaagagtactatttttaaggctttgtccattatacttactctagatctttatggagaataatttgtctccctgttttgacctaaatacagttatatttcaccaaaatatatggatggcattattttaaatacttaattcttgagaccgggtgcagtg

SEQ ID NO: 157971 - DNA, 495 bp, Homo sapiens
ctgtggaaggcaagcatacggaactccgtctggtatttcttcctggaaacaaacctactctcagaaaacccattgaagtccctgttttacaactaacataatgggcgtgtggaaatgcctctccatccaccagggggcagaaacgaaccctttgattggccagagatctttggacttcaactttgatttggaatagttgtaatttgcatagccttttcactctcagacatcactctttctgtcactaggaacataaccatatagacttttcaaagaaacctcttaattctgtgtgaaactctaaacttcactctaccaataaacttccccacattcacactagagagatgtgatgggaatgctgggtcttacatatggtggtcttcatattttcgtggatttgtcttttgaggcatggagtgcctgacctttgcgtatgcaagattcgctagcatgtaaactctgtcactgtctcccaagaacacagaaacaggg

SEQ ID NO: 157972 - DNA, 583 bp, Homo sapiens
tggatatcataattcctttttttcctatcaccccaaccaatgaatctctctagagccgacctcctaaacgtctaccccacctacattagcctactctttgaccactgtaaggttacacttggattacttatttactgcaacagtctcatttagcagactctctgcttctccccttgtcttattccaatccattcttcagagcaaccagtcgatcacgctaagcaaaaaactgttcataatacttccaacataaaccttcaatggccataaagagccaattcctggcactatataatgtcctccttataatcacgatcccccacatgcctgtcaagagtctcatactccagcttactggacatttcctaaatgacaggcacatgcttgcctctgattcttacacaggctctcacctttgccctggatggtcctcctacccaccttgcttacacggatgcatccttttaaaattcagatttcaagcaagtaacctcctttaggaatgcccttcttgaatccagacccttcctcccccagttaagttagatgacccttccatatgttcccagaggactcaatcaca

SEQ ID NO: 157973 - DNA, 522 bp, Homo sapiens
tgtagatgaggcagcaaacacactcatgactcgtctgggtttcctccttggagagaaagtcacagaagttcagccaggtgaccaatacagcatggaagtacaggatgaaaatcagacctcagcaatcacccagcggataagtccttgttccactctgactagcagcactgcctctccaccagccagtagcccctgctctacactcccacccatcagtacaaatgcaactgccaaggactgcagctatggggctgttactagtccaacctctacccttgaaagcagagatagtggcatcattgctacattaacaagctattctgaaaatgtggaacgcacaaaatatgctggggaaagcagtaaagaattaggatctggaggaaacataaaaccttggcaatctcaaaaatccagcatggactcctgtttgtatcgagtagatgaaaacatgactgcttccacctatagtctgaataagatcccagagagaaatttggaaacagtgttatctcaatcagtaca

SEQ ID NO: 157974 - DNA, 344 bp, Homo sapiens
ttcccagagggcactaatcagactgtgtacttggaggatatccagcaggtgttttctgctctgattcaggccactatcctgaaaggtgcagtccatggggagagaactgcattctagtattagaataaattgtaacttcattttattcccctgaacagtctaataaaggtaggcatgcccttatacatgcagctattcccagcagtgtttgcaaagcgtttgcacagagtaggtgcttaatggaatggtaatttctgaaggaaacattttgcagccaattaaaatacagcacagagtttccatttctctttgccactgtctggaaaattgtagatacatatgac

SEQ ID NO: 157975 - DNA, 461 bp, Homo sapiens
caagcttcaggttatcaaacatgtgagaaccaaaaacctcaaagggtggatgtcaaacctaaatcttttaccagaactctgaaacctgagtaagagacgctcgtgtgaaactgctgtgcatatgccggagccaggtgtctggcatctcacccaggtgggctccccatctacagagaatcctaggcagggtgcagtggctcacacctttaatcccagcactctgggaggctgtggtggaggactgcttgaggccaggagttcgagaccagcctgggcaagacagtgagacccggtctctacaaaaaatttaaaacttagcaaggcacggtgttacgcatggcaactactcaggaggctgagggaggtgagaggatggctcgagcccaggagttcaaggctacagtgagccatgatcgtgccactgccccccagcctgggcaacagagtgaggctctgcctct

SEQ ID NO: 157976 - DNA, 296 bp, Homo sapiens
gcagggacacaggaggagacgggagtccggcggtgaccacagggaagtgatgtctcagggccgccaccgctagatctggggttccagatctagaaacacagctacagctggtttaacaggggtcttcaggaagacgccagagcctcaaaaccagtgtcaccacacgccgacccgggacagggcccccttcttcctgcctcagctgccaatgatgggctacgcttacttctcagctcctgaaatgaatttatcccagctccagatcagtgtctgtttccctgttccttcctttcact

SEQ ID NO: 157977 - DNA, 296 bp, Homo sapiens
tcaatggttctgcaaaaatcataaacactcagaaaaatacaaccctaaattatgtctgcacgttctcagaaatctttaacttcttacgttagttctacttctcacagcacaatgaaccttagctttccctcaaaacaaaatattgtatgaaaccaaagaatatactcagcagataagctggtttataagtatcaaaaccagaagtctgtgtaggggcaattccgaaagttttctttcttctttttttttttttttttttgtgtgtaaatttcagagaaacctctgctaaaactctt

SEQ ID NO: 157978 - DNA, 540 bp, Homo sapiens
atttccaatctggacaagaggcacatggtctgccatgcagcggggccacctgtttcccttcttttccttctcactcaaatgttctccatcatcttttcaccttcaagattctttctattcatggattcacctcctagacatgtttctcttttagcataccaagcctctccactgtcacaatttaatcatcagcctgtccccatcccacgttggcaaaactcctggatcttacgtatctcataatgtggctatgcattggtacagacaggtgaggtcataaatattcccctgctggtctcttctgagaattacttgatccttcctccattcagggacttcttttatgttaccacctgttttctcctgctagggaattaatttttaaatcctcggtaacaattgttcctgacccaccagtatagacccagagaaagaagccagacttgggaagcttgctatcagatcagcgactgctgtctcccattcagagtaaaggttcttttacagtcaatcaacacatgtttattcagtccctgttat

SEQ ID NO: 157979 - DNA, 497 bp, Homo sapiens
ttgaggcagcagtgagctatgatcacaccactgcactccagcctagaaaacagagtaagaccctgcctctaaaaaacaaaaaagagtgtcaaaacacagaaggagtagagcaaattagtaaaaatcctccaaagcacctataatggcagaaaggaagcacaaacgagaaaaaaagttaatgagtcaaaaaagaacttgctatagtacttggtcaaagctaactttaaaatactattaggaaatttaaaacattcataaaagctatgaggttcaaaactaattttacaaaacactagctgaattatcactatattacaaacaaatgcaataaagtaagagaaacagatattcttagaaaacagaacatggaatatgttaataaaatcaaaaggacacaggatcaccttttagagtgactaaaatccaaaaaataccatcagcaaatgctggcaaggatgtgaggcaaaagaaaccctcattcattgctggtaggaatg

SEQ ID NO: 157980 - DNA, 607 bp, Homo sapiens
cagagtgaggttctaggctgagaacaggtggagtccctagaatgggttctgacagggctaccgtgcaccaggagctgggatggagcgctgcccatggtagtatggatttggtgggaacgtaaggagacctgctgtcatcaggggatgaggatggcttccaggtagcccctcccacaggtacacccgtgccaggaggaaacatgatatcgccctctagtgagcataaggtagcactgcaagggcgtgtaagtgcagatgcacttgtggaactgcttggaggaccttcctgaatgtgcagccgatgcatccttctgtgatgtgcacaccctcccaggagccccctgcatcccacagtcagaaggctcacagtggcccaggttttagttttcaatgtctcagctccctgttgtcctgctcccatttttcctgacccagtggggatgccaggttccttctcctgccttagggaaagtgaatgtcctcccctctgtgtctgtctgtccagatgtctctgctgctgccctcggggcctgcagtggagctgaggagctttatgatgtttcctttgcttaccacagtacttacccagccattcatcacccagact

SEQ ID NO: 157981 - DNA, 318 bp, Homo sapiens
ccagcactgagtctgtatgcccctgacgttacgggagaaggagatggaattcaacactttaaaaagtgtgggggggttgcttgaaaagagtcttctaggttcagcggccccaaaaagtccctcctatgaccactgtcagggagcgtgggaatccatgctgtccaatgttagaatgacccactccgaaatgcaaggagttgaacaatcattcagctggctgcatttcatgtttatttacttcactttttgggtggagaacattttcactacacgctgctcaagtgatcccctgaaaatactgtttgcatgagattggat

SEQ ID NO: 157982 - DNA, 199 bp, Homo sapiens
aataaacgtgcaccaggcctccactgcatctccatcagactcttgtgtttaaaaaaaggagcttgtctgaaagccacatggttgaaaggcatttaatcccaaagaatgtttatggccattcctccaatttcaattaattctgaacatagcataggtcaaggggcaggttgatctaaagggaaaagcaaaatcaagattt

SEQ ID NO: 157983 - DNA, 701 bp, Homo sapiens
tctgacagtcactatgctaactagtaaaggtgttgatcaaactatagagagtgctgcactgatggcagcccctggagagtgcacccttgaagatgtaaagctaggtgacatcatggaatgtggatgcttcattaatgtaattcacattcccctgaagttgaggctgaaactaactggcaaatatatactatcagatggtctatgaagaagtatttttaaataaattacagacatcataactccatgataaagactttaaggatgatggaagtcagcgaagagttttaagctggagacagcattactgttaatagatcttaggtgagaggaatctgaccaacgttatggccccccctgtaagctttacacacatagctctactctgacttctccttgcaactgtactgtcccctagccatatgtggctattctaatataaagtataacttaactaaaactaaaacttcagttcctcagtcccactagcaaatttcaagtgcctgatggccacatgtggcttgtgtcttctgcactgacaatacagacacagaacatttccatggtcacaaaaagttctactgataccgctgatctagaagaataaagtttcaagagaatgataaatttctggggatggaaaataattcaaggccaggcatggtggctcaggcctgtaattccagcactttgggaggccgagg

SEQ ID NO: 157984 - DNA, 180 bp, Homo sapiens
gttttagaaaccgtattattaacaaagtaactaaagccacaccactggtaaccaaaaataaactttattaaacagttaacttatttcagctaactatagaaattctgtatttcaaatgaatattagttattctgcatatattacgtattctctatattttttatatgtaataaaaaatct

SEQ ID NO: 157985 - DNA, 475 bp, Homo sapiens
tgtcaacccctgctttagtgccgcagattgtcattaagtaatttttaaaagaaagatgtatttattttttaatatttggattaattttacagcaaatacttgattttgcatttaccaaaaaagttaatttaagaaaaattttgagcaagttatatgggaaaaaaagtgaactaaacaacttagacagacacagagtcaccaggagcctggacttcttatgaactcaatatgtatatgaatacatgcgtgtgtgtgtgcatacacacacacacacacacacacacattttaactaataccaggagtcaaaataacaaagtagtcaacataaactaaccaagtgactattctgcatataattcagctctaggttttaaagaggacataaacaagtattaagtagttcttcccttcatagagtttaccatcttagtgggaagacaaacacatattaaaatactaaaacaatgagaaaa

SEQ ID NO: 157986 - DNA, 154 bp, Homo sapiens
atataggtaggctacattatttagttaatgtgttcatctagaaacttagaaaaagtcagcatttaatatttattttttgagatgtagggtttcactctgtgcccaggctggagtgcagtagtgtgatcacagctcaccgcaggctcaaactttt

SEQ ID NO: 157987 - DNA, 142 bp, Homo sapiens
ccacctcagccccctgagtagctgggactacagttgctctccaccacggacgctctctctgcgggggtttctacatgctctgtgaagacatcgcccatggctaacagaacacacacctgtgtatcctcagttttaatttcta

SEQ ID NO: 157988 - DNA, 226 bp, Homo sapiens
ggcttcagtcttagtcttggtggcgtgtaccccgccttatggacaaaggtggcttgtcctgcccatatgctcatgtcattccatctggatatggggacagtgaggctggaataggcaaacagccatctagaggcagacccagaactctcagttcttgctgtcaactcaggtgctttctgcctagagactcctgaaggactctacttactgaaatccacaaaatcta

SEQ ID NO: 157989 - DNA, 329 bp, Homo sapiens
cacctgaaaggaagcatccagctcttcgaagctaagctggacaaaggagcccggatgctctgggagctcgccattgacttctcccctcgatgcagtgagaaccctgagaagatcattgccacggagcagaacacgtgtgcaatggagaaatcagggcggatctacacggaaatcatccggatttgggacatcgtcttagatcactgcaaactggctgattccatcaaggccatctgcaatgcctacaaccggggcttgtcctgtgtcctgcggaagaagctgaaaggtatcaataaaggccaagtgtcagctaacatgaaaattcaaaa

SEQ ID NO: 157990 - DNA, 199 bp, Homo sapiens
gacagtaaagtagaagagagaaagggtaacagagtctttatatttccttgacttatgatggaaaattttaagcatataaaaaagttagtgatcataaggaattgctgtgtaaccaacttcaacaatgatcatggtcaaccttgtttcaaaggtcaacaatgactcacgtttcaaatgtacccctgtctactccccccac

SEQ ID NO: 157991 - DNA, 216 bp, Homo sapiens
cacaggaattggagaaagaagacttgggattaggtcctgccccatccctacatgctgtgaggtctttcaaatcacttctgagcctcagcttgcaaccaggtaaagtggaaggaatagcatgtgcctctcccttctcctgaggaggtagtgagaagttaatcagatgagatgggcttctcgtaagctgtacagtgttattctaatttctggatttaa

SEQ ID NO: 157992 - DNA, 409 bp, Homo sapiens
ggtatcatcaatatggaattagggaactctgtagaacaggcaatattctttccccattgccttccaacctcagcattccaacacacaagattccaagagagtgctgtcaccccctgaatccctaatgttcaaagacagaactattttctttgttcccataccaatacaagattagtatgcttttgtcaatcattaaacttcctgtggccaggcgcagtggctcatgcctgtaatcccaacactttgggaggccaaggtgggtggatcactggaggtcaggagttcaagaccaccagcctggccaacatggtaaaatcccgtctctactaaaaatacaaaaattagccaggcgtggtggcaggcgcctgtaatcccagctactcgggaggctgaggcaggagaatcactt

SEQ ID NO: 157993 - DNA, 472 bp, Homo sapiens
aggcctggcaataactaaaaacgtgttcacttgaagggtaagagaaagacacagaaatggggaactctgcccttcgcaccccaaaacccagaggagattccaggcctgtttctttgtctgaaagtggaaataatccctgccacttccttacagaaccactgagatgtaaatgtgagcagtgcaaagttctctgcaccctttagcatattcagagttccaaggcaagagacatgtaattttagccttcatgttacagacaggaaagactggccagctgaggccttaaggggagctgacctgcctggaggcacacagcaaacagtgatgggaaagtcattttacaagggttacttttaatcactgcactatgcagagcacaaaattctgtggttaggacactattttgttaggcaaatagctgtgacttggagagcctgggaacaaaatacccaggctcatgtacctaggctgc

SEQ ID NO: 157994 - DNA, 781 bp, Homo sapiens
agagaggtggatttgtctgcggttatgcagtgagtaagtgatatagcagggattctagcccaggttttctgagtctgtattctgatctagtgcttctcaaactttgttatatggatcacctaaggatcttgttaaaatgcgggttctgactcctcatatctaggtggggcctgaaattctgcaacttttaataactcccaggtgatgtcagtgctgctgatccttggaccacacttgattagtaaggctagtctttcactacatccaactgctcttgagccagatttgggaactacaggtgtcctgtgcccttaaactgattcagtattgaaagtcattatttttaaatattatcaactggaggtgattactatagaatatgagtcacgctttgagtggcttccctcaggatattttagttgtgtacacttgttctgcaggtaaactgtacaaaaccaagattcaaacctcaggggtgtaaggaaaggttgggggaataaggaagtgaaaaaaaatattagataaaagtattgaagtaatggtaatagatatggatggtgattcatagtaattcacttgttttcttttaagttggctatctttctaacctaagtttaggaagcaatgtttattatatatagagatgtgggccgagtctgttctgaccacaaggggaagcattttagattgttaaatattattttggaaggtttttaatgaagggttactgtaatttaaggtattttcccgtatgttttttggaaaaaaaaaaaattgtggg

SEQ ID NO: 157995 - DNA, 624 bp, Homo sapiens
ctcttcgttgatgctctaattaagaaggagaattgtatagaagaaagttgttctctacctagattatcttgtgtgactatctccaagtggccagctcgcagctgtgctgttcatcatcaaattaattataaaatatcagcattggaaggggcctgaaagatcacctagtattcacacacccttttttgcctctttatagtcctctgcctttagaaaatcacacttcattgtaatgagctgttgaatgtctgtcttagccatagcattagcataagcgtaagaagagcagggtcaagacctggtgcagaatccaacaaactgctccaaaatttagaggttgaaaataaccatcttatttactcatggatttgcagtttgggcagagttcagggggaagacttgtgtcagtgactagagcaagaggatctacttccaagatggcttaatcatatgaatggcaaactaatgttgcctgtgaattgggagatcagctcaattctcttcaacatgggcatccctatgtggcttgggcttcctctcagcatggcagctgggttccgagaaagaggaggtaaaggtgcctgttctcttaaaatatggaagtgaaacgggcacaggatcatt

SEQ ID NO: 157996 - DNA, 487 bp, Homo sapiens
tgtctacacaaccaacactgccactgacctggccagcagcaccgactcttcccactgagctaaacctggaagtcaggcagtccctctctgaccagccctcctgcgatgctgctggccattcctctgccttggctcagggatgttcggctctcctggttgtgcttcctgctctctcacctcctcctccaaccaatcagtacctaaggagagctctgagcgttcctacctctgccaaggtaagaacgtcttcttagctgcagtccaatacattaaaaaacagtgggggctgggtgcagtggctcatgcctgtaatcccagcactctgggaggctgaggtgggcggattacctgaggccaggagttcgagatcagcctggccaacacggtgaagccctgtctctactaaaaatacaaaaactagctgggcgtagtggcgggcgcctgtaatcccagctacccaggaggctgaggaagaagaatctcttga

SEQ ID NO: 157997 - DNA, 1109 bp, Homo sapiens
  misc_feature (29)..(29): n is a, c, g, or t
  misc_feature (87)..(87): n is a, c, g, or t
cattgccaccggccccctcaggtcacggntcgatagcttgtatcgaattcggccgagcaagcctgtgtgcattcataagaattcggnatgtctgaaagagcagcagaaacgctactttcagtattttcagacagagtggtatatactccagaaagcctctacaaggaactcttctcacaacataaaggactcagagacttaataaatacagaaatgcgccctttctctcaaggaatattgattttttctcaaagctgggctgtggatttaggtctgcaagagaagcagggagtcatctgtgatgctcttctaatttcccagaacaacacccctattctctacaccatcttcagcaagtgggatgcggggtgcaagggctattctatgatagttgcctattctttgaagcagaagctggtgaacaaaggcggctacactgggaggttatgcatcacccccttggtctgtgtgcctgaattctgatagaaagcacagagcgtttacagttcgtatttacaaatttaccctgaatcctataacttcatgaccccccagcacatggaagccctgttacagtccctcgtgatagtcttgcttgggttcaaatccttcttaagtgaagagctgggctctgaggttttgaacctactgacaaataaacagtatgagttgctttcaaagaaccttcgcaagaccagagagttgtttgttcatggcttacctggatcagggaagactatcttggctcttaggatcatggagaagatcaggaatgtgtttcactgtgaaccggctaacattctctacatctgtgaaaaccagcccctgaagaagttggtgagtttcagcaagaaaaacatctgccagccagtgacccggaaaaccttcatgaaaaacaactttgaacacatccagcacattatcattgatgacgctcagaatttccgtactgaagatggggactggtatgggaaagcaaagttcatcactcagacagcaagggatggcccaggagttctctggatctttctggactactttcagacctatcacttgagttgcagtggcctcccccctccctcagaccagtatccaagagaagagatcaa

SEQ ID NO: 157998 - DNA, 443 bp, Homo sapiens
  misc_feature (48)..(49): n is a, c, g, or t
agctctgaagggctgatacgatgcgtttgtcaatagaaaggggaatgnngggaaagaggagagatggattgtgctgtgtctgtgtggaagagtagacgtggcgactccattcatcgttgtagtataattttgtgtgtgtaaaacaaaacaagacaaaaatagcctgttattttcatgatagaaaccctcttatttccatgatataaatcttggctgatggatatcaatggtgagaggaagggaatggagcttttcggcttatcttagggtatctaggtttagaaggaatgacgctgattttctggaagggacgtggtgtggacagaggagagcggctgtggagtcagatggggttgctagggcaagaataagaagcttagagccaggccctacgtagtagcttcttattcttggcctagcaacccccccttttccacagcctt

SEQ ID NO: 157999 - DNA, 505 bp, Homo sapiens
gagcctgtgcgtatggcagcagcacggggctccgggaggacgtggcaggcgagaggtgggagtgggaggggagtgacccccacctgcctccacggatgctgaactccagccctggaactcccaaggcccctcctccagaggaagcaacaaggtttgggggtgtctgagaggctggctggggtcccacaccccagtgcagaccgaggggttctggcccccagcactgtgagaaccccccaggtgtcctgggccagggtcaggaaaggggcgggatccctagggcccagacttgtttggggaggccagggtgggctcggcgtgtgcgagccactaccaccacccccatgtcaggggcccgccactgggaagtgggtccccctacctttgcctcgtgggtccccttgcacaagtggggggtccagggtcacagtctttggctaggcctcagccccccatgcggccaagctggacacgtggccccagcccctacccatagcacactcgg

SEQ ID NO: 158000 - DNA, 535 bp, Homo sapiens
aacttgcagccagtgccgagccttgactcccttgcagccctttgctcagctctgctccagcctttgcctccctgaagatggcacttaccattctctgctccaagatgctaagtatgcagaaaggaaacaaactgttgccaggagggcagaacgaagaatatcttttctctcagatgcaacaaatatacataatactctggtttatacaaagatgtccttgctaactcttgtaaagagaggttaaaactggaaagaatccccatgtccagtgacagaagtagttacattatggtgcggccacaggacataagggcagacagtcttaacaataaggatttgttaatgatttgaggtaatgagcataataaaatgtcatgtggaaaaagtcacaataaaaaaatcagctaggttttatgatatgtatgtcttaaatatttttttaaaagactatgccaggcatgggggctcatgcctgtaatcccagcactttgggaggctgaggcagatggatcccttgaggccaggagtttgagac

SEQ ID NO: 158001 - DNA, 162 bp, Homo sapiens
ttctcaggttacacagattaaactaaatcctgcagcaagtgatgtctataagactgcaattcactagcaaaggagagggaagcaataaaccacctcattaatgcaaattatcatcatcaaattttatctatcaagctcccgcaggtatggtatggtcagcct

SEQ ID NO: 158002 - DNA, 526 bp, Homo sapiens
gaccccacactctgaatcatcgtggggtttatctcccaccctctgaagcacgtgtcttaccaaggcctccaatacatctgccccttcttggtcatccagtctaatgaacacaatgccatcaatatagtggatcaatgtgatgatgttcaggacattcagatgatttgggtcccttcagattatattatcacagaaaaggaagagttaacatagcctcaagataagaccttaaatgtattctgtcgtctgttccatgtgaacgtaaaccacttccgcttctcctttctgagaaagatgggaaagagcacatttgccagatctgtagccacacgccctgtattaataattagctgtgttcattggctgggtaagatactactctggcgcagtaattgcaagtggagctactacctggttgagttggcagaagtcaactgttaacctgttttgtttgtttgtggttttcttgtcttttttgtttggccagaaactgattaatttaatggggatatgatgaggctcacta

SEQ ID NO: 158003 - DNA, 390 bp, Homo sapiens
cttttgcagggaagtattactgaaggcttttgaagagtcaaacatgtagctcaagggaagccagcacacactaattattaatcctgttgaagagccctggttgaccagagagtaggatttctgtttagttttccctcgctctgttgtatttgcacatccttgatgatttcatgcctttattatgggctttattgatttgctggtatgtagatgagactcctggtttgtcatgtaggagtgcttcttatcctgaggaacttgatggtgatctaactaccttcgagcaaaccagtggccatttactggaaggggtgggacatcttgggccataacactaaacctatctttggcagtcattcagaagcaaagcataggtatccttcaagactg

SEQ ID NO: 158004 - DNA, 362 bp, Homo sapiens
ggattagcctgctaagccccgggtgaggagatggcctgtccatgctggctctgactcaagagacagctgccccgcaccaaccgcagcagcaaacagcagccatgtcctcccccaggagagcctgtgttaaaagctgaagatacaggttttctgcttcaaagtcatggtgaccttgggtgagcccctgcctggcttcttagccttctcatctggaaaatggggactattccaagcctaccattcacagggttgagacaaggtataaaaaagatgaggtcctcgttaacacggtgaaaccccatctctactaaaaatacaaaaaattagccgggcgtggtggcgggcacctgtagtcccagcta

SEQ ID NO: 158005 - DNA, 360 bp, Homo sapiens
cttctgagtttgggaggtaacactggccccgcccctcacgccgtggctcctccctcccttccccttcaaggggctgaagacaaaaggtgcccctgtcctggtcaagccaatcgacccagccttgttatgggttggggtggggagaaatgtgtcctcctgatggctggggaagaagaggggttggatatttctagccagggccatgccaggaggctggtcactctgcaaggggatgcagaggaaagcggtgcccactcactccagctcttttctcctcaaggcagaatccttacccctcctgctcaggttcctccaataggcctttctctagcccaagagagaaaggtcctctggagtgag

SEQ ID NO: 158006 - DNA, 427 bp, Homo sapiens
gtactgagaaaaatggtaaacttctacttcctgaaattaagcgtttctgaacagagattcatcaaatctgcagaaaagagaaaggcagataaccgtaggttctgaggctcggtgtttcctccctaatggctttgccaacagaaatactgacaggttttgtctgtcacgggccttactatttatcaccttttcctctcctacctcctactgtggtcttgcctcatctgtacttcatgtaccttaagcctaatagtgaatgttgaagaaatgtctctctttggaaattatctgttttattttattgatttaaggtcaaattaagaaataagataatgagacttgtcaaagaaaacgaatacatagaagatgaaacttgcaatcctaatgcctctcctggcaaagaagacatttcccaccaaatcactaa

SEQ ID NO: 158007 - DNA, 471 bp, Homo sapiens
tcgtgcctcagcctcccgagcagttgagattacaggtgtgcaccaccatgtccagttaatttttgtatttttagtagagacagagtttcgccatgttggccaggctagtctcgaattgccgacttcaagtgatccaccctccttggcctcccaaagtgctgtgattacaggcatgagccaccatgccctgccataattctgataattctttggaaggaaacagctatttaaacccaagctatttttccccaatataatgtttattttttacttataaatatatgctgattatgaaaattgtggaatatatgaaaagtatatagaaaaagttagaatcatctataatctccccatcagacattaacattattaacatcttgatatattttcttctttaataattaacttttatttatctagtcaccataagactttataaaatctctccaagagagaaactatctttctaga

SEQ ID NO: 158008 - DNA, 323 bp, Homo sapiens
tctaatctgtcaagtggggatgtgcagtggtttctatggcacaggtgcctgtgaggagtaaatgtgtatacatcacgtagtatagcatgggacataacacacatccacgcggtaccttgcagctatggttcttggaagggaaaataaaactcagatgtggaatagtttatcagatgagggtagtttagagctcaatcctgggaggaacaaccaatcaatcaatcagcaagaacatattatggaacaccaagacgctttgccagggattgggtgcgattgccagaagctgcaatggatggcgaggaagagctgcttcttgtggg

SEQ ID NO: 158009 - DNA, 778 bp, Homo sapiens
ggctgaagggtcagtctagggatggctttctgacaagtcacagaaggcggcactgatgactgcagacaccttaactgaacaatccttcagtacttatcactgttccctccaagctactgtctttccagattcactgggcattgtcaatccctggtaaatgaactgtcaacaaccaacaaaaatcttacctgatctaacaagttcaatattccaactaaacttgcttcttgtagaagtctggaaggcttgccctttactcaggcactcatttattcatttatttattcgcaccattcacttatccgatcaacaaatattctcaaccttaaaaaatcctgagatgattctggataataacaagaaagtttagacaaagcagcaatcagcagcacaagagctggaaccaggaactaaaggaatacctaaccacatattgtgcctggaatatctttctgcccaactgcagtgtcactctacaggaatctttctaaatctcattttaggaagaatgtctttggatattcctctattaatatccttagtgtaatgcttatgatattacattgaaattaaccgcttccactcaccagactgagctccttgagggaaaacaactgtgtcatccaatcctctttgtgtccctggtatccagcacagggcctggcatatagaatttattaccaatgcagcagttctctagattccaatgaagctaacagatttctaggtattatcagacctgcattgttcagtatgatagccactagctacatgtggc

SEQ ID NO: 158010 - DNA, 647 bp, Homo sapiens
caatacagtgtcctgattccagtcatatactttcattttctacagtagctggtgataaaatatcatggtagtcactggttttaggtagataaatatgtactacaagacatttatattgcttaatgagattattgtgaagcttcaataacattgtacaactatcttctctctcgtttatagctaatgattgaaatcacacgtcatcaatcacattataaataataaaaaaagactaaatgcaaattttcaccaattttcttcaaaaaatcatctgcccagggagatcatttcaaaaatttcatatccagtttcttattcttacctttaaaatttctggctttgttttttccatcacatgagtcagactaaaaagatgaaatagagcttcccgaacaaagaatgcccgttcactgtaacgcttcagtgcttctgcaatctgagtttcattggcttccccagacacctgtgaacataaccagattagcttttagaattctctctctttctctatctaattatcatgtgtggccaggcgcggtggctcacgcctgtaatcccagtactttgggaggccaaggtgggtggattgcttgaactcctgacccaggtgatctagctgcctcggactcctacagtgctaggattac

SEQ ID NO: 158011 - DNA, 194 bp, Homo sapiens
cctagtttagaagttcaatagcacattgctgctctggaggatctggagaattaaggtcagcaatgcaggcactcagtcatgtctatgtaaccaactcccaataaaaactctagacatggctcaggtaatctgcctggttggcaatattccatgtgtattgtcatacatcattgctcatagaaataagtgctatc

SEQ ID NO: 158012 - DNA, 235 bp, Homo sapiens
ccagtggtgggcctacaggagtgcttgataaatgctcattaagtgcctagatgatctccagggacccttctagctgagatttggctttgtgtttgggcataggtgaccttctgaatcccaataagaaaatgagttaaatttgagacagtgcttcttgtaggcggggtagccatagggacttattggaggcaggggaactgggccaggtctgtgaaggaaggtcagcatttgaaca

SEQ ID NO: 158013 - DNA, 170 bp, Homo sapiens
tgacattaatattagtcgatgtctgttttttaccctaaaaataactcgagtatccaatgtattaaccacccctttattttaaaacataacaacacaggaggcgaaggtgggaggattgcttgagcccagtagtttgagattactgtttctaccactgctctacagcctgg

SEQ ID NO: 158014 - DNA, 238 bp, Homo sapiens
gtcaggagtggggcaagaatattagaaatccaccagatgaaaatccttcaaataaacgaccttattacccccttgacctatataatcagcatggagcaaacaggaataattgccctgtgcaacccgagtgtgtgagtttgagggaagggggacagaggaattcaataaccaataacccacatttacctacttcttccctctgaatattttacattagaaatgacagaagatttgggtt

SEQ ID NO: 158015 - DNA, 400 bp, Homo sapiens
ggagaaggcagtgaggggagggcagtgggggcggagatgagggaggaggcatggccagggcaggtctggcagggtcttgaaggccaggctgagggtaataaaagttagcacagggttatttattggggggataaaagaagtaacacacgtgaaatgttgaatggcacagacattgtcatatacttaaaaagtttaatactgacttataagagactagacaacagttttataatcatgtccctttcctggctttaaatggaaattaggtagagattatattttgccctccttcagaccacagactagagttgaaatggtgagaagtggtgagatttgaggtcacttttaaaagtagagccagcggcctctgcaggtaggtggggatggaagaagaggaggt

SEQ ID NO: 158016 - DNA, 653 bp, Homo sapiens
agatttttcttctcacagactgcaaagtcatctgacatcggactatcttcatagtacattttatcactgcctcagtatatttccacttggaataataatataattctgcctttgaattatggtaaagggttttaagacaacttatttggaagtaagggtgatgacagaggtggtgataatgaatacccaaagtctgttttactttatctccccaaaatgtaacagtaataacagcaacagcaggtaacatccattgagtgcttaccctctgccagatcacctctaagcattttacaaatattaatcatctaatcatcacaacaatggtatgaaggagctattaatacctccattttacagctgaaaaagctgaggcagaaagaggctaaatgatttgtctcagatcatacaagtgaatatgtggcaaaactggaatttaaacaaggtagtctggcactgaaacccatactcttaattggtatgttacactgcttcgaacaagaccaaagggtactaaaaggtgatttataagtaacaggttccacttaggctcagaagctctaatgataatcctagtgaaagaacatatgtgctgaaggatgcatcatttatttggggaaggtaatactgtatggttttgtcagaggaatgga

SEQ ID NO: 158017 - DNA, 413 bp, Homo sapiens
aaagaaaatgaaagaccatgagaagaggccaagaaaggcaatgagaggcccgagcaaggacactgaggaggctgcgcacggggaggttggagcggaacggccttgggctcccacctgcacagtaggatctcacccccggattgaccccggccctggccctcctccacactcttgacacaggaggaggcacgcctccagtgaattctgcctcacggtggctgctgccctcctaagtgcaaggctgggcttgagaatttcaggggagaaactcagtagtgagtgcttctcctcagctgcagcagctggtacttagtggctcttaatttccctgctttctgtgctacttcccaaaggcacacagaaagcggactggacatctgtgccagagatgactagcttcaggagtgccgatg

SEQ ID NO: 158018 - DNA, 125 bp, Homo sapiens
ttttccttttgcagtctgcaccatgatgatggcccatcacctgaccagcctgactttaatcatctggtgccttggtcttagcgtggctctgtctttgctttttcacaagctttcctataattgta

SEQ ID NO: 158019 - DNA, 354 bp, Homo sapiens
cttaaagtataattaaaaaaaaaaagaaaacagaagctatttataaagaagttatttgctgaaataaatgtgatctttcccattaaaaaaataaagaaattttggggtaaaaaaacacaatatattgtattcttgaaaaattctaagagagtggatgtgaagtgttctcaccacaaaagtgataactaattgaggtaatgcacatattaattagaaagattttgtcattccacaatgtatatatacttaaaaatatgttatacacaataaatacatacattaaaaaataagtaaatgtataagtttttacacattatatatatgtttatattgctactcatgtatctatctgga

SEQ ID NO: 158020 - DNA, 185 bp, Homo sapiens
acccagatatttaggacaaatcagaaatcctcgttggatgctctttctatgcatgtgaacacattttggttggggcagggcgaggaacctctcagagccatggatggggtggccgtgaggagggggagttgcatgctgggtatgccttatgggtgggcatgaactttgtggaccaaaggccacag

SEQ ID NO: 158021 - DNA, 310 bp, Homo sapiens
gcttagaggacccggctcattcattcataagctgtctagggcaaaaaaatgaaagcatttataactaaatttcaatttagttctaaacttagttctaaactaaaaagcatttagttttattattgtgatagaagtattatcttctcaaaatgtattctttctgtcctttatcttcagggttttatacgccttttagttttttaggaaaagcacagctcaaacagaaaatacctttctctgtccttgcttgaactgaaggagaagtttctaagttactggccagtaagcagtagtcatgtatgtgtttagg

SEQ ID NO: 158022 - DNA, 535 bp, Homo sapiens
gaggtcttgtgagtctgaaaatgaggatccgccccctgcacccatcattccagctgagtcaaattactgtgtacctcctcatgccaggctatgctgcttcagcacttggcacgcgctgccgtctctgtttcgaatgccctttcccacctaactcattcctcccacccttccatacttagacaagtctgagcttttctgaccagtctttcctgaacagtcctccatcccatcatcaccttaactactgagagtgaaagcttcttcctacccaggctaccggggttcatgcaccctctttggttggtttacttatctgtcactaaactgagatctctttaaagcaggaacaagatctctttttacctaactcataacacagggtaaacagacaacaaatgtgctgactaaaatgctaatataaaaaatcccttagtgaaatgtgcaatgttacatgtgaatattggtaaggcaacataatagcaaatataaatttaaagaatatcttttaaaaaggtaacattccctaagagtatta

SEQ ID NO: 158023 - DNA, 408 bp, Homo sapiens
ctaatctctctcagttatagtttgttctgtaaaagagaataataaaataaatcttctgtaaaagaggataatacaataaagaagatatatgtttatttctattgtgtgtagaaggcatactttgattgttgtgaggattaaagaaacattgtaagtacctaaaatattaccttgcacatatttagcacttagtaaatgttatctattactaacccttaggaaaattttgcaaggtaaatattgttatacctactgcgtaaatgtagaaactgaggtacagagaaggcatagcttgtataaaaccacacagtaaatagtagaagtaggattcatatccatgccttatttccaaattcatatgcttgtcatattgcctggtaaataatggagaagggaaaaaatcagaaa

SEQ ID NO: 158024 - DNA, 209 bp, Homo sapiens
cacacacacacacacacacacacagtgctcatgttatgtaaggatcatcagtcgatgtatttgcatttccaatcataattctatttggccaaagctcgctctttattaaatgatgctaaacatacataacactttttcttcctttttttttttttttcaaaaattcccttatatacactctgatgctcagaaacccgatggaccgataa

SEQ ID NO: 158025 - DNA, 436 bp, Homo sapiens
atttctccctcttgacaaagtagataaaatcctagggataggaatcagtgctttactgatagaaaaactaaaaacctgatatacttggcagagcacacacacagcaaggtctctaacctaggtaactgaggccagacttgatagaaagatatgtaaaaagcaacagcactgtcaaaaaaatgaatgaaatgccaatctttaacctcagtcccttcacctagtgagtaagaaaaggaaaagcaacagttacatctcttgccatagattcatgtacatcccatgaaatcagtaaactcccatgctacatattagaatattgctgagttctggctgtttattcaggaaagtgaaaaataataataaagaaaaaatataacctctaaatattgcagattgacagtacggccaagaaaagataattttcttatatgctgaa

SEQ ID NO: 158026 - DNA, 472 bp, Homo sapiens
tcgcaccactgcactccagactagcccacagagcaagaccccgtctcaaaaaaaagtatagcagtgtagaataaattggtatagaagcaacagtcccaaatgtctcaataaggctctgaggacatcactctattaaaattcatatcagcatcgatattcattttaatgatctcaagataaaatcaagtaaagataaaactgcactccaggctcaccactgcactccagactaggccacagagcaagaccccgtctcaaaaaaaaagtatagcagtgtaaaataaattggtatagaagcaaacagcactttgggaggctgaaggtgggtggatcacttgaggtcaggagttccagatcagcctggccacctggtgaaaccctgtctttaccaaaaatacaaaaattagccgtgtctggtggcccatgtctgttaatcccagctactccagaagctgaggcaggagaatcgctt

SEQ ID NO: 158027 - DNA, 378 bp, Homo sapiens
gagagcttaggactctacagagacaggtctcctggaccccagagttgggaaattcaggactccctttttgtcccatgttcagacatcctctggctctaccttaacatgggattgtggaatccaagaaagtgggagcttgggagtttgaagcagcgagtccaacccctcagtgtagagctggggaaactgaggccaagggagtgaaggtcacaggacaatcaaagacagagtgctgggctgggaaaccggaccccggggctgtggttacagggttgccattgcctggctgtgagcctttgagcctctgggccctctggcccgcgcacttctccttgatgctcgtgagctatacacacctcctctgaggatgcaggctca

SEQ ID NO: 158028 - DNA, 624 bp, Homo sapiens
tgaaacagcacctgctgatggcatgggtgctggaaatgagagcagggtggcctcttcttcatcttcacagcctctccataagctcagctcagagaggtcaagtgacccgtgcatagctacatagctaggaagccatctgaaagtcctactctttcctgcacctctctgttaccacacttaattcattcactcaacagagggcagttgagctacactattttggttcctggggagatgacatgtggctcacacatgggtttggctcctaggggatcaaatgcctctgtggctagcttgaaaaacagcccccacaagaatgtccatggcctatcctcagaatctgtgaatatgtttgcttgagatgaggagactgtcttggatcatctaggtggggctaatataaccacaaaggtactgggccttataagagagaggtagggggaccagagaaagagatttgaagataccatgctgcaggatttaaagatggaggaagagaccatgagccaaggaatgcaggtgacccctagaagccagaaaactaggaaaccaagtcggcaggttgttttagcatttatatcctcatagctaggtagcattatatctctagatccagactattca

SEQ ID NO: 158029 - DNA, 272 bp, Homo sapiens
acggtggagtctgaacagggcgcgggtgcgaggagtcggctgggactcggggaacggaagactggcgcgggcctgccctcgtcctcgttccggcacaatcgagtagggcagtggggcgggtggcccaagggtgtcagagcaaacttggcgggcactgggcggacagctgggcttggagctccccgaagggtggcctaaggatgaagccccctagttatgcggaattggcgaggagcggggagaggcgttgtcattcgcgggcagggtttgtg

SEQ ID NO: 158030 - DNA, 663 bp, Homo sapiens
atgagcaggggacccccacatccctggccaggacaggaggtgcctccgcagggacttgccccaaaggggcaccatctccagtcatcctcagagtcaggcaggcttgccaacctgtcctttcatctctgtcttgctcccaggcaacccgtaaacccctcggggcccagaggccacgcctcactcgacagctcgggagagccgggcacaggggcagaagcgacttgccgaggtcatgcagtgacatggagcctgaactgaaagaccatcacagcttgcaagccacctccctgctctgttgctggctctccttgaagacaagtgtttttcaattaaccaaagcggtgcatggcaatgtgataggggaatgaaacacagcagcagattcaatgccccacgctgggcaatagccgactttctgttcgctcccatcccttccttccctccccgcctccttcccctgctccttccattccacaaacatttattgagcacccgctgtgtgccagccactgttctaggccctgaagacacagaagtgaacaaaaaaaagagtccctgtgcacatcctggagggactttccccgtgtgtgtgtgtgtgtgtgtgtctatacagtgtatggagacagtggataataaaagctgtttatcaggcactttctctga

SEQ ID NO: 158031 - DNA, 381 bp, Homo sapiens
tccgaggagagtcaagccacacagctcctctgttcctctcctctgcttgctgcatggctcttccaagtatgtacatctggggagaacgcacaactcaacgctttatacttccgtcactcttgctgctgggtgaaggacgggggaagtcggggaggctactaattgcagtgagagaggatcagggcttaaattaggggtaagaggattgagaaaaatgaagaggcagagtcaacctgacttcatgattagcaagatgggggtaaggagatgagagagaagcgggcttaaagttgtctccaagtttttgactccagtgatgactgggtagcctcaacgctttatacttctgccttagacattgttcaatcatcccctcattca

SEQ ID NO: 158032 - DNA, 581 bp, Homo sapiens
ataagcttgattcaggtacgggagtgggaatgacactctgtagagtttctgcagcctgaacctactgagatgatggcttctgaggggttatcctacttgtgttctcacctgctgtaagcaaactgaatcttgggtaggaacactatgaaatgtgctctttaaattgccctgtctacactggtgataactgaacactctttgtgtctatagtttgtggtgggcaccgtttttcttttttattttattttattttattttactttattttattttagtgagacagggtcttgttctgttgcccacccaggctagagtggcgtgatcacggccactgcagctgcagcctccaggctcaagcagtcctcccacctcaacgtctcaaatagcttggaccacaggcatgcactaccacactcagctaagttttttattttttatttttgtagagatgggttttcattgtgttacccaggctagtcaagctatctgcctatctgcccacctcagcctcccaaagtgctgggactacaggtgtgagccactgcccccagctggaatcttagtactagttgttacaatgt

SEQ ID NO: 158033 - DNA, 120 bp, Homo sapiens
ataaaaacattctcctgtatttttatctaatatttgaattttcaattcatataaaatttatttgttagtacagagcactatatatgatctaattttgtttcattttagatggttagctga

SEQ ID NO: 158034 - DNA, 135 bp, Homo sapiens
tctaatcactctttgataaaaaaatgagcatggcttcatgtcaagctgccatattctttccactctcttgacagtcctttggtgccaattggctactgagagccccagtgaccgatggcgtccttagggtaggtg

SEQ ID NO: 158035 - DNA, 631 bp, Homo sapiens
aagtgtccgtgtcatcttggttgctattttgaatgcctccttattttaaggtatctttcccaacagttccctaatcttggatgatttacttaatcattctgcaaagaaggatagtaatttaattccacaaacactatgagatggtgaacttgagttcttctgttataaattatgtcacataagctgtaattcatagatatttatcatcattttattatttttttttttgagatgcaatcttgccctgtcgcccaggctggagtgcggtggtgctatctcggcccactgcaacctctgtctcccgagttcaaacaattttcctgcttcagcctcctgagtgtgcaccaccatgcccagctaatttttgtatttttagtggagctagggtgttgccatgtcacccaggctggtctcaaacccctgagctcagattgattccctcaccttggcctcccaaagtgcagggattacaggcatgagccaccacacctggcctattgtcatcattttaactcgtagctattatcactattagtcctgattattatgtgtgccaaatataatacataacaatactgagaaaatactttaagggtataatatctaattgtagacactatagctttttgat

SEQ ID NO: 158036 - DNA, 493 bp, Homo sapiens
taagacatactaatttaaaaaaaaactttcatctgcagaactacaaaagttggatgcatatttgtaatcttgatgtctaggcaatgattaactttagaatcaagtggttaatattaaattccagggagcacttattttatctgattagagtgtgattatcagttttattcttctttcacatattctctgaaagtacatatgtacttgatttttatggaagaatcctaagtgacaaatggctgatacggctttcgacgattataacttttttacgcattagcaaatacaagttagggtctgttgctttgaatcttagtagaagtacagaattaccagtgacgtagtataaaaaaatttgatatcagctagtcctagcacaggtactggtcttgcagtcatacctattagtttatagctttggacaagtcactttatcttcataataaaggtaaagatacccatcttagggttttgcagagatcaaatgaaatgc

SEQ ID NO: 158037 - DNA, 377 bp, Homo sapiens
tttttccccatcacagccattcatatatttgaagacaaccaaatcctccaggctataaatttctcaggctcagtaactactcctcatttgaatgaagtttgagttctctcaccattctgctctgaagacactcaagttggtttctatttctctacaaatgtggtgcccagcagtactacactgtattcctggtgtggcctttcatcacagagtgcaaatgagaccaccacttccttggtcttatgtatcgtgtttccattaatgcagcctaatgaggaattacttgtttcgtagtcacattgcattgctggttcatgttgagtctgttattaactaaaactcctagatctctttgcatgcgttgctgctaaatcatc

SEQ ID NO: 158038 - DNA, 193 bp, Homo sapiens
ctgatgcgggcattccccattggcagcacgagtccacagtgtgaaatgcattggccttgcagtcagcaatgttagttaccagaacaaactgagatgtaccatctgagcgctccagggcccagtctaaggggaggacaagcagagggttgtgggaaggtgcattggcccagaacgctggcccggcatgagttcg

SEQ ID NO: 158039 - DNA, 176 bp, Homo sapiens
agttttatggtgtttttttttcttccttcatcctcactcccacttcccccttattttggcaccttttgaaagaggatgtagcaattatttggtaagaaagaattaaaagtgttctaatgagtaaataccccagatcttagagaggatttgtctgactagagtggagagaagaaacc

SEQ ID NO: 158040 - DNA, 301 bp, Homo sapiens
acccacatttctcccctcaccccatccgtggaaaaattgtcttccacaaaactgttccctggtgccaaaaagtttggggactgctgaggaagggcacccatgcacaaagacctggtgcagtggagtcataccataggagtaacaataagttaacatttattgaatacttcgaatctgctacaatgtctaacagatttttacatggacagtctcatttaattttcttacctcttattctggtcatttaacatgtgaagtaaataaagcataaaatagtttaatctcttgaggaagtcacaca

SEQ ID NO: 158041 - DNA, 927 bp, Homo sapiens
caattataaagaaaaatagagcagagtagcaagagaaagagttccgatgttactcaccactttggaaatcccaggcaagcccccttgatgagttaggagtttttcctgctgatgggttcgtggtctcactaacttcggagaatgaagctacggaacttcgcggtgtatgttacagctcaaaaagagtccacagaccaggagagtgagcagcagaacagtttattgaacaaagtgaaaggaaagcttccacatggtggaaggggacttggaagggttgctattgctggctcgggtggctaaggcttatatccctgtgttaccccctcccctttctttctttttgtccagagagtagttctttttcaatcctctcttggagtggttaattttgaatccttcactcgattggttaagaactcaaaacactgagtcatagggatcttttgcaaaagtccctaaactggccaaggaagtcctgccaactccacccctcattctgaaaggtaagaaggaggcaaaaactataggagaaaaaagcaagatacttagaaacttttgaaggtttctgaaatggaggctctgtttcttgcccctccccatcagattcacaccaaggagggataacagagccatcaataggtgtgagagtctgagaacagtagggaggtttttcttcctctttcctaaaaccatgacattgcagttcctgttaccaccttggtgtgggggcaagaaagtagaaataatcactgtacgtagtagacagagagcttcggtatcaggaactaagggggccctagcccattatgtcaggttttctgcctgtccaggctgagaaagagagatggccaacttagagtggtttagagttgtgatgaatgatgattttggtggaaataaagcagagtatataaccagagtctggca

SEQ ID NO: 158042 - DNA, 170 bp, Homo sapiens
agctgggccagggaccccatggcgtgagaatagctgttgtgaagggccttgtaatgtctggtttggcctgaggaaccagagaagtctgggatctctaggctttgttcctggaacatagtgactgatttgaagccagaactctgggtgatttgtacctgagttaagctaag

SEQ ID NO: 158043 - DNA, 182 bp, Homo sapiens
gaatttgtgttctgtcagcttagctgaggtggactacacctcacagaattctctttcccttgttgcaaattagcaagagatactttgctcaagatgtggatggcagccatgaaggagcagtcttattcctttattctttttttttttttttttttttgagacagcatctcactctgtcaccc

SEQ ID NO: 158044 - DNA, 453 bp, Homo sapiens
ggtagcgttcagaggatcccctcggatgcaaagtggtggtggggggatgggggaagagagagaaggagaggcgagaactctggaactcagcaggagagtactttcaaatcttcctctgagaaccgatctgcatacatgtgtgagaagactactgacaccaagaagaactgctggaaagacaggcggatcaatctccagagcacacacgggtccaggaatagcttatatgcccactagccagagtggaaagacctcctaatacagggggcattaggttcagttctcagaagggtatttatcactagtggggccatattacacctagactaaagggcacatcccacaaagcctaaaagcaaacctcaaaagtatcaaatgattccaattgactaaattgcatcccagaaaaaagcccctaaatacttaaagaaatataaaaactatcaattaaca

SEQ ID NO: 158045 - DNA, 391 bp, Homo sapiens
gtcacccaatgctctatgctcgtgtggtaaaagctgctaccgggggatccctgtactcatagcagatacatctctagaaagatgtaatcttcttagagttaaatcccccacacagcacaaactgtgcttgtcaacctttcttacacagtgccctatacagcacggattttacgggggtgtttttatatgggcaattgtatcatcttttcttcatgtctggaattttccttatattagaaagcccttccctattgtaattaaataattatttcttattgattttattcttggttacttccttctccccttttccatttatttaaaaagccccaacttttcaataatagaaaatttcaaacacacacaaagtttgaaaaaagagtataatgaa

SEQ ID NO: 158046 - DNA, 425 bp, Homo sapiens
attaaaggctgacactgtgcaaggtgttatgccagtaaggcacatgctaataggaagaaaaacaagaaatggtccttccttccttcattcttacatttgtaccattttttttccctgtttctttctgtatgcattatctaatttgatgtgcataacaacttatgagatacaaaagaaggttgttattgaccccacatagaaaagaaaggcaagtaatttcaaaaagatcaagcatttattagaaatttctagacttagtgaggaaggaagaactaagactatgtaagatgttattatcgttacatattgattagtgtgcactgctcgtgaataccatatttttaggcctgttttcctgaaccacataatattgtcccactgtgaaacaggcattacaattttgtatttacttctaatggttctca

SEQ ID NO: 158047 - DNA, 306 bp, Homo sapiens
agactgattggttattattctgtatacctaaagtgcaataccctcaactctttaaaaatggagaagaaggatcatgtttaatcacctggaaagatacttatgatgttatttagtaaaaagactgggttataggacagcatgttactctatgatctcacgtaagtaaaattgtgtacccatgtctttgaatgtatggctaaaggtatacccattgttgttggatagtatatttgggtcatcttttccttcctctttagatgattttgtgtagtgtgagcctttctctctgactctgtatcagttata

SEQ ID NO: 158048 - DNA, 426 bp, Homo sapiens
tccccagggaggaaactaacttctttttttttttaatttacaaaaggtaggctatgattattagagtcatacacagttgactgtctcagtgtgactcaagaccacaaaaaaaccatttttccttcacttctgagtcctggggttaagacctagaccagcaagcgtactgcttggggtcccttcacaggtttacaagtttttcattgagggcaatctgtgactgtgtgaggttggccagttaggtcaccatcaacaggtcattgatgttgctgtggagcatggtctcgaagtcatcgggaactatttttggtacttggttaaccaggctcatcaggaagtggcccaccttcctgatggtattgtcagctgacacctttccagatagtatatcctctgcatattgcaacactatgctcagggtatcct

SEQ ID NO: 158049 - DNA, 651 bp, Homo sapiens
agccttcaggaggaggaaattctgacacatgctgcaacatggatgaaccttgaggacattatgctaagtgaaataaaccagtcacaaaaggacaaatacatgattggacttacataaggtacctagagtagcaaggtctcttcatagagacaaagtagaatggtggttggcagagggagggagagagggatggggagttagtgtttaatgggcccagagtttcagttgaggaagatgaaaaagctctggagacagatgttcttacaacaatgtgagtgtacttaatgccacagaactttacacttaaaaatggttgaaatggtaaattctatatgtattttgccacaataaaaaatccagatacaaactagtacatactgtgcaattctttttatatacagttcagaaccaaggaaacctactctatgatgttaaaagtcagggcaacgattgcctttgttggttgtggggtagtgactggatgtgagtatgaggagggactacagtgctactcaggttctaattctttgagtgcttgttacacaagtgtgttcatgatgagaaaatttatcaatgtgaactcttaggatctgtgcttttttttcccatatgtattttatacttgaataaacaagactttttgccttctac

SEQ ID NO: 158050 - DNA, 558 bp, Homo sapiens
cttacctcacttaagtcccttaagcttatctgactgcaagaaaaagaaatacggtgttacataaaacacagttcataatgaccaagataaaatcattctgagccttacaaacctttcattacattttcattgccaaattaacagcccatagtccagtgagatatttatcactcttccataaaactaaagccaggttatttttctcataattttctaaggaaaagacaaagttaagagccaaaataaaaggtggtgatagaaaggacatgaataaacgtgcatcttattttgggagaaattaaaaaatcatcatttctcctgacatttgatttcctacgtcaagtttcattggcacagtcagacctattattaacttggttttaaagctcttagtttttcactttgagggaacataaagagttttcaatatgaagctgtcaggtgcagtggggtctcaggaaagcaagtgtaagagagaatgctgataaagaacgaagatctgagacaggagaaaaacataaaattgaatggtagagggcttaaaggggacccttgggg

SEQ ID NO: 158051 - DNA, 141 bp, Homo sapiens
tttttttttcttatattttgaaacaagggtgattccaagtcatgcttagttaacaggaataatccttgaaatcaggatgtgtactaacaagaacttggaacataaactcacctaagagaaaaagcactattctatctactg

SEQ ID NO: 158052 - DNA, 183 bp, Homo sapiens
ctcagtttcatttccttctttccaaggcctaattttctcccctatttaattgtcatgaatctttagactttggagctggaggctacctttaagaatcatctgacccagaactttccattctcaaatggagactcccaagcccagagagggagcagcatctgcctgacttcccacagctgcctg

SEQ ID NO: 158053 - DNA, 343 bp, Homo sapiens
agggcacattcttactgcaaggtagagtgaaccaagatgcacctacttcatgctattggaaggcatcattttcagtgcaaaaaagcttagtctcagacatttatcttaaggtgaaatcttattgcaggtcagtgttaactgatatcaatgtaagcaatgcaatacacattaacctcaaaggcatattcttactaaaagatgagaggaatcagaatgaacctgagtaggagtttggatgagaattcctgttagtacaacaaactcaggcattcttattaaaaccaactcctcatagcttattgagggagatgacagtcggcacagcaacacactcacatgcagg

SEQ ID NO: 158054 - DNA, 240 bp, Homo sapiens
agccaccacgcctggctgactgagtccttttcattcttaaggtcttagtgtaaatgtcagctgaccaccctatctaaaatagtcctctccatctcagcaccttacacactttagaatgtttatcataaaccatttaaattttttttttttttgagatggagtcttactctgtcgcccaggctggagtgcagtggcatgatctcagctcactgcaagctctgccttctgggttcacgccat

SEQ ID NO: 158055 - DNA, 245 bp, Homo sapiens
tggaagttgggtgggaaatttgacgattaggatttattcaacacagtttgccttttactattgatcacttctttccggaattataaacatgtttgatttattataatctatttcatagccaagtttccaaatctagttgtcaaccaatgttaatagtttctttggttctatttagagtgacaataaatattttggaggcacaactaatatgaacaaaggtactgcaaatgtagacatatgttggg

SEQ ID NO: 158056 - DNA, 148 bp, Homo sapiens
tttcatttaaacagtctcacgattagcaaataacaagaggtatccattagtacaggtctcattgactaggctgatcaccgataccaatcggactaaaaaagctacactcagaatcattcctcaatcactcatcagaaagtagtatgga

SEQ ID NO: 158057 - DNA, 610 bp, Homo sapiens
atattctagagaattcaacttcaagaacacctttaaactttttctttgtagttaaaaaaggaaaacaacaaaactttaaaaccaaagttagatgtgaaataactactgatgagttagaacaaggtcatattatatttgaaaataagaaatattatatcaagtttattcatcaagtgcatagcttttagcttttaactgaatttttctgggttcagtaaaagaccttttgaaaaaggaaaaggatcatttttagaatttttaccatgagaaacaatatgaactttctttattctaataaacagtttccttgttttttcataaaagtattgccgtactgctgactagaagtgaggacagagaggctggccagaggtcaaatgggactcagatatttctgaattaccagatatacaagctttggacttcaaaattaatagctaccatatctttaatgtcatggattccttgccaaatttccacagttcatattagtaactacatttgcttccgctttgtttcactgttgaagagaatgaaatgcttgtttggattaccatgcaagcatgcaaataatctatgctctctgtatttaaaaattcgtctatttgaa

SEQ ID NO: 158058 - DNA, 556 bp, Homo sapiens
aagacttctccttaacttcatccagaggactcaaagggaaggccactcaaccagaatcacacagcagaaggagcagagccaggcctggggtcccattttctggaggcactggcccctttttctacactaccatgctgcccccagcccctgggctaactaagactcccccattctaaatgtgagtgcccctgatggaccgcataggctggatgtgcccgtccttgctttgcccagcagagccatgtccataaagatggcatcccacgtcaaatcctgtagactactgcaaaatatccatcagccaatttcttcaccaaaacgctctgagcagccactgaactggcagtgccattaattttcagacaatttcagactaagttaggttacctttttggggggattttgttgctgtttagtttcaacaccattattgactcagtgatactctagggcaagtgttctaatgatccaagatagcttttaggagaatttctgaagctcttgaaatttgtatgcatagctttaatcagaatcccaaaggtgctcctatcggtaa

SEQ ID NO: 158059 - DNA, 118 bp, Homo sapiens
catatagtgtgccaaaaggaatagaggtgattgctgggatatgccaaataactgccttaggctctagcctatgcactatggagttggcatgggtggtggtgtgggaatctttgattat

SEQ ID NO: 158060 - DNA, 269 bp, Homo sapiens
ctatggtgtgaatgtttgtaccctgccccaaattcatatgtgaatttcgtgcctttatagtctatataaatttacaaatgtactgtgtctttatgaaagagaccagagcaagcttctgccatgtgaggacacatagagggtctcttgtatgaggcacagacgctaacagatgaggaatctgccagcgtgtttgttgatcttggacttcccatcatccagactgggagcagtggagttccgttgttcatgcattacccaaactaaggtgt

SEQ ID NO: 158061 - DNA, 443 bp, Homo sapiens
tgctaatatgatgcccattgatggctgtggcaactgagacctatagaggagaaggtaggaagcagtggagccaggactgaaaccacggtggatgggaccctgggcctctgaatcccaccctggctttgtaccttgctgtgtaccttgccagtcctggcgcctgaggccggagatggggaaggttagccaggggcccaggagcatgttggggaggctgagtctagcccactaacaaagcagaaggccagcgagcagtaagttgctgggagcttgggagtcaagtttaaagcatagaacatgactgttctttaaaagcccctcccctgccctctcttccatcctcgtgatctatttgccagggggttgaagggcaatgaaaatttctctggtgcccccttgtaccaggcattttgcctgttggatcccacactacccccatggtg

SEQ ID NO: 158062 - DNA, 388 bp, Homo sapiens
aaaccccgcggggtttccccgtcgcgatagcaggatctctctctgtgtgttatcaggtctgatcacgatctttgtttatagatgacggttccaccaggcctaattaccacacaccagcaaaggcaggctatgctgtagtacaagccactagcccgcctcttaaaacctctcatttcctttccatcatagaaatctatcctcaaggaaataacttctagtgtaaccatcacctggcttgctcaggtctcgctgtgtgtgtagcagcttgtctgaatttcaagcctagtagtgagtagaaatgaaaacttttgaaatgtgccagccttgcttgtaaatatgaatcatttaaaatggtggcatttgtcctcattcacaacaaaattcatag

SEQ ID NO: 158063 - DNA, 513 bp, Homo sapiens
agttacactgactcacttacatacaatctatggttgctatcacactaccatggcagagttagtagttgctacagagaccaccataaagcctaagttatttaccgtctggtctttcacagaaaaagtttgccaagccctgctctggaattcagacagcctctcagcgccagccttctccaggcagccctcgcttgcggcagctaggttttccttaggcgggaactgacctggagctgggcgcccactgaggtttgcaaggctggggagctttttaaataaataggtgggaaggaatgaggcaaccctctggcccagattcagcctcagtgatctctgtcccatcccctgagcctctagctgggggaaagccctgtcccgttcctccagagctcagggcaccccccctccctaggttcttggctccttgggttgtttcttggctacttttctcggtgaagggggcaggtggtctttaagttcagagcctgtgggctgaggctgggaccagggaca

SEQ ID NO: 158064 - DNA, 541 bp, Homo sapiens
tatttttaaaaaaactttaaaatctgaaaacaacacatgcatcagcttttgttcttggtgaattttctgattaatgtattatgttagtaacagaagatcagtgtgttccaggagtatagtttgagattctctagtctaaagggtctaaaagtgaaagttgggtaaaagaataacagggaggaaagtttttgcttccagttttttatttttatccagcagtaaaattttagaagactgtagggaaccaaagagtgtaggttagtttttacctcttccatggcctaggaatcacagaaaccctcatcagaggtttgaggggacagcggtggaattctgggaagcagaatgctttagctggttggtgggaagaaaatgggagaccagtcttcccagtgcttctctgagaaaaatgttcccagagaattgggtcaatagatgatgcaagttcttcacagcttctaatcccctgtctcctggaaccacattgctgtgcatgaggaccaccagcttcttacctcagagggtctgcttccaccctctg

SEQ ID NO: 158065 - DNA, 383 bp, Homo sapiens
  misc_feature (11)..(12): n is a, c, g, or t
ctgcctttggnnggactcctcctttttctctctctatcccctcccacaatgatctctggccaaactacaattccgtgccttcaacattccatgcctctgccctctggcccattatacatgctgttccctactctttaaatttgcatgtaaagttcttcatgatcttaccccatgcacctccgctattagctcctcgatcacctccttactctcctttttctctctctatcccctcccacaatgatctctggccaaactacaattccgtgccttcaacattccatgcctctgccctctggcccattatacatgctgttcccccaaggtgaactcttctcacatttctccctggtcagttgtgatacggttgtcgaggcttcaat

SEQ ID NO: 158066 - DNA, 120 bp, Homo sapiens
ctgatcctaaaagttacttttcactatgccatgatcctgcttacaaatgtatagttatactaacattaaaagagagaatgggctgggcatggtggctcacgcctgtaatcccagctcttt

SEQ ID NO: 158067 - DNA, 238 bp, Homo sapiens
ggtgcagtgacacctgcacctgacagggactgtttctttcttaaaggttgtctagaggctttttacagtttgggtgtgatgaaagtaaaaacctcattaaatggttcaaaaggaaatgggagggagaggaagtaaagatagcatatgggcacctcaagacatgtcactttggaaagcagaggaaggggaagcaggaggcagatgtggtgggcacacggggcagtttcgactcattttg

SEQ ID NO: 158068 - DNA, 413 bp, Homo sapiens
ggcaatgcttactagttcctcagggaaaacaaagtttgtcctggcattaaatcttaaaagaaatctctcagggggaggtggcaacccctcccctgaccaatcaatcaactgatcaagcaagcaagcaaattaagatctggtttcaaggatttaccaacaaatgcagaagcagttctatagaaggctcctctaggagaatgactacggggggtaaggtgacacaccccattgaagagcagtttcacctctaggctgagcattttgcacagctggggtggtagacgatggcacgtgcccacggccttcccttcaaacagccctgctcctggccagatttctgagtctgtgctaatctctcctcccagtgcagaggtgttggagacgcaggaacctccagctccagcctttgtgga

SEQ ID NO: 158069 - DNA, 690 bp, Homo sapiens
tcccctggactttaaagttgctgggcatgctgacatcagaccttatagactctagacctgacagccttgctggatcttgcatgcaaatctgccacttgagattttgttaaaatcctgttaagacccattacctgtctagatctatattacctgccataacccactggaggcctgcacacatgcactcctaggcaagctgggtctcattacccactctaacccctgtgacatgctatcagttataaatatgggcagtagtaagccccagaccaggatgacagggtttgcatccatgtatttggccacaaacagacctggctgaaacgtgatgcaaagatctattgctaaagggaagtggctacagtaaaatggataccaccatagctgccctgggatacaggaacctgttggcctttggaactgttgatatgatatctctaaaatcaactaaatccattctcaggcataatccatttgtcttaataaagctaaaacaagcataaaatttcaaaaaagaactctggctttagaatgaagcaattccatagcagatttttcattcttcatcccaaagtcttcaacaccacacacaaaaacataactcaaaataccatcaacttgaaaaagagaagcacttttgtgtagccagctcaaaggactggtgttatataccagaggtatgtcatattc

SEQ ID NO: 158070 - DNA, 731 bp, Homo sapiens
atcccaacactttgggaggccgaggcaggtggatcacctgaagtcgggagttcgagaccagcctgaccaacatggagaaaccccacctctactaaaaaaatatttaaaaattagctgggcatgatggcgcatgcctgtaatcccatctacttgggaagctgaggcaggagaatcacttgaacctgggaggcggaggttgcggtgagctgagatcacgccattgcattccagcctggacaacaggagcaaaactccgtctcaaaaaaagtactagtgagaaaatcatcaagaatatagaaaatctgaacaacacactcaacaaaatcaaattaaaacatacaaatactacaccagaaaaaagtacccattgaatattcactaagatagaccacgtcctgagccatgaaacaaatctcaacatatttcaaagagttaaatcaatatagaacatgttatctaaccataattgaatcaaactattaatcaataacagaaagataatgagaaaatctctaagcacacttctaaataatccatgggtcaaagaagttacaaagaaagtctaaaactcataaaactgaatgaaaataaaaagacaaacaccaaaatatgtttgatgcagctaaaatcaagaggaaaaagaaactcatatcactacatgcttacattagaaaaaaagtcttaataatgatctaagttcttatctcaagaagtgaaaaaagcaaataaac

SEQ ID NO: 158071 - DNA, 274 bp, Homo sapiens
gggcgtctccacggggagtccagcaagccggcattcactgctccctggccttggtgccctttgccggagcctgtgtctgggctgctggtcccataacacgtcgacaaccctcaggatatggggcagggttgctgcaggggtggatttgggcagtggagagtggctggcaccctggaggctgtgtaggcccagctgtggctcttctgggcctgacttcagggtggagaagtgaagggggaggttacacagagatctgtctctacgcacacatatc

SEQ ID NO: 158072 - DNA, 683 bp, Homo sapiens
agaaacttattgctcacagctctggaggctgggaagtccaagatcaaggtgccagcagaatcggtgtctgttgagggctctctgattcatagacggcagtttgttgctgtgtcctcacgtggttaaaggggcagtggcactcccttcacctctcttataagggcattaatcctactcatgaggtcacagccctcgtgacttaatcacttcccaaaggtcccacctcttaaaactattatattgggtgtgagattccaacatatgaatttaggagggcaccaacattcaaatcacagcacacagcaacctggatgactctccagagaactatgccgactgcaaaaagccaatcccaaaaggttactagttgcttgattccatgtacagaccattcttatggtgacaaaggtataaagatggagaacagattggtggttgccagaggctgggggtagatgattgtgttagaaacaaacaggaggggtggccaggcacagtggctcatgcctgtaattccagcactttgggaggccgagacaggtggattacctgaggtcaggagttcgagaccagtctggccgacatggtgaaactctgtctctactaaaaatacaaaaattagccaggcatggtggcaggtgcctgtagtcccagctacttgggaggctgaggcgggagaattg

SEQ ID NO: 158073 - DNA, 117 bp, Homo sapiens
tagagacctcattggagaatatgctaagggaaaatccaagggaataatactcatggattaatgaactgattccttctcaaaggatatgaacaactccatcagtctttgatatggttt

SEQ ID NO: 158074 - DNA, 302 bp, Homo sapiens
aaaggggatgtgttctgcttccgtttatgagttaagcaaagttctaaattaagttgagaagaggaagcaggtaaagtcagggatagcagagaaaggagacatcaaaccctattgttgtaggatatttatgtgaaggaatgagcaacgtgataaaacacatttttgcttgctgtgacttgccatagggtgcattttcagtactgtgtggataatgtgtggcatgttcattcatcagtcattctgtgacatttatgtagcttacacttggatctattttcaacaacatttcagttccctaaaga

SEQ ID NO: 158075 - DNA, 137 bp, Homo sapiens
ggctgagttttctaagagcacgcaggtggaaagtgatcaagctgagtcctcagcttcatatcttctcagggtccttgatcttccgcaccctgtagttctggttcattttaggcaattatcagaagtcacctcaaatg

SEQ ID NO: 158076 - DNA, 275 bp, Homo sapiens
tgaacagcaaatgatatactttgattattgtcaaacaggtttgccttccagggtagaaataacactggaaaatagataacatggttctaacatattaccttcagaaaaagggaaaatgaacttcattctaaaggcttaggaaaacaatatgtttcttgaatatgggtaagcacaagagaatatattagaaaattgcctgatatttaaagttcatagaacaaaaaaaatgtaagtttaagagattttataaaaaaaagtagcagaaagtcaaaagg

SEQ ID NO: 158077 - DNA, 400 bp, Homo sapiens
gacaaaatagtcaccatatcaaaaaaagccactgtcaaaaaaatgaaagcagacaattaaaaggtagattctaaacttttaaatttgcttacaaattcagcattttgaaggggaaatgtgatgatatcactaactttcagtctttaagcctgtgaatatttctgtttaaatgttggttaaaaacggatcacgaggtcaagagatcgagaccatcctggccaacatggtgaaaacccatctctactgaaaatacaaaaattacctgggcttggtggcacgtgcctgtagtcccagctacttgggaggctgaggcaggagaatcgcttgaacctgggaggcagaggttgcagtgtgctgagatcgtgccactgcactccagcctggtgacagagtgaggctc

SEQ ID NO: 158078 - DNA, 487 bp, Homo sapiens
ttgcaacggaggaaacaggtgaaaaactctcccaggtagcatagtcaaaagcttctgaattctcatccctgctctccccacttaacaggctgccatttcagtctttttgagacgcactgctgagatctacagcagcttctggtaccagtggccagcaagccaggacccctccaagcctcatactactcttcaagcacacacatttttcaacaaccgatcatccaatgacaaccaaccccccgccccccgcatcctggcaagccccttcaatagcaacaggaaagcccctgaggtgcgaaaaacagcgcgccccacttagggcgcggcgtagcataggggaggcaaccggccagtaaccagggcagctgagctccaagcccgagtcagcagaggcacaggcaggcccggacggcccttctagcggcagccccggatgcccccagaatcctcagggagcccaaagcccccgctcccacccaagcacccc

SEQ ID NO: 158079 - DNA, 288 bp, Homo sapiens
aagtgctgggattacaggcatgagccaccatacctggcccatgcactgggctcttctgtatcaaaggccaagcggcaagggagcagaacgctgtgctctatgtgcatgtgacactgcacaaaacccaaagtgggggaagtaaaccccagggtatatggtgttggcacagctagcatagctatatgctatgatacatgctatgccaacaccacagattgcatcaaaatacatttatgtgtttactgaatgaatcaatgacctagtttcactagagtcaggattcgtgat

SEQ ID NO: 158080 - DNA, 176 bp, Homo sapiens
atgagatgggcccaggaatttggattaaaaagctagtctgaaatgcattacattcctgtaccacattctaaaacaaaacaaaacaacaacaaaaagaaatgtggccataaggcaggagggagcagaagcaacatttggactgtgggcacatagagtaaggtttcagggcagaaaca

SEQ ID NO: 158081 - DNA, 658 bp, Homo sapiens
gagtgtgtagctgtgagctgagggtatgggggtaggcctgggcaagtaaggtgaagcggggagcagtgccagacattgtggggacaccagcatgggaagaccatggatctgtggggcaggcacccccagagatgccaccttgtactcatcctattctgtcctggcccatggttctgcctctccacctgtctcggaaccggggggccgttatggtatctccccaagccgcagttccttcatctgtaaagtgaagatcactactgtgttagtctgttagggccgccttaaaaaagcaccacagtcggccgggagcggtggctcacgcctgtaatcccagcactttgggaggccgaggcgggcggatcacaaggtcaggagatcaagaccatcctggctaacacagtgaaaccccgtctctactaaaaatacaaaaaattagctggacgtggtggcaggtgcctgtagtcccagctactcaggaggctgaggcaggagaattgcttgaacccgggaggtggaggttgcagtgagccaagactgtgccaccatactccagcctgggtgacagagtgagactccgtctcaaaaaaacatagtgataacaattagcggggcatggtggtgtgcgccagtagttccaggtactcagcaggctgaa

SEQ ID NO: 158082 - DNA, 187 bp, Homo sapiens
caagaatctgcatcatgcttttctgaaactctttatagaattgtcaggctggaaggggccttcatgaacattgttttctcctctttttccttctaacagtcgtcaggcctctcttttcagttcttccctaagatgtgctttcagaatccctcaccatcacggttacttatcttaggatacactttag

SEQ ID NO: 158083 - DNA, 270 bp, Homo sapiens
tctgagatcccctaaagcatcactccccgatagttgaatgtctttctacctgtcagctaattcttaatattctggtctatctactttcctttgtggttcttctttttctcattactttgttagaatgctttatagaggaaagaatatcaaactttcactttttgtgggttatacatattttttcagttttttgtttgttttttgtttttgtttgtgatgggctttattttcttttaccatatagaaatttaaaattttttattgcctaca

SEQ ID NO: 158084 - DNA, 444 bp, Homo sapiens
gtagctgggattacaggcatgtgcaaccacccctggctaatttttgtatttttagtaaagatgggatttcaccatgttggccaggctggtctcgaactcctgacctcaggtgatccacctgcctcggcctcccaaagtgctggggttacaggcatgagccaccgcacccagcctactgttttaattttgatttaattgcaaatatagttgaatgtctttctacctgtcagctaattcttaatattctggtctatctactttcctttgtggttcttctttttctcattactttgttagaatgctttatagaggaaagaatatcaaactttcactttttgtgggttatacatattttttcagttttttgtttgttttttgtttttgtttgtgatgggctttattttcttttaccatatagaaatttaaaattttttattgcctaca

SEQ ID NO: 158085 - DNA, 502 bp, Homo sapiens
agccacagttctcagccatgatgctgaagaggcagacagacatctgagacacagaagcaggtttacatctgagtcgtgtctactgcaaggccgccagaccgtaaaaggggaagtttggaaggcgtgatctcctacagagtgagtgccgaagtcctaagaagctgatcagtagtcactgccattgttcaaaggcagactatgaaggacactggtccctagaggtggttacacccccatcacccacatgctcacaaccacgctgtcacacatgcccacacccagcacctaaacttgtgcctgtgacatcttcaccctctatccacggagggaactgcgttccaccaatcccatcgccgtccacgggctgcaggagggctgctggcctccgaggacactgtcacaggaggaagccctcaggggagctgaatgagtggcaggccactgagagatgggcagacctgacgtccttgccctagccagggaagccacagcacagcagcca

SEQ ID NO: 158086 - DNA, 381 bp, Homo sapiens
gttccccacacacgaggaagagggaaccaggacggcttggagtgaggaccagacagggccgtggggacaaggaggcagggggcggccagcaaagcaagacctgggtcaccggggaaggaaaccagctctgccgcatgtggagacgagccaacgggaacacaggcaggggctcacgaggcactcaacaggccccgccctccaaagcagccagcgctctccggaactgcaagttgccatggtgcccatctcccaggctccatctggtgcccgcctggcatcagtccacacccctctaacaccttcgcccatgccctcctggcccctctcctggcgggccttccctcatgggacacactggatgagtgaaggaacctatctgtg

SEQ ID NO: 158087 - DNA, 440 bp, Homo sapiens
gaggagaatcagtggggaggttgcttaagggttgagagggagagtcaagggagagtcaaagttttgtaagatccttgaatccttcttgttagtctcattccaataatccaaattccagtatttccctaattgcttaacagaagtgacacggttgtgaattcagtgtggggaaaagagaggtcagactgttactgtgtctatgtagaaagaagtagacataagagactccattttgttctgtactaagaaaaattctgccttgagatgctgttaatctgtaaccctacccccaaccctgtgctggcagaaacacgtgctgtgtcgactcaaggtttaatggatttagggctatgcaggatgtgctttgttaaacaagtgcttgaaggcagcatgcttgttaaaagtcatcaccactccctaatctcaagtacccagggaca

SEQ ID NO: 158088 - DNA, 506 bp, Homo sapiens
ctgccatggcaacagagagtggatggatagccacctctgtagactcacagacgtgggttcgaactcctggtctgtcacttactacctatttaaccttgaatgatttacttaactccttagagcccaatttcctcgcctgaggaagctgctttacagagaggataaaagaccctaagaccgctaatggttcagaagccatactcagtcacttgtgagtattagaaacaatgtatgtaaaatggtggcctccatgcacagcacctggcaggctcaacaaatgtggctgtgttaaaagagggattctcttcatctcccctggagaagggcaggccagtttggccatagaccaacagaaagcaattgtgggtatgattggggtatggtgccagatcccctcacccaagaaacctttcctctcagatctggtacaggacacaattccaggttggagtcacatttttgtggtaaactgatttgtgtcctgcgaccatgtgttagaattgtgc

SEQ ID NO: 158089 - DNA, 373 bp, Homo sapiens
ccttggtttgcactgtgtttggtttgctctccttctgccaccattcactccctccaagttccatccaaactttcaaagggcttctgtcctgctgtgccttactatgacaggcagtagaacaaaagttttacacactgtggcctttttgtttgtatgcaagcaggtttctgatgtattgtcctttagggccaagttctggacccaaaggcattcctaaagttaatttgggggtggtacacacagtggcagggcagccggaaaggaggatgtggttttccttttccttttggaagaaaagggctcagtcagcctaattgtcccttgaagtgcttccaacttttcttttaagagctttaattggtatgtttgcatg

SEQ ID NO: 158090 - DNA, 168 bp, Homo sapiens
tttctcaggagcaaggagaaataaccactccttaaaattcttctatcccaagttctaaggacacatttctctctctgctttcttctctcatcttcctcaaccttcctcctcagtctggccagattcttcccttctctacataccccctgactccatgggggatctgtc

SEQ ID NO: 158091 - DNA, 355 bp, Homo sapiens
cagctcagaattagcctgggactgaccgccttctccctcattccgagagacccagggcaggggttcagggggttgtgtacctgtatgtctgcagaggcaggaaggcggctagggatgggagctggtgagcccgagtgtgagcgcaagagtctgtgaggtgtgtgagtgtgtggtgtctgtgagtctgtatgagtgtgtgtgttgtgtctgggtatgtgtgttttatgtgagagtctgcatgtgactgtgtgggggtgagcaagtatatgagttttatgtgactgcgtgtctggatgtatgtgagagtgtgtgtgattgtgtgtgtgattgtgagcacatgactgggtgtgtagag

SEQ ID NO: 158092 - DNA, 527 bp, Homo sapiens
ccatcaactcacaaattaactattgaaaatgagatgcataatcttagtcttctggtcaggtatcaagctctatattatacatttctctcatgtgttaagtagtaatgactacctaggcaatccatttggctgactggagaatattttaatagttaagaatcatgctacaataaagctaaaccaaactagaacctttatcaaatcttttctcttttgagacagagtttcactctgtcacccaggctggagtgcagtggcatgatcctggctcactgcaatctccacctcccagtttcaagcgattcttgtgccttagcctcctgagtagctgggattacaggtgtgcaccaccgctcccagcctaattaagctttctgtcagaaccatcagaatagtcactatgcttttataaataatagtctgatgtatggatagactaaactctgccaactctatgctattcagagcaaattgccagggtaaggggaactcaataaacttctgagcatattttgagatggaacgtc

SEQ ID NO: 158093 - DNA, 545 bp, Homo sapiens
cccatgacattttaacctttattcaggcagttatgatcacaaacatgcaatacctatatgataccatttctaaccattttatatacagatgcataaacgtatgacagtatttcctttcccttcaaaaaacaacatggcaaaataacttgcaagatctctagccaattaagaaccctggatctgaagactgactccgtgggatttcataaaacttggctccccatcaaaaggccacaattactctttcttgactacaagcatcatctctggattatccacacctcttccatctccaaagataactaaaaaaatacagggtaactaaatgagtataaaaacacatgaacctggccaggtgcagtggctcccccctgtaattctagcactttgggaggcagaggtggatcacctgaggtcaggagttcgagaccagcctggtcaacatggtgaaacccgtctctacaaaaaacacaaaaattagccggacatggtggcacatgcctgtaatcccagctattcaggaggctgaggcaggagaatcgctt

SEQ ID NO: 158094 - DNA, 277 bp, Homo sapiens
gtctacttactgacttgccttctacccagtgatgggccatgtgctgtgagggcacacactgtgtgcccatctattcattcctctgtgcgtgcgttcattcattccttactgaatgcccaccaagtgccaagcattggggtacgaagaacaaggcagacggggcctccctggcctcttccagctcgctgtagagtgttgtctaccctactcatcctcacatacccatgcctgtcctatgtggcactcaataaatgtcggatggatggatgtgtcccct

SEQ ID NO: 158095 - DNA, 247 bp, Homo sapiens
aagggaacggcagttagaaataggtaaccaaagggaatataagtaaaatgagagatactttgtacggactgatgcgcctggtaaaaccacgtactaaagaatattattaatctcctgtatttgaggtccaacaacaaatgttggggttagtgtcagccagaaatcctggggggaaatggtaaactccaactctgatgccctcaggaacaaaaactgttaaggttgcaaagaaggaatttttcatatc

SEQ ID NO: 158096 - DNA, 508 bp, Homo sapiens
ccatccacaggccaaaaaataaaaattacaaagctgattcccaccctcatcaaactcaagaggatgggacccacttctccctcggggagcagttttcttagtggaacactcagactttctgttgagcattggcagtaaaggctttcctgcaaatctcaatctctctctctctcctgatttttttcagacagctccttcgtttttaaggcatctgctctgtggaagctcacagaacaccctcctccaggtcctgggaaggctcagctttttgctgctgttctctaggtcctcgttcccaaatggaacaagtcctgcttgtgataaacacagaggtcctgaacttgggtctggttaagacaaaaacaaaaaggacatcaagtacagttaaaaaaaaagttcccaagaatctgcttattactttaggtctgaatttagtgcagacacgtgagcctctctgagtcaccatgttctcatagtagctcgtggaatagctccgtgaagaatgctg

SEQ ID NO: 158097 - DNA, 518 bp, Homo sapiens
ggagaacccaagtgactggataaaggtcagtagaaataattactaagatcgagagtcaatgaacattttcactaaatgagcattttcattgaaaatgaaacaatgatggtcaatagttaccattcaaggatagcagatgtggctgagtctgaccacagacaacacaaagaaaactgactaaggaagccccaactgcaggacaacctggccttcagcctgagagttaaatgtaacagaaagcactgctgtctattccaggatggactggaggcaattttctgcctgaaattcagtcctcccaatggagacctctctgttcatccttctgttttgaaggtcagagggcacaggtggcataggcaacaggaacctctatctgtaggcagagaggcacaggcaatgtgttcaaacacagatttcagagtctgagctgagtatgggccagtcacaggactgtcatgtggcactggcaagtgacaaaccctctctctataccttatccttctgacaaaggcaag

SEQ ID NO: 158098 - DNA, 508 bp, Homo sapiens
ctagctcggtcccccacaccacctgagtcgggggagggagagcatcgggataaatagctaatgcatgtggggcttaatacctcagtgatgggttgataggttcagcaaaccaccatggtacacgtttacctatgtaacaaaactgcacatcctgcacatgttccctggaacttaaaataaaataaaacaaaaataaaaaaagaaaaataaatgaaaaagaaaattttaaaaagttaaaaaattatgttcttgatacagagaaaaatctttagtttattagttatttttactcttgccatgtttctataaaggcaagaaaattaagaactgaaaagcaaacatggtctatttctttcatcaccccacactatatctctgtaatttatttctataatgcaggaagggtactagggaagatgacaagtattatgaaaagatatatactggccaggcacggggtctcacgcctgtaatcccagcactttgggaggcccaggtgggcagatca

SEQ ID NO: 158099 - DNA, 1372 bp, Homo sapiens
gaacaaagaagtataactatcttcgcccatttgtgttgctataaaggaatatctgaagctggataatttataaacaaaaaaggtttatttggcttatggttcttcaggctgtacaagaagtatggcactggcatctgaatctgggaagagcctcggactgcatccactcttggtggaagggggagaggagctagcctgtgcacagatagtgagagttgaaacaagggagacagagaaagaaagaggaggcattgtcagactcttttcatcaaccagttctcatgagaactaagagtgagaactcattcactcccgtgagaatggcaccaagccattcatgagggatctgcctccatgacccaaacacccccaccaggccccatctctaacattgggcacgaactttcaacatgagacttggtggggccaaataagccatatccaaaccgtagcaataactagtcagccaattgaggaggttaacggaatgctaaaaaatgttttcaatccaaaagattgtaggaatagagaactgaacaaagaacagatgggacaaattgaaaacaaagagcaagatggtagccttcaactcaaacgtatcaaagtcattatattaagtggaaatggactaaatgctccaattaaaaggcagagattgttaggttgaattaaaagcaagggacaattgcatgctatttataaaaagtgcacattaaatctaaagacacaggttacaaataaaaagatgaaagtaagatgatataccatgcaaatactaatcataaaaaagctagagtacgtatactaatagcagacaaattagacttcaggacaaggaatattatgtaatgagagatgtttcacaatgataaggaggttaaatgatgaagaagatataacagtgctaaatgtgcacacatctaataacaaagcttcaaaatgcaagaagcaaaaactaacaaaactaaacacagaatggtaaatatgcaagtgtagctggaaatttcaagactccttcctcagaaattgacaatcactaaagatatagacttgaaaaacactaccaatctgacctatttgacatttgtagaacacctgacaagtgcagaatacacataattttcaagtgcacattggacattcaccaaaatatatgatatgttaggccatatttaacaaatttaaaagattgaaatcatacataggatgccctgtgctataagggaattaaattatgtatcaataaaaaagataattggataatccccaagcactttgaaataaagtaacatacttctaagtcatctatatgtaaaaaaaaattagaatattagaaaacagtatagctgattttaaatgatattgaaaataa

SEQ ID NO: 158100 - DNA, 554 bp, Homo sapiens
caggcaggatgacgtgtccaatatggtagccactagtcatatgtggctatttaaatccaagttaacaaaaaataaaaaataaggtcaggtgctgtggctcacgcccataatccccgcactttgggaggccgaggcgggcagatcatttgaggtcagtagtttgagaccagcctggccaacatggtgaaaccccgtctctactaaaactacaaaaaaattagctgggcgttgtggcgcacgcctgtaatcccagctactcgggaggctaaggcaggagaatcacttgaaccggggaggcggaggttacagtgagccgagatcgcaccactgcactccagcctgggcaacagagtgagaatccatctaaaaaaataataagataaataaatatgcatgggaagctattctggggagagctgggaataggcccctgggattggagggggccaaaggggctgggtagcagaggcttggtgccatcgggtcaaaggatccataggatgcatgtgttgtgtagagggaagcatgggtcagggttggagccacagtccctc

SEQ ID NO: 158101 - DNA, 483 bp, Homo sapiens
gccgactcttgaggatacagtatccctactgtatcctacctaggctacacacttgtacagcatgttatggatctgtaggcagttgtaacacaatggggagtatttgtgtatctaaacatagaaaaggcacagtaaaaatacagtattaggctgggcgttgtggcgcacgcctgtaatcccagctactcgggaggctaaggcaggagaatcacttgaaccggggaggcggaggttacagtgagccgagatcgcaccactgcactccagcctgggcaacagagtgagaatccatctaaaaaaataataagataaataaatatgcatgggaagctattctggggagagctgggaataggcccctgggattggagggggccaaaggggctgggtagcagaggcttggtgccatcgggtcaaaggatccataggatgcatgtgttgtgtagagggaagcatgggtcagggttggagccacagtccctc

SEQ ID NO: 158102 - DNA, 388 bp, Homo sapiens
ggccaagtgggtaacagaaccaatcactagtattatcctttgtggtttccctacactctgcccacactattgtaaatagtcacttgcttagtgaccttgagcaagtcattttacctcacttataaagtgtcctccaattattccagtttgagtgtgacatctgttttctgctgggaccctggcttatatattggcctattagcctcaaacgcctcatggaagcaaggcagcggaaaggttagacacagtgctgagactagcatgagaaaaactgataagaatactcaattggaaagaagaagagaaggaataggtaaaagaaggcaaaggggacaaaaatggaggaaccacagttctgattatgacttcttccaggtatagggaaact

SEQ ID NO: 158103 - DNA, 2366 bp, Homo sapiens
aaaaaaaaaaaaaaatatatatatatatatatatatatgtatatgcacacacacatatattcgtatgtatatatatacacacatatacacatatgtatacatatatttatgaaaaggacatagaggtggcatatgatcgcatatgtatacatatatatatatatatatatatgccacttataatagctcaaaaaaattaaatggttagatgtaaacctagcaaaccatgcacaagacttctgtgctgaaaactgcacaatgctgatgaaggaaaccacagaatatttcaataagtggggagacatactgttttcatggatggaaaactcaacctagtagagctgtcacttctttccagattgacagacagttttaccacaattcctatcaaaatctcagcaagatttttttgtagatatagacaacataattctaaaatttatgtggaaaggctaaggaaccagaatagccaaaacaactttgagaaagaattaagtggaaggaatgaggttacctaatttcaagacttattgtatagctacagtcatcaagactgtggtgtggatggaggaacagacacttaggttcatgaaacagagtagagaacccagaaacaggcctacacagatatgcccagctgatttttttgacaaaggtacagaagcaagtcggggaaggtcagcctttcaacaaatgatgcgggggcacctgggcacccacaggcaaaacaatgaacagccaccaaaggctcacactttatacaaaaattaacttaaaatggatgatggacttaaatgtaaaatgtaaaacatagtattttttaaaatgggagaaaatctttgggatcactaggcaaagagttatgaggttaggacaaaagcatgaaccataaaaggaaaagttgacaaattagactttataaaaattaaacatttttgctatggaaagaacctgtgaagaggataaaaaagacaaactgcagagtaggagaaaaggtttgcaaaccacatgtccaaaaaaaggaatatcatctagaatgtatataatctctcaatactcagcagtaaagaacaaacaattcacttagaaaatgagccaaactattattaaaaagtcgaaaaacaacagatgctggcaaagctgcagagaaaaagaacatgtatacactgttggagggaatgtgaattagttaagccactgtggaaagtagtttaaagatttctcaaagaactgaaaacagaactgccatttgacccagcagtcccattaccggatatacacccaaaagaaaaaaaatcattctaccaaaaagacgcatgcacttgtatgtttatcacagcacaattcacaatagcaaagacatggactcaacctaggtgcccatcaacagtgaattggataaagaaaatgtgggacatatacaccatcgaagtactccgcagacgtaaaaaaagaaccaaatcatgtcctttgcaacaacatggatgcagctgtaggccattgtcctaagcaaattcagtatcccctgaatttaaaataaaagttgaaattaaaaagaaaagccactgactaaattaaataaatggatttttattcagtaggaaaaaaaattagaaaatggttcaaagaaaaaaagagacatgtcactgaagaggacgtagaggtggcttatgagcacgtgaaaagatgctcaacatcattagccattagcaaaatataaatttaaatcacacctatcagaatggctaaaataaaaaatagtgacaacatccaatactggtgagcatgtggaaaaactagaccccttatacgttgctggagggattgttaaaatggtacagctgctgtggaaaacaattttggcaatttcttaaaaatgaaaaacctacatctgccatgtgactcagtgattgcattcctgggcatttatcccaaagaaatagacttatgttcacataaaacctgtacaggaactctttttactttaatagccccaaactgtagatgtccttcaacaggccagtggttaaacaaattgtagtacctcaataccatggaacacttctcagcaataaaaataagtgaattattcatacacacaacaacccggatgggtctctagaacattaggttgagtgagaaaagtcaaaacctgaagtctgtatagtgtatgattccatatatgtcacactttttacatggcaaaattgtagacacagagaagagattcatgtctgctaatggttgggaggggcaagagtagaaggggaatggagtagccaaaaaggcaacaggagattggcagaagagtggtggagtaagaggtcgggaaggtggagccaggccaggagccgttctctgtagtt

SEQ ID NO: 158104 - DNA, 379 bp, Homo sapiens
tctcctagatttcttctacctcactaaccattcaagatgctcagtctgcatcttgaattcctctccatccacatatcccctataaaatgttggcatttctggggatctttttgttgtcaatgtccttctgattctatgtacatttcccagaagattttatccacgggagtgccctgtactaggttaaatagagtcctccaaaatttcatgtcaacctggagcccgtgaatgtgaccaggacattgcagatgttattgatttaagatgagatcatactggattagggtaggccctaacctcatatgactagtttacttataagaggtaaactgagacaccgagacatagagaggagaatgccacatgaagatggaggcag

SEQ ID NO: 158105 - DNA, 210 bp, Homo sapiens
cctgacctttgtctgattcccgtcacttagcatgttgttaaacatgtcagtgattttggttcctttttattacatagtagtagacttagtagtcgaagtagtagtctactactaagtagcaggcttagtagtcttctaagctatataggaaaaatacactaaatatataatacggtatataatgaagtgtcttatatagtgtgtctgttt

SEQ ID NO: 158106 - DNA, 369 bp, Homo sapiens
acagaaaggagatgctgtctgcttcacccaggccaggaagggaactgtggcttaaagtatgcgggacttaggtcagacacactgaagaacttcctgatggtggtgttgggatcagggcaactagaatgggataattgaaagctcagaatgcccccctcacatttcatctgcctgcccattgagtctgagataacctctgatttttccaccctgaagtcaaatctgtactggctgccccactccctatatcccccaaacccatcctggctcccagagggacgaaggtcaaggggagtggaggacgatttgagaccagaaaggagatgctgtctgcttcacacaggccaggaagggaactgtggcttgaag

SEQ ID NO: 158107 - DNA, 510 bp, Homo sapiens
ccctgaagatgaatgaaatccagatgattctatctacattccagattattgttaggcaattaaaggttgaaaatcacagatctagttactttaattttagaatatgtaattcagaccaggcgcagtggctcgcgcctgaaatcccagcactttgggagaccgaggcagacggatcacttgaggtcaggagttcaagaccagcctgaccaacgtggctgaaaacccgtctctactaaaaatacaaaaattagccgggcatggtggcaagcacctgtaatcccagctactcaggagactgaggcaggagaatcacttgaatctgggaggtggaggttgcagtgagctgagatcgtgccacggcattccagcctgggcaagagcgagcctttgtaaaaaaaaataaaaaataaaaaaaagtgtaattggccaggcacagtgactcacgcctgtaatcccagcactttgggaggcccaggcgggcagatcacgaggtcaggagaccaagaccat

SEQ ID NO: 158108 - DNA, 455 bp, Homo sapiens
ttacacaggcacagaaaactagacattactcagcagtcaagaagaaactggctgaggcgggaaggcaagcatcaggtctggagatagcctggggctgcgtcctggctctgcacttagtgcgggcttcctgggccagtgccacctccctcagatgtaacctggacaagcggggcaccaggcagtctcaggaccaactggatggagagacctggcaccctgcagactgcgaggtacctgatgcgttcagtgggctctggggaggcgccgactactcccctagtcatggccacagtcgacttcttcctgtgcctgctctttcaagacgtgccccctgtgtgaggaggtctagaggggcagggacccccgctcggcagggcgagtccaggtgcaggcgcctgaggtacaccaacagcgcctcccaccatgccaggtgccatgctgggcactctgtcccc

SEQ ID NO: 158109 - DNA, 336 bp, Homo sapiens
gtctgaaccttagaaactgtctccctgtctggaggtagagatacttaccttgtagtcctacaacctctttcaaaatgtgtattctagccttatggctatgtaaaaatatactgaatacacatttcttcatcttagctctgatatctggctactttttctttcttgtgagatcctcagtccccttcctcctcaaggcatccccacatatagcccttctagcccatattgtcacccagcttcaccctaaaatcctccacttaggccagccttctggtgcaaaatttcccatacccagaaacctcttgaattggtcattatcatagaagaaattaagtc

SEQ ID NO: 158110 - DNA, 537 bp, Homo sapiens
cttaggaggaggttacaaggtctagtccaagcagtaggaagaagaaagagatgacaacattaagatcctatgaacaagggtaaagaagttaaattctaattccttaagcctctcttaagtgtgaaaatcaagtgagttatttctgtggttaacatcaagaatgaacctcatgttactttccttgggtggaacaggtgtggaatttcagtatgttgataaaatgtcatggatctggtttagcctttcacagtccttgacagctattcattttcggtagaatgtagcatggaagaaagtgctccaatttgggtcagactacctaggttcaaatcggtgccttcccacctgtgtgacttgaggctaaaagttaacctctccagtctcagctggttggagagcacattaggttagtgggcagcatgagtatagtatggtcccttggaggatggaggggtatccacgaagcactgagtacgtagtaagtgctcatgctcactaactaggatgccagttgttatccagattcatgtttctcaa

SEQ ID NO: 158111 - DNA, 409 bp, Homo sapiens
atgcctgcaatcccaagcactctgggaggctaaggcaggaggattgcttgaacccaggagttccaggctgcagtgagatatgacagcactgcagcacttcagactgtgctacagatggtctcttaaaaataataatataaaaactagttgggcatagtggcatgtgcctgtagtcccagctactcaggaggctgaggcaggagaatcacttgaacccgggaggtggaggttgccgcgagttgagattggaccactgctctccagcctgggcaacagagtaaaactctgtcccaaaaaaaaaacgattacacccttgcaggatgtctctcctgtagacagcaagaggtagaggaggcagagggctctttcttagaaaagaggcctttggtgagcccagaggtttgaaacc

SEQ ID NO: 158112 - DNA, 463 bp, Homo sapiens
actgcactccaggctgggacgacagagcaagactccatctcaaaaaaacaaaaaaagaaaaaagaaaaaatgttttcttcttatggaagctaaggaacttatgcccctccttgcatctcctgtgaaggcagcatcttcttttttcttgtggcttctctccatctggctcagactggctgctgggatcaagccaggactttctctagtccccaaccttgagctgctacacataagccacctcccacaaggcctcttcctcttatgtaaatcaactcataaaaatatatacccgagggctgcttgcggctgccaatttgtatatacatgaaattaacatcttaactgttccagatatttccatgtgtttttcctgaagcagagttgttaatcttttttttctttttctgatctctttccatttccctgaacctttcctccttcctgccctgataccgcccgctag

SEQ ID NO: 158113 - DNA, 654 bp, Homo sapiens
gttcattcagtaaacagatatgaaaaagtattaggaaatattccctggctctaaggaagggtaaaaagatagaactgcaaaatgattggtgaatctttgtgacatctgtatatagctgaagtcctgacattatgaaatgtgttctgccgcactgccccttttttttttttttaaaggtaacttgacttttgacatttaaagatctgttgggtttttgactctcggtgatggcacaggtacccatactcatagttcctctttacccacaatagtaccctttacccaggggggaatattatactctagaaatgtgattcagtttcacagtatgattcaggaagtaattaaccatagccatgtccttttctccctcatgattttttgatctaaaatcagaatctttaaaaatagatctattttagggaagttaagagcatccttttaataaaatataaagtgatataatcatgtctgtttctcatgggagattgtattcaactattgtaatagtatgtaacgcttttactacacttaaaaaattgagatataatttatataccataaatttgctccttttaaagtgtataattcagtggcatttattatattcacaaggttgtgcaaccttcaccactgaccaatcccagattattt

SEQ ID NO: 158114 - DNA, 342 bp, Homo sapiens
tggggatcacaatgtccattggggattaaaggcactgacaagtcctgtgatagagggacctgtttacttttgtttcagccagcatcatgcaaaatgttttgaccataaaattctttttttcactgctaaatatctctttaacatcttgcagaacacacatactggtcaagtgccgtgcaaatacagaacctaaccaatgccaggaggaaaaggatgtgaacacagccaagttctgaatcttaagctcatgcacataaaggacccagggttatgcttagtgcttctgaaactgtttagacatttttgacatgtgggtgccatgttaagatactttatctgctc

SEQ ID NO: 158115 - DNA, 266 bp, Homo sapiens
agaggagggttgctacagctgaggtctcagctggtgcagcacaaaagtgaaataggtccatggatatctgaagccatatgtggttctgtgtggctatggagtcattccgggagacgttcacaggatgatttgggattaccactgctattgtaaaccatggaaattctgtgttaatgttggatcctatttgtatttgtcaagcatagtctggatgcttatccacattttggtataaggccagaattgaaggcccaatatgatgtgtc

SEQ ID NO: 158116 - DNA, 597 bp, Homo sapiens
tgtgttcattttctccatatccctctaatatttgcagtaggtcgtggaaaaacattcaactagaaaataggaaaccaagctcttagtcctagtttcatcactaattggttatgtggtcttagataattcattcactgtgtatttattacctattgcaagtcaggtaccgtatcaagctctgggtgtgagacaacgcacaagggagtcaccacggaactaatgaaatgaataagtaaacaaccactgcaatatagtatccagacaactgagtggtgactgtagtgaatgtagagtatcaaacaagatgacacaacactgtacctctgtgaagtcaggagaggtgccacggaggaaacgatgatgaatcttacaagttaaagacacgttgagtcgaggtaaaccctcacctctctgacatagcttctgtgagaataaaataaggagggttgccagagcatccctcagatccccttgtccattatagtataatatgtgatccaatttttctgtaatagaaacagagctgaagaaatgcttgaaatgctatccataaaaagggagaaattctgtgcttaaattgcaggatgaaaaggagcg

SEQ ID NO: 158117 - DNA, 740 bp, Homo sapiens
accagacaaacttaaggtgttgttctagctgagatattagtaatattactgagtctgtgtagaaaataacttcaatgatggtcatttgtcatcagattaaaaaaaactgagatatacaaaacaaaaaacaaaacaaaacaaaacaaaagacaaaattttgtaaagtggaaagggagcattagattgctatcattcaatagttgtgaagcttggatccagaatagaggatgctgcagtgtcattgtgctcttttcttgtcaggcctcatctggaagagaggcaatagcaagctgcaggtggctggaaagagaggagggatgacgaatctttatcacctgggaaatgatgaaagaaattgaggatgtgtactctggaaagcagtagatttagacagacacaatatgtatgttctcagatgtttaaaagtactgtcatgtggaagatggattagaataggtatgtgttgctccaaagaatagcctgtggaccaagactagctgtcagaaaggtatttcagctcagcatgataaaaaggtttctgactctgaattacatagtgttagtgagtgcttcattataagacgtatcctgttctgaaaaagtagactaggtatgatatccaaggtcacttctgacactaagaaatctttgatttttgtgaattaaagtatattttaaatgtccattctcagttttagtaaaaagccctgtgcatagttttaagataatctgaaaaattt

SEQ ID NO: 158118 - DNA, 323 bp, Homo sapiens
ctacaaaaaatacaaaacaatgagctgggcatggtggcatgtgcctgtagtctcagctccttggggggttgaagcaggaggatttcttgagccagagaggtgaggttgcagtgcgctgtgatcatgccactgcactccagcctgggcaacagagcaagtctctgtctcaaaaaattaaaaataaaaagcattctcaccagaaaaaaaggtaacaatgttaggtgacagatatgtaaacttaattgtaatcatttcacaattgtaatcgtttcacaatgtatatatatgtcaaaacatcatattgtacaccttgatataccgtt

SEQ ID NO: 158119 - DNA, 240 bp, Homo sapiens
gttaagaggataccaccctctagaggaggctccctgttggttacctgctcccctgtagcagcttccaagatgacctccaattatccctccctggtattcatgcccttgtgtggtcccctccctcagtgaatcatggttggtatgtgtgtccaattaaaaaaggcagagtgatggcatgtgacttccaaggctaagtcatggctctactctctgtctctcgctaagtcatggtctctctct

SEQ ID NO: 158120 - DNA, 598 bp, Homo sapiens
gtaattcagcaacatttagttcagagagttcagtacatcccatagatgccaatggcaagccaaaagcatgatcaaaaataggaaaaagaggagaaaactaggataacgtagggaaaagaagacacagcacagcaggaaaagaggagaaacaacaaaatatgcgtaaccattgggggaaactgggtgaagggtaaacaagaactccctgtacattttttgcaacttcttgtgaatctataattatttcacaataggaagttaaagaaaacaaaagaagaaaaaagtggaaagacacatgaaatggaaaggctcttggttccagtttcctaagttcactgagtacttaatgtaccaggcaatctgccaggcactgccctcaacaagctccatgttcactgcagagagaaagacaagtaaataatctattccaccaagtatatcaagacgctttcctgcaaggctctacttttccaattccttaggaaacatggaaaaaagaaaggctacaacagtgaaacaaatataagggcaccactaggtaaagctacaccttaggtgtacctgagcatgagaatgcaggctttgcttattgtccctc

SEQ ID NO: 158121 - DNA, 467 bp, Homo sapiens
ggtatataagatcacaacaactttttaaaattatctcccttaagctagtggtcagtggttgtgtagtacagtaggtacctctttttcttggcaagaaaatgtttgccaagccaccctgtggaccatacataaatgagctcgcctatcaagagagttgaccagttttccatccctattgcagaggtagtatcactggtctttaccaatttaccactgtcatgtcctgctggtcacccatgttttgtacttcaggattccttcccaaagggacctcagtagagctccttgagaatgtggagggtttcaggtggaaccttcccacctgctgcctggttcctgccataagtcagtgctctggaattctgaaccatgtgaattggttctaggatactaggtaggccacactggatgagttgcttctccacttcagcccttcatttcctccactgaaagatgacacaagggat

SEQ ID NO: 158122 - DNA, 267 bp, Homo sapiens
gcggccgcctactactactaaattcgcggccgcgtcgcctgagcagtgcctaggagggagagggagaagcagtgtgagcctgcaggcacgcaggagtccagttgtacacggaggcgaaacactgttcagatcccgctgcagtgttaactatggtaaaggcagagttgaccaccggaggagtccttcagcgtggaggccttcagcgatcttggcaagcaccaattttcatggatgtaggagaatgggagcagaggaactggaggctgc

SEQ ID NO: 158123 - DNA, 181 bp, Homo sapiens
gtggatagatatccttcaacagttctgaaagatttccagccattctcttcatatattatctgtgctgtattcttgtctctccttttagaacttcgattagtaaaaacatgtttgatgtcttttcccactcttgttttttgtttctcccatgctgaattctgtgtaatttcttttgaactat

SEQ ID NO: 158124 - DNA, 190 bp, Homo sapiens
aagtgccaggcatggtactaagctcttcacacccatcaactcatttcatccttaaaacaactctttgagataaacgttactgctttctccattctctgacagaaagagaataagcaacacaccccaataaatgccacagctcagattctaacgcaggcagtccagctccagaggctagataaccacattg

SEQ ID NO: 158125 - DNA, 308 bp, Homo sapiens
tgtctgtgtgtttttaaccaatgctacatcgaatctatggggaaaccaaccaagtaacctaggggagctttggcccaggcagactctctgtgactatctgctagggctgatagcagaatgggtagctgtctgtcccctctgctgccagcaaatggaaaacagtcttgactacacattcactagtgaccgtgagtgatcttattttatgcaagtacataactgctttgaattacttgagaacgcaaaaaataataactacagaaaactctatatcctgattcagatacagtccacctcttcccagggtc

SEQ ID NO: 158126 - DNA, 373 bp, Homo sapiens
aaactgtgcagtgttctgtctgtcaatgtccttgttgcatttgcagggcaggttttctaccagtggctggggacttagttttactgggccgagggaaggttaggatttgagggtcttgttaagctggatatgggctgcatttcaagcctcccctggctgtctctatcctgcgtgttgatgccaaggctgaagaagactggatttgcaggcaaaagactgtcatttgaggcctgttttcaccccttaatcactgtgtcttggtatgttgtgggggttgaggtaggcagaggttagccaaccttttctggaaagggctggctgataaatacttgaggctttgcatcccatacactgtctgtggcaacccctaact

SEQ ID NO: 158127 - DNA, 347 bp, Homo sapiens
gttacaatacattacagtgtggaaaaagcaagttacaaaacaagggatataacatatttgcagttttagtacatcctgctgtgtcagggcccgaaattctgaattgttaacaatttccttagtgttgtcaatgctgctggtctgtggaccacactctgagtagcaggttaaagtgtacacagacatctctgtgtgaataaacacttggaaatacacgtggaaagtttcctgagatggtgaatctggatatttacttttgtctttgtgcttttctgtattgtttaatacttcataatgcatctgtatcaagctttacataaacaataaagctgggttttaaataataa

SEQ ID NO: 158128 - DNA, 130 bp, Homo sapiens
gtgatcagagcagaagcacccttaagagatcacccaagagagggctccccaaactcacaatccaaacttgcaggcccctgcgtgcaagagtgaacgttataccaagtccaattttttattttatagcttc

SEQ ID NO: 158129 - DNA, 539 bp, Homo sapiens
cacagatggggcctttaaaggataattaggcctgaggactccttcttcattaatggaattaaagcccttttgaaacaggctgtatacagtgttcggctagcttgctctcttacccttccaccttctgccatgtgaggatgcagcaaggaggccttcaccacaccaaatgctggtcccttgaccttgggctgctggcctcccaaactgtgagaaaatcattttcttgtctcaataaattacccagtcttgggcattctgttactagcaacccaaaaggaataagatgctaagttttatgtaaagccagcttgttaggggaaaaaatcagaatcatcagctagtctcagagtagtaacacacacagaaaactggaactaaccattttggtctgagcttagtgctagctgtgtttgatgaatagaactaggtgatggcttcagctcttttggccttacgcataggaaaaactatctttttttcattctaaatctgcacatttggcccggccgccccgtctgggaagtgtggagcgcctctgc

SEQ ID NO: 158130 - DNA, 297 bp, Homo sapiens
gtagagatggggtttctccatgttggtcagtactcccgacgtcaggtgatccggccgcctcggcctcccaaagtgctgggattacaggtgtgagccaccatgcctgagcatttattttattttatttttaagagacaatgttttgctatgttgcctaggctggtctcaaactcctgagctcaagcaatctgcacaccttggccttccatagtgctgggattagaggtgagccgctgtgcccggcaaaatattttaaacttattttgagatttcttatttgacccatgtgttatttag

SEQ ID NO: 158131 - DNA, 506 bp, Homo sapiens
gtgttgggattacaggcatcagccaccatgcccggccccagcagttttctatggatgttagtgaagtcatgtataaagatgaaaaatattctggagattctgacaggcctcttgaagccacctttttttccctccaatcagaccactgctgtaaaccacactgacactattgtagtatgcttttttcctatacccataacacagtgggagattaaaaataattttgtagggtaggaagagaagtggatagagagccaggagatctaggtttggtgctgctggtcctgcagttaagcaggcatatgtctttgggcaagtcatttcacttgtttagattaattttctcacttatgaagtgagggatttggactgcttagcgaggtacttttcatctctaaaatttatgaatctaaaatacttgcagtaaatattaaatattacaaatggttaatattttaaaacttactcagatgagtaaaaactcaagggagctccaagttgatgaa

SEQ ID NO: 158132 - DNA, 403 bp, Homo sapiens
cacctgctcagaatggaggtaggggcagagcgctttctcatctttgaactctgcggtggacagggatgggggtcatgttcctgggttccgtggatcctgaagaaggaaacaaggttatttctgaaatgggttatctgtgtcattgtatgatctctcttgtcacacacacaagacacatacacgccaaagatcataaaagatgtatttttaaagccccagtgtgtacattaacttacatagaataacctgattagctttgaaggctgttggcttaaagagaatgaagatttccaagtaaaagcagaggaggaatgctcgatgtcattgagaactcaaggagaatttccttccagtgaagtctcaaaaaaaccaaaggaagaagcagcctctgattatataattt

SEQ ID NO: 158133 - DNA, 355 bp, Homo sapiens
ctgatttagaggctgcagtgcaggagtaagaaggctgtgccccctccttccaatagagaataactctgaagggctatctcagcttcagatctccttttacaatcagatgatgcctttttgtgcctaaatcccagtccagcttctccctccagtcatcccggcttccttcccttttcccacaggtgttgactccaccaggggtcccaagaaacttccttctcagaaactctctttctttcttttttttttttccctttggagacagggtctcacttggttacccaggctgaattgcactgccagcctcccaggggaactcctctagaagtctcgaccgtgcaggcttgcaacctgg

SEQ ID NO: 158134 - DNA, 471 bp, Homo sapiens
agtgggctctgttccaaggagaacaaaacacactcttgggaatcccacactacagagactccttttgtctctctttttgtgaatctctaggttgactctcacagtgctcatttttcactctattgcaataacctcgcacttaacatctaccctggcacatcagcagactatcagcaattggaaaaattaaccaaataccactatctcagatggagacatctagacagagaagtttaaggacactaacgtctaatttcccaaataaagggaacctctttactctcacaactgcttctctggtgcgaccccaacaaaggagggggtggtggtgagagtcccacctctaaagcaaattgtcagacagatgaaaaccagagctgctttctttcttttaacattatggggagtaggggtgtgtgtgtgtgtgtgtgtgtgtgtgtgtgtgtgtgtgtgtgtgtgtgtgtgtgtgtg

SEQ ID NO: 158135 - DNA, 540 bp, Homo sapiens
ggagacgaggatgcagttcaagatgcacagcttgatccaaggataaatcctagactatctagagaaagtggtggctggcctgcttctcaacccactctccgaaatgctgtttttctctccatcgcacctttacttcatattgggcagtaggtggttaaggcagccatccccagcaaggtctgactcagctggttgttgggttggaggaaactctcatttaatttagagcagccatcatcaggcttctttgactatatgcccaaccagtaacaaggtttagtatgcccccagtaaatctaattttttctttgttatatgcaactagcttaatctactatgtattttgtaaatcataccccaaaataagtaattgaaagggatgagattcaaatcaacattggcagaagctagtactttctttctcttctgcaggggattgtcttttgcagtcctgaggctgggtacactcccctttggatgcttgttgctctctgagagcatttttctggcttcaggaacatcctgctggaaggggcagag

SEQ ID NO: 158136 - DNA, 511 bp, Homo sapiens
tgggactcgcttatggatcggacttcgctatgcatcggcacctcgctattcatcggcacctcgctattcatcggcacttcgctattcatcggcacctcgctattcatcggcaccacccttacccccagaaatagctgcggggctatggtagcctgaccctttcctgacatcctgctcatgcggcaccatgtcccccatcagcagggaaccacgaggccaagaggtcaagggtcttgctgggaggcacagcattggtgtggaagaaagcaggccctgactcacagcctcatgccgcagtgccaaagctctgcagcctgcagcagacatgattgtgacacccgagctctccaaatatgacagtcaccagggaccctccaggcgtctgccgtccctcggggcagggcggggctgcaagtgtccaggctccctcatcctctcccatttgttcgtcctcagagccttcagacaaagacccagagccttcaaacagccagatacctgcgggcatcaa

SEQ ID NO: 158137 - DNA, 127 bp, Homo sapiens
taggcgaggccctaaatcttgtagagcacctcacacattctcaaggtcatttgccttgtttccttgtttaatgacagttgcctaagatccaggaatgagtctgtgacctgacctcagcaactctgaa

SEQ ID NO: 158138 - DNA, 193 bp, Homo sapiens
cttatatggccactctgttgactgagatgtaatctaatgaaatgagatttgtctgtcttccccacactcagcctgctttggtacaagtcacaggaggcctttgactgctcataggagaatctctgctgatacacagtctttcattgacaaatatcaatcactgtatttgcaccatatccaatgactagagtgg

SEQ ID NO: 158139 - DNA, 406 bp, Homo sapiens
taatagccatagactcaatattttatcttagggaagtcattcctcaggcccctacgactccatctcacctctcagactcccatgactctttcttacatctcattatgttaaatttaactggctctctgtttcccactatatgctgctctttccatcctaggaagcagacgtcagtcagttctcaacatctagcatttgccacaaacattggtttcataataggtcaacaagtatgttgacctatataaccttgctaagaattttagggaaaggatgagattcctaatttgtagtctcccttcatccataattggtgcccgagagaataggaccctaaaatgattgggattgcagggcattagtgagattgggcatgttttataagaacccatggaacagttatctc

SEQ ID NO: 158140 - DNA, 236 bp, Homo sapiens
ttctgatgttatattgcagagtttttatggtttcaggtcttagattttaagtctttgatccattttgagttggcttttgtttaaggtgtgagagatgatgatccagttttattcttctacacgtggcttgccaattatcccagcagcatttgttgaatagggtgtccttttcccactttatgtttttgtttgctttgttgaagatcagttggctgtaactgtttggttttatttct

SEQ ID NO: 158141 - DNA, 358 bp, Homo sapiens
tgatgaatgcttttgcatgagcagatttccaacacgggaggggacttcatgagagatgccccacttccgagagggtgttgtctcaggggtggcattctcaatcctgacaggactaggacttctgagcaagcatccctgctcctcggccagcagttcttgcttacatggttggttacagccccttgcgggagctctgcttgccacaggagcaaatacaacttggcaacatcagatcccccaaaagctatttgttttggttaagagggaggactttgggtaaattagagagggaggaaaacccacagacggtgatttgacataccgagagcagagcacaggaccaccagccaatgaagtc

SEQ ID NO: 158142 - DNA, 608 bp, Homo sapiens
atgaaataatgaaatttaaaaatatgtattataaattaaactatatacttactattctcattataataaaatcctagggataaggaactagtattgcaagggcaccattcccgttttttattattattcctagctggaattttattcctcaaggcttagctctaagtgactatataatgaatactgactggcaaaactattgggattctaatttaagaatcatcagattctgcacaagaaatcttgaagcatgtcatcagtaacatgtggagaagctgtctaaaaaggcatgcctttcttttaaatgtccatgagccctggatccacagattatgagacatgaaggatcacgcatgctcaaacagggcttatttaggtgtcatctatagaggggctgctctcttcagctgcccgtcccggacccgggaattatgtctacagttttcagtttccacatgtctttgcggcaatgctaccatgaattattttacttgggactttagattaaccacaaaagaaactaattgaaaataactaagatcattctgtcatgtgagccacagtttactacagtcaacttaagcacaattatatatgataaactatag

SEQ ID NO: 158143 - DNA, 559 bp, Homo sapiens
  misc_feature (192)..(192): n is a, c, g, or t
agaggatgcagagaacccaggagtttaagaccagccacaacaacatagtgagattccatctctacaaacaattttaaaaatgagccagccacggtggcgcgtacctgtagtcccaactgcttgggaggctgaggcaggagaaccacttgaaccctggaggcagaggttgcagtgtgcggagatcacaccatngctctccggtctgggcaaaagagagagactccatcacaaaaaaaaataaaataaaataaaataaagttggttccatggatccagcatccccttttaacaactaaatcctttttccctacctcctcttttgcctgggggtgctggaatccccccactgcctcctgttctgggccagtacttgatttacagagctcataaatccaggccatgctcgggggaaaaaagcaccatgattctgaccttaaaatcaaggtttggctgggcggagtggctcacacctgtaatcccagcacttcgggaggccgaggcaggtggatcacctgaggtcagaagttcgagaccaacctgtccaacatggtgaaaccta

SEQ ID NO: 158144 - DNA, 293 bp, Homo sapiens
gttggcggagtgaagccagagagtgtgggctctctgagtggccaggaaaggcagccacctggaagggctggcagaagctccacagaggactgagaatccgaagtatttgagacaggtgtcaatcagttagaaagcttattttgccaaggttaaggacatgtctgtgacacagcctcaggaggtcctgacaacatgtacccaaggtggttggggcacagcttgcttttatacattttagggagacgtgagatataaatgaatatgtgtaagacggtcacaggtagagacaaatg

SEQ ID NO: 158145 - DNA, 171 bp, Homo sapiens
gctggtttaatctggaagaggctcactaattcagtaaagggatgggtcaaaactaaattcataaatgttcttacttccaaacagcttctcttctagggctccatatctcatcttcccatcagtcattcaaactaaaactctctggctcagtgtcatcgtgggtcccactct

SEQ ID NO: 158146 - DNA, 339 bp, Homo sapiens
tcttgcaagagtgaggtggtatcacattgtggtttcgatttgcatttccctgataattgatgatgctgagcattttcccatatgcttgttggctatttgtatatcttcttttgataattgtctaaaagtgggctaatgtccttagcccattttttgatgggattgtttttttcttgctgatttgtttgagttctttgtagattctatatattagttctttgtaggatgtatagattgtgaagattttctcccactctactgattatttcttttgctgtgtagaagccttttagtttaattaagtctcatctatttatcatttttgttgcatttgctttc

SEQ ID NO: 158147 - DNA, 691 bp, Homo sapiens
gcattgtttttagtcaactggtagtaaaaaggaaatcattgtgatcattactttttgtttctattgctggccttcatgatgtcttcatacactgaaacccattcccttcaactcttgaggtacatacccctcttatttagagttcatggcactctcaatctctaattactgctttgttgttttctagcttgctctgtctttcttctcaagctctgcaggtaagatttaagtgaagcatcagtgaactaaatttagcgccgtggagttgtgaagtaagtgttactggcagagctgaatcatcattctttggacattctcctactcttcactaacttagcattttttttttcaaagcaggttctgttttaaaaaaaataagctagatttatttgcatgattctttggagaaagagccttattttaggagtgaattgtacgtggtaaagaaaagaagggagaaatggatgaaggggaaagagatgtggggtgattagttatctcaatatcccttcgacaataccgtgatccttgttttctcagcctgagttttcatcttgataggaaactagtactttatttttctgtatcatagttaaatggaatatatctataaatagttttttccttgatagtggtaggagacatttcaagagcttactttgcattaacctcactagttttcttctagctt

SEQ ID NO: 158148 - DNA, 247 bp, Homo sapiens
ctattaagcacccagtaggtggtttaaattgaatggaaccagaagcagaactttggccaaagagatggggacaaaggaatgagagcaaaggtgaaaaaggcaaaatgtcaaacaatatcattcttttggataaaaatgtggtcttttcccttgcaatgaggtaatgctaaggaagttttttccccacagtctgcatatgcttagtacagttaaaattaaatcatcgtaaaatagaaactacaactag

SEQ ID NO: 158149 - DNA, 131 bp, Homo sapiens
cacgcagcttgagcaccccagccgatggccgcgtcccgggctttgtggccccgtccccagcgtcgcggagcagcgggtttgcagggtgtcaactctggggacgtgcgtgcgtgtgtgtgattgttggggag

SEQ ID NO: 158150 - DNA, 256 bp, Homo sapiens
atagatgtggggggaccctggatccagggaggagctctggtagggagggttggggtgaagccctggttcctgcctttctctgactgcccctgacttagctattgattccctgccatttctccttcctctggccctacctaccttatagggatggtgagatagcacagcagaaatattctgagctcacgaaaggaatgccgtcacttagatctgagaggtactatacccctttcaaagaagatcccacatgggaaga

SEQ ID NO: 158151 - DNA, 624 bp, Homo sapiens
tgagagacactctgctagatgctggggccataagagtgaaaataatagtctctgccccagaggggctcaggtctggctccttgatacatttcacagatgaggaaactgaggcactgaactttctggtttctttctctgggctggttatgctgtactcccttcactgagtattttcctcccttcatgaattttcaagagtttcactcttgttgcccaggctggagtgcaatggcgtgatctcggctcactgcaacctccaactcccaggttcaagcgattctcctgcctcagcctcccgagtagctgggattacaggtgcccgccacaatgcctggctaactttttgtattttttgtacagacagggtttcaccatgttggcaggtttgtctccaactcccgacctcaggtgatccacctaccttggcctcccaaagtgctgggattacaggcgtgagccaccgcgcccagctgcacaaaagtttttaagtttgatgtagacccacttgtctattttttgcttttgtttcctgccaagagagaatcttacatcatgtgacataatcatgggagtaacatcctatcacttataccatatcggtcagaatcaagtcacaggtcctgt

SEQ ID NO: 158152 - DNA, 130 bp, Homo sapiens
aaaataaaatcgaggatctagtcctcactgtaaattcagggcttagccattatatcagtggcttctaaacgttttctctcctgaacacttaagtcgcttcccacggttttaggaattgatgccacaaaag

SEQ ID NO: 158153 - DNA, 162 bp, Homo sapiens
tctgcatttggctattgtagattttactgtattgagcagcctaaaacataaatttttgtcttagttcctgattttcttttttctgcaacactaattcctacaagtggaacatttgggtcaaagcacacaccttttttttttcttttaatagccattccttag

SEQ ID NO: 158154 - DNA, 253 bp, Homo sapiens
ggcgtctctcaccttcaccttcctgagccatagacttaggggacttcagatatgtcccacaagtccttgtccatgtcacatgagcactgaagaaaatacttctttctgctttctggtctgtgattccctttgataatgtcatggaaatttgttcaaggtttttagtacttgtattttcctgagcatatactttattttctgtggtttcattgaggatattaactaaaaattgcttcatttggggaggcataag

SEQ ID NO: 158155 - DNA, 412 bp, Homo sapiens
ctgagacagacaaaagtcatgaagtgtcacaccacattcaggagaaagtgaggcgttcagtatgactggactacagggtagactggaagacaaatggggcccaaccataaagcagcctgaacaagctagggacatgttccctagatttgagacttgatcttccagttaactcgaagatagcctgcctctagtgttcccacaatagaatggcataactctattgtggcctttatcgtactctactgcaatgtttatctttctgcaccatccactttgctgtgatctctttaaagacaggaaatcttgtcttgttcattttccagggcactaagcataccaacttacatggcacatattcttttttttttaaatcccccaagacggaatttcgctcttgttgctcaggctggag

SEQ ID NO: 158156 - DNA, 642 bp, Homo sapiens
cttggatgtgtgtgtgtgtgtgtatatgtgagagagagagagagaatgagagagagagaatgcttaagatgtactctcatagcaaatttcaagtatacagaacaatatttttaagtataattctcacactgtacattagaacctcaaattgtattcatcttattactgaaggtttgcaccctttgcccaccatctcttcatttcccacagctccagtccatggcaaccaccattctactctgtttctatgagatcacaatggcagtatttccttcattttatgactcaataatattctattgtacatacataacacattttttatccattgataaaatccaatccaatgttcatccatccaatgaacatgagagtgtagatatctctttaagatactgatttccgtgacttcagagctatactcagacttgggattgctggattatatagaagttttatttttagttttgtaaggaacctccatactgttttctatagtagctataccaatttacattcccaccaaaaatttgagacagttttcatttatccacatttttgccaacgcttggtatcttttgatattttttattagagacatcctaacagatgtgagattatctctcattgtggttttgattt

SEQ ID NO: 158157 - DNA, 478 bp, Homo sapiens
ccttttttctgtgtcttcatcaacacatgttatcttttatcattttgataaaagccattctaacaggtgtgaggtgatacctcattgtggttttaatttgcatttacttagtgattactgatcctgagcattttttaatgaacctgttagccatttgtatgccttcttttgagaagtgtctgttctagtcatttgcccattttttaatcattacttgttttcttgctaatgagttgtttggattcctcatatattttggattttaactccttatcagatgtatagtttgaaaatattttttcccattctgtgggtctgttcactttgttgtttttgtttttttgtttgtttttgtttttgttttgctatgcataaactttttagttttatgcaatcccatttgtttatttttttttggttccttttttttttttgggaaccagagttgggtccttattggcccaggctgttgtccaag

SEQ ID NO: 158158 - DNA, 323 bp, Homo sapiens
atagtggcatttactgagatgggggttctgcagaaaatacaccttgaaaggggaataaaaagttagttatgttttgtcccagaatcacagcaataataaattagtcttaatgcattaagttttggggtggtttaataggcagaaatcgatcactgaaacattctagtaagtactgtttccttgatttcaggatgcttttgatggagtaatgagcgtcaattaaatgcacacatcaaatgaaaaacacatcacgattttagaaacctacttaatatcttctttagagaaatgtctattaaagtccttagcccactttttaatca

SEQ ID NO: 158159 - DNA, 1296 bp, Homo sapiens
gtgaggcgggaggatcacttgactcctgggttacagtgagctctaattgccactgcacttcagcctgggccacagagtgagaccttttctcaaaataaaataaaataaaatataaccttttgggcaggcatggaaaggggctggagagaataagaggaaacagagataagccccctccctgggagcacaagggactcatccccagacatggcaccacaggcaaacagacactgtcacaaaactagcatattctctttcctagaagtcctttgttttccccaagtgccctttcccccaaccttttgttggtttacgagctctcaattctaacctcctagtacacgaataaaaatgtctatcggggtggtggcgtgagcctgtagtcccaggtacttgagaggcagaggtgggaggatcctctgaccataagagttcctgaccagcctgtgcaatactgactccatctcaaacaaaaaacagaaagctatacaactccgtttctcttgctaatttgtcttttgtcagtttaatttgcaggccccagatgctgaatctaagagggcagaggaaaagcttttcctccctgacataaccatccaggagaaagtctggaatggagggtcagaggggtagggaatggagttaggagaagtagatagattcaggacagtctttggagaatgtacatcactgaggtcaagatgtcctagggaatggcccttctgggttcacaattctgcttccgtcggttaacagcaacttagtcccttctatgcctgtggggataatcagtcaggataggctggattatgctgctctaacaaccccaaatttctctgatctaataaaagtatactcaaagctgtatacccttcaagggtcccctggggtctctgctcattgtagttcctgccctggctacaggcataaccatgtggaaatcaaaggctttcttggcaaagagaaagagagctctagaagctttagcactggcaaataaataaatgcttggcgtataggtgatatatggctcttctggctcaggtccttggccagaattaatcacatggtctcacctcaagggaacaggtgagttaaatgcagaaaaatattcaagctgggtgaggtggctcacgcctctaatcccagcactttaggaggccgaggcgggaggatcgcttgagcccaagaagatcatggttgccgtgatccatgatcataccacggcactccagactggggaccaaagtgagaccttgtctctaaaaattaaaatatttagaatgtttcctagca

SEQ ID NO: 158160 - DNA, 368 bp, Homo sapiens
gctttgtactaatccttggtcattcagtaatgtataaaacgtgattcttgcccacaatcacacaacaaatgatataatccctttgccaatttatgtttcttcctgtccctgtggacctcgaaagctacacacacacatacatttcacttcgttatcaaaaccaatcccatcattgtttgttcttctcctctacagtcatcctaccggtaaccttcatctcattaatcgcctgtctgtggcccctaccccagcccctaattcctttctattctctggagggccaattgcccttccttttaaccttctggttccctggctacttccttcttacgtcccttttcttgtttatccagcgggggtgcgggtct

SEQ ID NO: 158161 - DNA, 536 bp, Homo sapiens
ttctagctcggtaccccacaccacctgagtcaaggagtgactttcattttaatggcaggctccccctggcttctgggcagagaatagcatgtatgggtgtattcctctggggtcacactgctgtaaagaactgcctgacactgagtaatttacaaaggaaagaggtttaactgactcacagttcagcatggctggggaggcctcatgaaacttaacaatcatggtggacggcgaaggagaagcaaggcacctttttcacaaggctgcaggaaagagaagtgccaatcgaagggagaagagccccttctaaaaccatcagatctcatgagaacacactcactatcataaaagcatgggggaactgcccccatgatccaattacctccacctggtctctccctcgatacgtgcggactatatggattatggggattacaattcaagatgagatttgggtggagacacaaagcctaaccatatcactatgtaaccttaaccagagaatttctccaagcctcagttgactttttgtaaaa

SEQ ID NO: 158162 - DNA, 265 bp, Homo sapiens
agcttgtttattgcatctggcctgcaaacaaaattaattgacacacatgctttattccagattgtggtgctattacatgtattgtcattattatgattttagccataagtgtttggtttgaggcagaagtagtgggatattgctgtcaagtaaactggggccactaaccttgtgggaatcaacttagcattttaaaattatagactcgaggtttttagaagaagctgaagggttctgtatgctgcatggaagattgagttcaaat

SEQ ID NO: 158163 - DNA, 443 bp, Homo sapiens
gcatgaaggtgagatctaagcttactaattagatcgaatgcagtttgacttaaagagcagacttgataattaaagaatttcataccaaatatacattttgaaaacatttcttttcacatccttgaggtaaaatgagttttcctgaattttttcccttcttttcaaatagaaatttctcttacagaaagatgatcaaatcttgtatcgcttgttagaaaatgacaaacctctcatttgtttgtcatttagccaacatcctgtgttcaggttattctaattttttttcccatccaagtagaattttgaattgcacggaacgttgtgatgaacacaagttgttgtgtcttgtgtttttccccccaccaagttgtttgatgctgttgaaatggaaggctgaagtagaaggggcacttaagcagtgaagggtttttctttgtaaataa

SEQ ID NO: 158164 - DNA, 370 bp, Homo sapiens
tcccgccagtaagggtgtgccaatcaagagagcttagcgtgtaaaccgccatttcgcctctcatctaaatcatgatttttttgtaaatgtgtgacattcccttgtgcattctcaactgaaatgctatacaggtgatgctgtgtctttcttagggtactacatctgcaggcacatgatggccttttgctcctcattggtgagatgaactctcattaactggactgtccactgtctctgctgtatagtcactattttcctcattgcaattgatacctgctcagtaggaagacctcttgagatatgcaaatatcctgctcctcatcaaactctcaaaatctctctcctcctcaatgcatgcaaaactcttctt

SEQ ID NO: 158165 - DNA, 585 bp, Homo sapiens
cccttgaccccaggaggtcaaggctgcagtgagccgattgtgccactgcaccccagcccgggcaacagagcaaaaccttgtctcaataataattataatgttggcctttccaataggtgtgttgtggtatctcatcatggttttaatttactgaagctgttcttttactaggactccctgcatctgctcttgttctcctatagcctgttctgcttacagaagctggagtgagcctttatctcctcatctcacttggacgaggagccacagtccttacagcagcacagtggcaggcaaatggggccatgcacactcacagagacacaaacgcacacaagtgcgcacacacacagatgcatgcacacacacacagacacatggacacacgtgcacacgcacagagacacacagatgtacgtacacacacgtgcacacagcggcaggcagatggggccatgcacacgcacagagacacatgtgcatgcacacagatgcacacgcaaacatgtgcacacgcatgagacacacacgcatacatgcacgcacacacagacgtgcacacagcggcaggcaaatggggccata

SEQ ID NO: 158166 - DNA, 577 bp, Homo sapiens
ctgatgttccatctgttagtaggataccaatccatggctcctcactttctaggagtctcagaggagacagtaggccctggagacacccatgatacaaaaccagagcgagatgaagacgctccactcacctctcccctcattcttgcccagaaaatttgctctatcttccccattttttaccctgcccacattacccaccacaattagacaaaaggcctcaagaagtctgcagaggggcaggatgagggcaggggtcagctttcctctttcagttgttttctgattactttagacttggtccagccaggaagaatccgtcactctcagcaggcagtgggtggggagaggtaccagcagacttagaagtatatatggaatgtattaaaccgtggtgcaaaaagaaaggcctgagaagctaaaccaaagagggagatgcagttgcacaaagttaggggattgaaaagcccccaagtaacagaaggtgcaacatagtaagaattttaaaggtgataaaggtaacttgctgtcaaaaaggcagatattactaaagaaacaagtgaaattgattcctttctca

SEQ ID NO: 158167 - DNA, 474 bp, Homo sapiens
tttccaaatgaggtcacgatcacaggcacagcgttggtgggtaaatgttcaacatatccttttggggaacatagttcaacccgtaataatcatcaagggcagcctagatcacaaataggaagacataagactttattttctggcagagcataccacctattggcaaagaattagacataaatcagagtaagtctagatctacctaccaatttacaggaagtagagagtacaaaaaggcatgttaaaaaataccacaggcagtagaatcagcaagatccagaatgtgggaaactctacaggactaataacttggtttcttcaacaaataaattgcaaggaaattccaggagagagctctgtaaattataataaaatggacataatagacgtaacaaccaaatacaatatatagattttgtttgaaaatttgaatacttactagatatttaataaaataatggcttatcgacagtt

SEQ ID NO: 158168 - DNA, 283 bp, Homo sapiens
aattctgataagcccagtcatacatgaaagtcacccaggagcatccttctctctgtcagtgaaagtcaagagcatgccttatagatactcaatgcgggcacttgatacactctttgcagctgaatcctggcacgtgcaattattaatggtatggctactagtatacctcttgcataaaactatatttgacagcaattcacctacaaagaaacaacacctcagccaaaacaggcacacatggtggtgacattcaccccattatcaatcacttttgtggcactat

SEQ ID NO: 158169 - DNA, 496 bp, Homo sapiens
cccttagagttatgaaccacatagcacatggttggtacatgcttggaaaagttactctggggctaagttcaatttcctcacctgtgaagttaagaccaaattaccttacagttatataggaatttgtagttttcacagggttttggcttgttgcctctcaggtgagttttacaggaaccccgataggcgggcagggaaggtgtcagcgccctgttttatagttgtggatttcttaacagttaaagagatcacatgaaacactgtaaaaacagcaaaagtatcaatacgactctaagatgagcatgaatccccacgttcctagtccttctgggaggctatacttaaaaagagtgacaatcacaatggctgggtgattaaataagtcaattactggaataaaaggtttttaaaagactaaacataaaaggaagcaaatgaaagtcgacctttctaaaagcatagtcagaatttaagtacatgcatagaaaaatatcta

SEQ ID NO: 158170 - DNA, 415 bp, Homo sapiens
tttgcttattcactgagtatttgagcactgctgtgtgacaaacatggtggtaggcactaagttctggtcacagagctgataaagagcagtgttaggattgactgaaagtcagctgtgtctgatgccggagactcagcacaatccatttctccccggaggcagtgggctactcatgcttcgccctccattttgctctctgatctcagaccagtttctcctcttcccatttctatagctgggatgagagaccacaagggatacagaaaagggcacagatgagttggggaggggagcaggtatctgagtcaaggtccctggacaccactactgccatgggagaagagcatcttaggcccctgaaagtgaggtccccaacgttatccctaggaatgcatttcatgagtacagggcaatc

SEQ ID NO: 158171 - DNA, 220 bp, Homo sapiens
tgaatattgagcagttcaactcacaaaaacacacatagtctttaagaggttgtcaattctcagatgatcaatttttttcattttgtctgaggggtggtgcactttcatttgatagttaatgggagtataatataatgcattatctcacagccaaatattggttctaagtttactttgatacttcaggttaaagaatactaaactgcaaatataaaacagt

SEQ ID NO: 158172 - DNA, 194 bp, Homo sapiens
cacattactgccccaaattcatatgggatatattgcaagctctctctaggctctgtccatctccactgaagtgacaatacaagaagggcctgtaagcactcttggtctcaagattgattctcttgaagccaccctccccacttcctgggcttggggaaaaccctcactgttctccccatgaggagaggaagtgg

SEQ ID NO: 158173 - DNA, 459 bp, Homo sapiens
cttttacaatacaaaccgaggtctgtaaactaagtctgtcattctccatggttaagatatgtcattacctaagatatatactgtagaatagaatcattcttacaatacggtaaaaaatcataactttgcatatactctcatatggtatgactgtgtccccacccaaatttcatcttgaattgtagctcccataatccccacttatcatgggagatacctggtgggaagtaattgaatctgggaggcagagatctctccctcccagcctttctgttatgaatctatgagaatcaattctgggcagatgaaaaaattctacaattgttatttttaactactacttgactatacttaaaacccaatgctgttgcatttctactgccattttactacttcctgagttcccacttcagtagttctcaatcttcactatctctaagtaggataaattagaaatca

SEQ ID NO: 158174 - DNA, 157 bp, Homo sapiens
tgctgggattataggtgtaagccaccacccccagcccattaataggttcttgggacaggaaaagcatcacgcataagctgagtatgtgacattcacagttataattatcaagacgaaaagatgtagggagaccaaattttgaggaaggtggaccaac

SEQ ID NO: 158175 - DNA, 363 bp, Homo sapiens
attgtattcgaggggagcaaggaggccagtgtgagcagctggggcagagtaacaagaatgaagtgatagaagatgagtgaagaaacaatgggggggatgtaagctcaggtgggaccaatgaggccatggtaaggatctaggctgctctgatgaaggagatagaaagccatgtgaggatttgagtaaaaaaagagaacacatcctgatgttcattctaaaatgatcttctggttcagtgtgagagtaccctataagaggtttgagggtaaaagtaaaggaaccaattacgaggtgattgtaataatcccaacaaaaagcaatggtggtggctcaggatggtggcagtcggggagatgagaagtg

SEQ ID NO: 158176 - DNA, 494 bp, Homo sapiens
gatatcgtacagaggctgggaaggacagcagagaggcagatagagatcggttacaaatacaaaattacagcaagtaaaattccattgaataagtgtagtgttctgtggcactgcagaatgagtacaatggcaataatacattttatattttcaaatagctagaaaagcagactgtgaatgtttctaaacacaaagaaatgataaatgattgagatggatatgctaattaccctgatttgatcattactcttagcacacatgtattgaaatatcacaccaaaccccataaacattgtcaattaaaaaacaataaaagaaacagaaaggcaacatgtgtctgtaggtaaagatgaaggcattgcctataaaccggaacaatataaagatggcactgactggagagcactcatttgtacattcataagtgctcatgatatccttgtgagcacttgtctctcctttggccctccatgcacatgattctcatgagaagg

SEQ ID NO: 158177 - DNA, 242 bp, Homo sapiens
ttccatgaaatttctaaattatccaaaccacatcagtcacatattcctgtaaattacattattattactgtccattaccaaataatttagcaattaattaacttctaaggttttttttttttcttccctttcatttttatctccagtgctttggtctttttttccccaggttttcccggggggggcccccccaggggcagggggtccttttagggtcaccctgcgggcttccagtttgggcc

SEQ ID NO: 158178 - DNA, 425 bp, Homo sapiens
gtttctcctttacatattcttttcaccccagcatcagccaacacctggtcactgggcctaaccactcctctctttttcccactgccttagttgagctgccagtatctcccttcccaccagcccctaatgcataagtggattttttcaaccctatgccagtcctgcttaaaacacgtgaatggctccttctcatcactgaatactggatggctcctctcagcctggctatggtagactgagatatataatggcctccaaggatatccaggtcctagttcctagaacctgtgaatattactatatatggtaaaaggaactgtgcagatgtgattaggattttcaaacagaaaaattatcctggattatccaggtgggccctaaatgcaatcacaagtgtctttataagaggtagacaaagggagcta

SEQ ID NO: 158179 - DNA, 290 bp, Homo sapiens
caggctctggggtggggggtctgtgagtcagccacggctctgcccacgtctccccacgaagcttcgagccacgcagagcagcacgttttgcagtacgccatcttttccaaaagccaccacctctcggcagcatcattaacccaaggcaggctgtggcctcagaagccccggctgtcctccacctggaactggacacagctgtccctgctgagcttcagcagccagggagccacaagtggagaggcacctgcgtgagccccccaggaaggctactggtgacacccagacag

SEQ ID NO: 158180 - DNA, 373 bp, Homo sapiens
aggtaatctgcccacctcgtcctccccaagtgctgcgattacaggtgtgagccactgcgcctggccaagtttccttactcttacctgaacagtatctcatttcctcattatctgaaaaattttgctttaaatctgggtccaaacaatcttcatgtgctaactttggttgttatgcctcttttaatcaaaactggcctctgcttactatttttatttcccatttcatgaattctttgtggaaagttatttcttttaaaacagcatactcatgaggttgaaggggtaaagaacattgatcttgtggttgcagtgtggatgaaaattcagcctgaaatatgcctgtttgcagcagccagtggaggagggttattaa

SEQ ID NO: 158181 - DNA, 234 bp, Homo sapiens
cacaccaggcgagcccaagccctactaacaatcagcaggtagggacatcagcaagagatccctcagcccagaagcactctccttccccatcaggcggacctgagacacccctcccacaaactagacacaccctgcaccaagggaatccagcaagtgggaccaccatcaccagcacctggcctaggaggcactctccttccccactggtcacgggactcctctccccactgaggg

SEQ ID NO: 158182 - DNA, 562 bp, Homo sapiens
catccctggggggcaggaggtgggtctgagcagaaaaccacaagcctgtgggaggagggaagtgttctcccactacaccagagtgggctgaggcctgggagcacctgccaggagcctcctgatgggatggatgctcttttcctcatccccttctacttgctggagagaacagtagcttcagaggcagaacatggtttgatgggggaagggagggatgggtgaccagcgggaggaaagaagctgaatttagggagggaagctggtctgtaaagcatagcctcagagccggcaaagcagaaatactgctgactctcctggctgttcacggaccggaggggagaaagttaagagtttgcacttactccacttgcaaaagcattcaactacagaggcggagggacggaggcctgggttcaaatcctgccctgccaactctccacatcgttgcagtgctttatgctgcgattttaggccaactgtttacaaaagcaatgaatgaatgtctacaggcagcgctcaaggagtaattttagttttgtgtgtgtgtgtgtgtgtgtgtgtg

SEQ ID NO: 158183 - DNA, 283 bp, Homo sapiens
caccgtgcccggccccaaagtcactttcctacaaggcccagatcctgattagggtgcacctgaggagagggggagggggcagttctgcctgggagataagaaaacttttgggaggagatgacactggacttggggcttaaggagaggagtgagggtaggctgtgggggatgctagggaaaggcccccagtagagggaagagtgtcagtgacagcccagagacacggaggaaggatgcctgaggaatacaaagggtacacatagacagcgcttgcgtgtgcctg

SEQ ID NO: 158184 - DNA, 118 bp, Homo sapiens
acacagagagaaggggtggggggtgcttgccccccaggaaagtggagagaaaagagagggtagagacacggagagaaggggtgacatgagcagccctgggctgcaatgtgggtgagca

SEQ ID NO: 158185 - DNA, 470 bp, Homo sapiens
cacccactccccacctctccctgctgtccccaacaacggaggttcatttgactctgtgagtatgccatttcctttgggacctttggcttctaacccttgtctaaactctgtagccctggaaccctctctcctgtttgagtgtagactcagcttctattcctcatatgttatagtttgggttgcctaagcctctgagttttgtcacaacttgccgattggttttgcaagagggttaaaatagcttttttctgtttcatagtaaaactggaattctccatcatattttaagtctttgtattttaaatatggaagagtccaaattttgggaagtgtcatgttgcaacgtgtgtgatatttggtattctctattggcatttttttggcatttcaagggtttttttaaatacataattgtatatgggttattctttataacttagattatcaaataaaatgttttgatatgaaga

SEQ ID NO: 158186 - DNA, 310 bp, Homo sapiens
aatttaggctcaagcaggctgacatgtcttactcagattaccagagccaactgacccactgaaatcctgaaacagaccctcctacctaagccctggccctgggcttagcagagacagctcagctccatggtgaccaataggtaaagctgtgtctaggcgctcagggtctgaaagacctgtcaagttagaaggtcatcacttacagatgtggggatggcacttcagagagtgggggactgaccagggccacagtgggaagcacccagcccttgcagtcatgcactaacaaggagacactggagaggaaaag

SEQ ID NO: 158187 - DNA, 209 bp, Homo sapiens
aatatcagtaagtattggtggtgttcctgtatacaaccctgaaaatggaccataagtaatagaatatttaattgtatcatcatttattaggcacgtgagtccttctaaatattgaagtcagtctccctattcccaaataaatgttccaagggtcactctttcattcacagatttgtgcatttatccacttaccctaagtttactgagca

SEQ ID NO: 158188 - DNA, 545 bp, Homo sapiens
gcccgttgtctaaataacagtcagtcttcataaaccaagctcagactacgttttaaaccagtaggactatttgccaaattgtatcttttaaatatatcttaatatttacttcacatattcaaaagagaatttgtatcaaacccattaattaaaataaattgtgaatgtaatttggccggcttgccacatttataggattaccattctattaaacaagttcttctcaggatcaattagctccagcaaaaagaaaagatacttataatttatatgatggagactaagccaatacaaaaataaattataaaagcactactggggaggctgaggcaggagaatcgcttgaacccgggaggtggaagttgcagtgagccaagattgcaccattgcactccagcctgtgcaataagagcgaaactccgtctcaaaaaaataagataagagttggggctgggcatggtggcgcaagcctgtggtcctagctactctggaggctaagtcgagcggatcccttgtccaggagtttgagactagattgggaaaca

SEQ ID NO: 158189 - DNA, 357 bp, Homo sapiens
ttttttacttcatgatctaggaccctgctattcaaaatgtagttcccaggcagttaacagcattaaggcaaattctcagcccccaacctacatctactactttagaatctcaattttaagaagatcccagggtattcctatgaattttaatgtttagaagtcactgctctggaacttgatcagtttttgtaaagcttatagattacaacagtgtttttattttaaaagcttatctgtttatgaggtaaaattttctctctaataatgtattttggcaagttgtcgtgttgaacctctatgtgctttttattttgagaaatctgaaggagatgttaaattttccagtatgattctaca

SEQ ID NO: 158190 - DNA, 379 bp, Homo sapiens
cacccggggctcctccatccactatctgggactcctccatcatccctcacccggggctcctccatcatccctcacccggggctcctccatccctcatccagggatcctccgtcatccctctcctgggatttctccgtccctcacctggggctcctccgtccctcatctgaggctcctccgtccctcacccagggctcttccatcatccctcacccagggctcttccatcatccctcaaccagggctcctctgtcatccctcacccagggctcctccgtcatccctcacccagggctcttccatcatccctcacccagggctcccggagggttaagggctcccggagggttaagggctcccggaggttaagggctcccgg

SEQ ID NO: 158191 - DNA, 232 bp, Homo sapiens
cctcagcctcccaagtagctgggactacacgcttgcaccaccatgcccaccttatatttacttaaaaaaaacaaacaaaaacaaaaaacaaaacctactatattctgaaataattttagatttacggaatggttgcaaaaacagtacgggaagttcccttcattcatcctgccctgatgttgacatcttataaccatagtcattcatcaaaacttccttattactggtgaaa

SEQ ID NO: 158192 - DNA, 214 bp, Homo sapiens
aaattttcaacattgctgtgttaatgtctcctgagataattagatgtgaataatttttataaacagaatttcctgggtggaatttctcatcttcaggagctccataaataaccgtgtcccaagagaactgtgaatttgggaactgcaggaactgagtcccaactcgtccagcctggaagtttttgggtgatcattcttgcaggtgacttcactg

SEQ ID NO: 158193 - DNA, 457 bp, Homo sapiens
ggttgtacaaagtgatcataaagaatggagaatagggaaaaaataagaaaaaaaaaagtgccagtttgtgtatgtcatagacatcatactaaagcccaattcagtaaaagctgttggtggatggaaactagaatgactatggcttttgagttccacctctgcttttcaagtcaacagcccctctttggtttcctcatttgtaaatcacagataatggtcaattttacctctcccaactggtttgtagaaaatgaaatgacataaactttcagagatgttactaggcttcaaatttaatttgcttgaagtaaatgttgataaaatacatgcagccatccctagataaaattacataataaagctggttatcttgttcccaggagaacactgtcattttcgcatcacccactggtaccgcagatacattcctaatttaggacaaaacagacttagttta

SEQ ID NO: 158194 - DNA, 410 bp, Homo sapiens
aattctccaccaggaaggagcagtgatttttgaataataatggcatctatttacatgtatcaaattttatttctttgctttccgggattacctgggagcatctggtgactgtgttcccagtgacttgaagtagcttgagggaataaagctagttgtaggcagagaaacgagagacaagaaaatgtcctggcagctttaatttgtttctcttctccctgaggctgtcctggttcctgaaattttcctttgtgtctgtaagctaataggagagtgtcatgatcagatgtgcattttagcaagattacttcagatgcaatatggagaatggggagaatgcattcgagtaaaagcaggaagaacagttagtgccttgtgtagaaagaatttttagtaatctgtttcagatatag

SEQ ID NO: 158195 - DNA, 311 bp, Homo sapiens
tcaccaccgcatgaatcacttccccctctggacttcagtttccccatttttaacatgagggcgttggactagactgtctctaggattccttccagcctatgctctgtgttgttttgatgtagtggcagatcccagattgatttacataaatttgcatgttcaatcagaaatcccaaactccaagtatagaaaatccaatcagtccattaatgcagccagactggggctcggggaacctgccaggttcgggtgagggttgtcgaaggagacagtgagagcggtggtgaactgggggagggggctgagaagca

SEQ ID NO: 158196 - DNA, 188 bp, Homo sapiens
ctccttcaggtatgagcatctttctctccacttcacctgtcccattgatgctcaatgttcctcactcacatttcacttctctgctcctagagagcagggttggcacgactgagggtcatgtccccaaagaccttgctcatacaatttaaataaacaaataaggctgggcaaagaggctcacacctgta

SEQ ID NO: 158197 - DNA, 417 bp, Homo sapiens
cagggtggacaaaagggaagcacaacaaaggatcaggagtaatggggggaatggtgctttaagatcttcactcagctggggctgcagagaaggggcagggaggacccagaaggagtgctttctaagaggtccagagaacaaggcctcctccagccttggctgatagctatatcccattacaatgcgcttcatctgtcagccatgacatattatattcacaatagtgaggctgtcatttccaatatgtcctttgctgagaactgagcacttactccatccagacagagatggataaggcaagccgcaagacaggcgaagcacacatcacagcctctgcctcccatcctagtggtctggggagatgatatcttatcgggctccctgactcaggtctttattaacctatgcaccacatct

SEQ ID NO: 158198 - DNA, 410 bp, Homo sapiens
ccttcagcacaagttaccagttttgacaacactcccggaattttggctttgcttcaattctggaatacacacctatgatagttgcctaagtgtaacacttcacatagttatatggctttaatgtaatcatcaataaacaatacaagatcaagaaagattagaatttattttctgttaagtcaggatttccggaaaccatagagtcagattggcagctctccacttctggttcccaacttccctgctcccatctttcccaattatttataattcagggcaaataagagtagaagaaaccatatccatctttctcttcttactttgtacctttgaagatcaggaaagatagaatttctaagtttgaaaacaggctaaattagaatcattctgtctatatttttaaaagacga

SEQ ID NO: 158199 - DNA, 385 bp, Homo sapiens
agaaatatgggactcattggaattttacctgttggcatttccacaccactctgtgaccaaagcctgccttcagggcaaagtagagaaaggaaatggaacaatattaaaacagaaactcacccctgtgtgttttgcttcagcaagtttttgaccctataacctattataaagtgaaatgaaaatgtggacacctgtgaagcggtccgagtgcaaaatttgtctagactttcaatttttttccccagtcttttagagttgtctcctacctaattcaacaacaattttagtggcttgcctttttgagtttttccagtgatttcagctgatcttctcagaattgctttcttcatctattttgcaagttaattgaattacctaatagcta

SEQ ID NO: 158200 - DNA, 507 bp, Homo sapiens
acccctgaggagacaggaggttcctatcatcatgggagatacaaagatgaattaaagtttcagccgctcaaagggctgccagtctggaactgggagccacggcgcccggaacagagtctatccctacacagaggacccagcaagcctcaagggaggggcaccatctgggttcccagtacacaattggctcgttgaatcacaaagttcacaagaaatagtggccacacaatctgaattttaaaagacaagtccaagttgcaaacattttctcctattgttataatagagtatgaagtgccccaaagaatccattattgtggcacctaaatgacctctcacagccaggtggatcacaaaaatctatgttataccacacgtcctaagcttgacttggggaaagaggatccccattatgctagacacacagatgccggctgcccccagcctcagcctcatgggtgtatgcaggtccacacagactaataccagacaagacaaagggtcacc

SEQ ID NO: 158201 - DNA, 321 bp, Homo sapiens
tgaaaggggaacctttggggtacgagtaagcattcctggaggcacctcatctggcctgcgtgctctagtgaggtcccgcgcacatgttttctggacctgaagttgtgacttgcctacaggtggggtttttctcttcacccccgtctccctctttctctataacccttgtgcatttctcttctactccttttctgccaggctcctttgggcctctggcccactcccctggcagatcttatcacacgcccctgtcgtttgcctgtggacttcctttctactttttcttgtctccctcaagcaccctccttcccttacttattc

SEQ ID NO: 158202 - DNA, 234 bp, Homo sapiens
caggtatgatcaggaagacgagctagtacccgttggagtttgtcacattgaccccgtctccctctttctctataacccttgtgcatttctcttctactccttttctgccaggctcctttgggcctctggcccactcccctggcagatcttatcacacgcccctgtcgtttgcctgtggacttcctttctactttttcttgtctccctcaagcaccctccttcccttacttattc

SEQ ID NO: 158203 - DNA, 402 bp, Homo sapiens
tgggccttggccctggcagtgactccctgcagccaggtcttcctggggagcccctccttccagcctgctgactgaatcgtctcttgatagagcaatgcaactagtgttaagagtcttggctgggcgcagttggctcacgcctgtaatcccagcactctgggaggccgaggcaggtggatcacttgaggtcaggagtttgagaccagcctggtcaacatggcgaaaccccatctctactaaaaatacaaaaattagccgggtgtggtggcgggtgcctgtaattccagctactcgggaagctgagtcaggagaatcgcttaaactgccaggaggcggaggttgcagtgagccgagatcgcgccactgtactccagcctgggccacagagtgagactctgtctc

SEQ ID NO: 158204 - DNA, 921 bp, Homo sapiens
tgctgggattacaggcttgaaccacctctcctggcccgaagaatgacttttaaccccaggaaacatagaaaattcatactctttccactttatcaagaaggagcatggacttggaataaaataggagttttcactacttactactagttgatgagcttgggcaagatactaaatacttctggtatataggtagtatacttatttataaaaagaggccattacctcagcaggtgttgaaaggattatatgataacttcaaggggaagagcaataatgcacaactttcttccccttcaagatgggattttcttctttcagataaggagaaacatttcctcctgctatctgtcctaaagccaagaaaggaccttaacacttctgattgatttatttatagattgacatgctctgtctccctgttgcttatctcaaaaggaagacatactccaaacttgatgaaaagaatgccttattggtcttttcagggttttgaggaattgggactgtgtaaatctggctcaattacatgcttccaccttttccaagttattttcaaatgatgggcaaagaggtgggggaatgccatagattgaaagtttggtgagaagctgctattttctttctttctttctttttcaagatggagtttcactcttattgcccaggctggagtgcaatggcgcaatctctgctcactgcaacctccacctcctgggttcaagcgattctcctgcctcagcctcccgggtagctaggattacaggcatctgccaccacgccaggctaatttttgtattttcagcagagacagcgtttcaccatgttgaccaggctagtctcaaactcctgacctggtgatccacccgcctcagcctcccaaagtgctgggattacaggcgtgagcaaccgcacctggccgag

SEQ ID NO: 158205 - DNA, 533 bp, Homo sapiens
ctgtgtttcacagggaagaaaggttggaaatagtattcccagaatagcatgaagatgtgccactaaaatgtcccttcaaacaattcatgatgaaattgtcctacattactcaaaatcgaagattctcttggggatgggggtggagagcaagagtttaagaactgtggtctcttgaatgctagataatctgtatttggccaggaaatctgaaatcacttcagtatggtaattgttctccaactttgaaagtgataaagtagaacactgaaaatgaaaccaaagcatgagggcaagagcaaaagctacagagaacgacgattcatgacagaaagagcctcttggggtataagggcaaatgagatgcctaggttgagagaagaggttgtagttttagtaagcaaaatgtgtgaggctcagagccaaacatcactgagtttgtcttaaagtctttgactattcctgaatctagacaggcagtctgtatttgtcgattatttacctttataaacaaaaggatacatcacacatcatcc

SEQ ID NO: 158206 - DNA, 214 bp, Homo sapiens
aaaagcatgttatttcaaaattacaatgccagactgtacgttattacccccaagaggaacactgtatatgctactattttatcacccaaattgctcatcgtgacataggtaaggaaagcaaagcatcattagataattgtgaaaattatagaaggaattcctgacagacaacttttttttttttttttttggggcccgggaaactccaccctaa

SEQ ID NO: 158207 - DNA, 265 bp, Homo sapiens
ttagcttatagaatactattaagcgtcttaactagacagttaaatggacttgaaagatcgtgtatttggtttccatagaaatttaagggtaaattttataacaacatatattttgtaacagtggtttggattattctgtcaaggtatcctaaagagagaaatagctgtgtctggcattacgtttggctgaaatgatacttaataccagtctgtctattagatactacgtgatgtcatgcttgcatgtgactgagagatgttgtac

SEQ ID NO: 158208 - DNA, 401 bp, Homo sapiens
cgtcgcgcttcatagcgcaatgggccaagtttcccctaacaacattctattatttcataagtaagatttaatcccctcttatctattacctacttttgctaaccttgctgcgtctcagttttctcatctaaaaaaaaaagttggacttgatctctaaggtctctttctgctcttaaaattctgtggatttgtatgtccttttgccatctgaagaaaggagtagatctataggattctacccaatttaagcactacatatgagaaatacaatttttttattgatgattttatttcatggtctttctttgttcgtttctgtgatctcaaacttttatagatggttaaagtaaaaagagaactttaatgatcactttgcctttggtcatttgtccttcaatttc

SEQ ID NO: 158209 - DNA, 531 bp, Homo sapiens
cgggtcaggattatgggatctagagtcaagtcaagactgcctgttagaaaccacgtggccttgagcaggtctctgctaccctctaggcctcctaggcttggcatctatagggcgagtggtcctactcgatgtgaccagcaagcgcccctggagcgcctcctgttacacggcagtgcacaaagcagaccagtgcctgccctcacagagctcacagtctagcaagataggcagaaaacacaccagaaaagtaggtacttgtggagaagaacagagcgaggtccagagcatggggacgccagggggacgaggctgacacttagggcccagcagtctgggatgttcttgatcagagacttacaggaaatggcagcaagctgtgtggctcctgggcagtgtttctgtcgggcagagtctgtgtttgggagaaaagtaagcagggaattgggtcccggagcaggtcagagggggagctcatgaggtgccagtgtgcaggattcgctgtgaatgaagccttggagacagcagttccct

SEQ ID NO: 158210 - DNA, 547 bp, Homo sapiens
aatgtctcataagtcttgggagataagagattcaggtatcccaagtaaggattctaacttcgaaaatgaatatgtcattgagttttacacgattcaagattcaaacgtgggcaacagaaatctctgttcttggaaacagatttatttcaggatgtgaaagcccagctgtgggtttcagagtttgcacacctgcatttcctcacccttcatctgtggccatgctcgtagatgcttttcttaggaaaatttgattaattgaactttttttgttctaaatgcaatctgaaatgagtagagactaacgctggctgtgcgtgcgtgtgtgagtgcatggtagtgaggggttggggagccttccagctgattttgtttcccttaagtactaatgaagaatttacttgaattgttctaacctgtacatgtattttctttgacctatcatttggacaatgttctgtggttaacatcttaaattttttttttttttttttgagacagggtctcactctgttgtccaggctgagtgcagtggcttagttagagccca

SEQ ID NO: 158211 - DNA, 126 bp, Homo sapiens
cagttaaccacagtccaaaaataataaatggaaaattccaggaataatgaatgaattttaaattgccatcgttctgagtagcgtggtgaaatctcatgccatcccagtccctcctaccaggtcatg

SEQ ID NO: 158212 - DNA, 328 bp, Homo sapiens
gtagggtatgaggtccacctcaccctcttcccccatcaccaggactattctcattaactcaggcttctgcctagcagggcctgcatcacctaaaaatatccctcctgggagaccaaccctggaccacactccagtctgtgacttcttagaatgctctgagtcaggaatgtcttcacagaacccacaaatgaaaaggggctgatggggtagaagagacaggatgagacaaagaaccccctagcatttctaagaatggcagccgtggcataacaaggcaccagaaattctagagggaggaaatcccatacctgatacattaagaggagtc

SEQ ID NO: 158213 - DNA, 425 bp, Homo sapiens
aagagacaaaggggaagagagacagagacacacacacagaggaaaaaagcagagaccaaaatggggagacagagaccagagagggagacagaaaagagagagggagacagagatgagggagaaacagggaggaaaacagcagagagagaagtgggcagagacacagagtgacagagaaaagagagacagagacagagacaatcacaggcaaccaaatcatcagggaaagaaataaacagaggcagagatggagagagacacacagagaggaaaaaacagagaccaaaatggagagagagacagagacaaagacaaaagagagagaggtgaggagacaaagatgagagacgcagagataaaagagacagagacaagagacagaaacaagagggagacagagataagagatggagatgagacagcca

SEQ ID NO: 158214 - DNA, 144 bp, Homo sapiens
tagaaggagcttagagttgattcagctcaaccctctcccttttatagatgaggaaactgaggtgcaaaggaggaaggtgaatggcccagtgtcaattaccgaaagccagcagcagcattccagtcaattctagctgctgatcta

SEQ ID NO: 158215 - DNA, 593 bp, Homo sapiens
ttgaatgcaaaaatgtctactgtatatgggaaaggatcgagtcctcctccaggtatggaaccaaatgtgataaagatgaactcacttactgactgggatgtacacatattaaattcataggaaggtggagggggagcaacagaggccctttcacacgtgggcacctgcttttgcgtagctaacatatccagtcctctcagaagccctcaaaggtgaagttcttggagctaggacatggagaaccctagccactgggctcgttggtttcttccttgctcccgctggcaggatgctaaaggtgctcttcaatcccaaagttgtatttgctatcagttacccaagacttaggtgagtgtgatagagacaaacaggctagcagatgacagcactgtaggtgggttgcagctatatccacaccaaaacaacctccactcagggaccagacattcccagatgactgcttgtcacctttcctgtgcacctgtttttcctactgggtttgaatctcagggagaggcatgtgccccaaatctgagtgtccaccttctccttctctcctggccttatacccaccaagctatagagtcctgtct

SEQ ID NO: 158216 - DNA, 415 bp, Homo sapiens
tgtgtcaagtcatgtggaggaaagttttgatagagttgacctgcctagaagaaaagactatggaagttcttttcaagattgcatttaaggtgaatcaagaaaagtgagaagatacaaggttttgcttgttttcgtaggatgttgtccttggtggaggaccagtttacacagagacttccgggctggcaatggtttgatgtgttcagaaaggtgaagaatgtccacataattggaatgatactttaacttttcttctttggaaaagttgaaattctctttaagggcatgaagtttatttacctttcaagggcctcgtctcttcttgatttgaaaaagcaggtacaaggctacattgtggttcaagttttccacttgccattactactaaactctaaggggagtgatcttcaaattg

SEQ ID NO: 158217 - DNA, 595 bp, Homo sapiens
ttatataatccattatttaagcctacagaataaatgagtgattattaaatttctagtgttgcaacacgaggccaaattcaatgttaagtttagaacaaaaacaaaattgaaaagaaactttagatcatactctattatgtttaaaccaagacagatggtgtatatttatgagtatgcaaacaattcccaggacttccaagtcagaggcagccctaaaaccatatatcattgatttcaagacacattttttcatatgttttgaaatcttcaaatgaatcacattttgcaatataattacctgtgtttctttttacgtagtacataaaacaatggtatgacttgcaagcggtcatcttagattcattgaaataagaccatgttactattagctaacacatattgaacacattatgtaccagacagtgcatgtggattatttcatttactacccacaacaacactgaagtgattccagttatttccccatttttacgttatgttattattttaagatggtctcaccctgtcacccaggctagagtgcagtggcacaatcacagctcattgtagcctcaacctcttgagctcaaacaat

SEQ ID NO: 158218 - DNA, 424 bp, Homo sapiens
  misc_feature (412)..(412): n is a, c, g, or t
aagatatggaggtagaaggcaatgatactgataatccagaccctgtgtaagcctaagctaatgtgtttatcttagcttttaacaaaaacagttccaaaagaaaaaaaaaattggccaggtgcaatggttcacacctgtaatcccagcactataggaggctgaggcaggaggatcactaaagaccaggagttcaaggctccactgagctatgatcacaccactgcattccagcctgggcaacagagtatgaacctgtctctaaaaaatgaaattaaaaatagcaaaaacctgtgccgggcacggtggctcaggctgtaatcccacactttgggaagctgaagcaggctaatcacctgaggtcaggagttcgaggccagcatggccaatatggtgaaacccccgtctctactanaaatacaaaaat

SEQ ID NO: 158219 - DNA, 393 bp, Homo sapiens
cctcccccagaaaagacctgtttgatccgactacaaactataagacattaagttactcttctctttatttctatgatatcttggtcataattctatcactgttcctcctattgctttctaatcagcaggtaattacattatgcaaatcatgcacaagtataagttacttgagatcaggacctatgttgttttatcatgttaaactctcactaagtcattttacaaaataacttgttattagctgaatacagtgcctgaccagtgaatgatcagtgatgagttcatctggggccaaaaataagtccttccacccaaatgctccaaataatgacactgaccagctttgtgtttacttctcacccacttcctgtaagtatatcaacctcatcgaac

SEQ ID NO: 158220 - DNA, 140 bp, Homo sapiens
gagccaccatgcccagccggtttgatttctttaagtagttgtatttctatttattattcttataggaaaatacagccttagatttgaaaaaaatgtctgtggcttctctggtaaatctaattctgacggttaaagtattt

SEQ ID NO: 158221 - DNA, 315 bp, Homo sapiens
cataaaatgaaagaaccttcccagaaagcaatttggcagtacgtatcaagagccttcataaagcttgtacccctttggtagaataagtccattttcagcaatttctcataagaaaatagaaatgtacacagaaattttaagttcaaatttttatttttatttatttatttatttttgagacacagtttcacacttgtcacccaggctggatgtgcaattcagtggcattaattacattcataatgtggaaccatcaccattatctatttccaaaaccctttcattactccaaacagaaactctgcacccattaag

SEQ ID NO: 158222 - DNA, 1368 bp, Homo sapiens
tagatattcaacacatggacaagtgtttaattattctttgtatattcctgttgtttgtaaaacagcttataatttttaaaactattttaaagggaatgaaagtaggaattacagggaggcagttatcaattagatataaggatgaattctctagtagagttagatgtaataaagatattgccacactctatccatatgtttatacatcaaatttttactgagtacatacatcatgagacaaaataaacttcctgtcacaaaaggtgcttgaccaaaactcaagaatcacctttcagggatactgttaaaagtgttcccacatcagctaggagttagctctagagggcttttaagatctttggccatcccgaaattctatgcttgaaacacgttttctcatagaaacgctcctaccaaaggccagtgagagaactatcactttgtgaagaatttcagaatgcccactagctctcctgtagccctaaaaggtaatgagagtctacctgttcagactgagagctccggctgccttgtgctacagaagcagtaagtgcatgtaaaggacgccatatttctaagacaaaagcagtaacaatgactcaaggatgatgcccaatagacgatttaacctataactttgctaattgtcatattttcaaaacagccctatgggaagggtacacaaatgtctggggagtatttcctgctttttagcacccagggaactacaaccaggagcccagcttattttggattggggatggggatagacaagaagagatggggcagggagaagagacggctggtttattttacatacacatattttatttataatacatctctgtgtctaggcgtctctatgctgttctcataaaatctgaattatacaaataaaagtttaattcctggctgttttggatgacttgggcctgtattacaaaattaatcagatacaattatactatcttcacaacaacaatcatctacattggttttgacaatgtacaaagtacttccatgtgtattatttcgtttatctttaccacaacctttgaagtaggaagacatgatgatccccattttactgcctaggacagagagacatcaggaggttaactgacttgttcactgagaaagcggaggagcacagactataactccaacagtttgaccccatactgcatacgcatcagggccttaatcatgagactgtatgacccttctgagcctgggattcacttgcaactgggtattccctcttctacctcaggccccctataccttttcaaaaagtgtccttcactgtaaataatcttcctggtggtgaccctaaaggatctgacaacctggatctatgtaaaaaaa

SEQ ID NO: 158223 - DNA, 227 bp, Homo sapiens
gtttccccatgttggtcaggctggtctcgagctcctcacctcaagtgattcacccgcctcggtctccaaagcgctgggatttacaggtgtgagccagcgtgcccggtctgccatatgcagtttactggagagacgaactgctcactggaagatgattaacatctcagagtttttaagcagatacttgcaacatttgagctcaccatagtatcgacaagaggcggcta

SEQ ID NO: 158224 - DNA, 137 bp, Homo sapiens
ctgtctcttcaggagtcaaattcaagtcatgacccctcaacatgcctatcggtcaccaaatcctgcagattctgccattttcaggatctctgtgtgacatttgtcccttctcctccattgctaccgccttagttcca

SEQ ID NO: 158225 - DNA, 543 bp, Homo sapiens
gctttacaatggcttggtgaggtcaagaattagagcctggcatggtggctcacgctggtaatgccagcactttgggaggcagaagcaggtggatcacttgagttccggagtccgagaccagcctggccaacatggtgaaactcagtctctactaaaaatacaaaaattagccaggcatggtggcgcacgcctgtaatcccagctactcgggaggctgaggcgggagaattgctggaacccaggaggcggagattgcagtgagccgagatcgtgccactgcactccagcctgggtgacagagcaagactccatctcaaaaaagaaaaaacaaacaaacaaacaaaaacgaattagagttggtcccacccatcttcctttcatgaattttcatgcaaactggagcgctatcctcttccctttctcctacatggccttgattcagcaggcagacaaatctcctgccattgtcccaagggggacattcccttaacgcaaatcccaggaagaactttgaagtaaaatacgattgttcttttccttttc

SEQ ID NO: 158226 - DNA, 255 bp, Homo sapiens
tgtccttggaatccctgcccttatctgacagccagggcccctctgactgggcactgatgctctctgcccagaggaagatggtgttcctcgggggccatgagacccctctgcaacatcacagctttgctcttgtttctctttcctactaaggcttccacattgtcaaaaccatgtatggggggagcagattttgcagccgaggggaaaattaccataaaacctagtctccgtaggtggtaagggatcaaggagcat

SEQ ID NO: 158227 - DNA, 604 bp, Homo sapiens
ggttgttccctttgtctgctaactgtagacgagaaagcagaaacagggatatgaaatgtcagatgagtgttggaatttcagccggggtgaggcggggacagggctgtcctgcttgagaacagctggagagtccagacccagaggacacgtcagtgtcgggaagagccgtcccagaggtgacttctgtgtgggttaatttactgagaaaatagtttccaacagtttgtctcttgggtggacctgtttggatgagtgcccacaatcccagccacacccacgtcctctgtgcagcgctgtggggagtagtcattgtcaggcttgcaggaagatctgctgctgactcttcccaggcgtgtgcacatgtgtgcacgtgtgtgtgtgcacagtggtgcgtgttccaaataaggaagaaagataaaaggagtatggaaacttcctaggctggacaaacactgctcttaaacacgtaccttcacagtcaggtcagcagtgatgccaaggcggagacagggtttcccctctgttttgtgaatacactgtgaccagtccctggggggcctggtgtattcaggctctgactcagcacggttttctttacaaagga

SEQ ID NO: 158228 - DNA, 139 bp, Homo sapiens
cagggtctgcccaggtgccctctgtgggcttgttagcctgcaggagctggtttctgctggctgatgttaagtcaaagaggtctcctggctctaactcagacacttcctcatacagtcttcttagtgggcttcctgctga

SEQ ID NO: 158229 - DNA, 578 bp, Homo sapiens
agtgatgctggctggctgtcctaacactgagttctgaccctcttgttctgctttggaacctcctttctcttctccatgccagtgttggagccacctctatcccatgcacagacacatctcctgtgtccctggctttgagggccccagcttgagtagaaactaaagtacctcgtgcggggtcagaatgtgtatgaagaagaggtttaaggctacaaatttggtaaagagcgtttcacatatgacagaaaatacctaccatctgcattcaagaaaggagtggttaggctgggcatggtggctcatgcctgtagtcccagtgctttgggaggccgaggcaagaggaccacttgaggccaaggcaagaggaccacttgaggccaaaagtgtgagaccagcctgggcaacatagtgagatccagtctctacaaaaaataaaaagaaataggccagacgtttgtggctcacactttgggagaccaaggtgggaggattgcttgagactgggagtttgagaccagcctgggcaatagagcaagaccccagctctacagatttttttttaaaattagccaggcatg

SEQ ID NO: 158230 - DNA, 432 bp, Homo sapiens
agcatcctccgagcacaatggccgtgcaggcttccccggcacaaagccggcgcgctgcccactcggctgcctccgagaccccccttggagcgcctgcatttttttttcctctaatccatgattttatttttttttttggctttacctggaggctggctgggctgggctcccccggctctgccccgcttcacatcgtggctgttgcatgggatccgagcggagcccgagcgccagcggctcgcggcgtgcgcgcgccggccgggctgccgggcgggcggcgcgaggacactcactgcggctcgcgctcccctagctcccgctcgcgcgcccccccagccggtgacgtcatcccttccgccagcgccgccgccgccgccgccgggtcgggggcagggccggcccgtgcgcgtcactgcgcagccgcgcggccgc

SEQ ID NO: 158231 - DNA, 354 bp, Homo sapiens
gttgatggccactgagcacagagcctgctggagaccagctagcagcttagctgcctctactgtattcagaacccagggttggctggggtacagggatggttgtgagacactcacaaatctgattatttgacccataccagatgggagcaactgagcagtgccccacaatgggaattctcgaagggcacaccagagggggcctaatctcaaacagcactgtctctggctccgggctcctaaagagagacatgttcttctactcttagtcagatgcatctgtgggctaagggacaatacaagctgtcaccaaagggctagccaaactcaactctctaggggcttgcatcttggtgg

SEQ ID NO: 158232 - DNA, 273 bp, Homo sapiens
cttctgtaaactggactataaatcaaatgagtgtctgcatggaaaaaataaaacaccctaaacaaatccaaagataaatgactaattgggaaaggatatttgtaagttacatctctgacagagtattatcactgatataaaaggaacccctaaaaattaaaatacaaatatcaaaattttataaatggcacacaaaaaacccagagttcccagaagaaaaatttaaatggttcttcaaatatgaagcttttctcagtataacttaaaatgcaa

SEQ ID NO: 158233 - DNA, 252 bp, Homo sapiens
agggccacttcagagtacacttccagattatttcagattagttattttaatgaaaaattctagcagggggtggctggagctgttcccttctgcctaaaaactagaccacaaagtaagtgaaggtaccctcgtctcttacaggtggtgtgggcggtggggtaggatgattttaaagactgtaagaggaggattttattggagggaaagtccaaattctatattggggcagtagagctgcaccatgtcagacac

SEQ ID NO: 158234 - DNA, 223 bp, Homo sapiens
gcggcgcctactactactaaattcgcggccgcgtcgacctccagcccagaaagcacctgctttaacagccttccaaggagctccaggacccttaggaaaaatctacactaagggccattctctagggtctggccctgccaacccttctagcttcatctttagcacacctcccacacaccacgccgatttccagccatgcctaaatgctggcagtcatctctga

SEQ ID NO: 158235 - DNA, 486 bp, Homo sapiens
aaatattgactcaaatttgtaaaaagctctatgtagccccaactaaacatgtctgtgggctagattagccctttggctagctggccaccagttgaccatttctgtagacaagattctcagaaaggcaaccacagcctcaacttttacaggattattttctacctaaagaggcatgtgcataaatggcaggatgcccagcacacctcattttactgtgtttcactttattgtacttcacaaatattgcattttttaacaaatggaaggtttctggcaaccctgtgtcaagcaaatctatcagtgccatttgtccaacagcatgcactcacttcctgtctctggatcacattttggtaatttttgcgacatttcacagtttctcattattattatatctgttatggtgatctgtgatcagtgatctttgatattactattctaattgttttggggagccacaaactgtgcccatataagatggaaaac

SEQ ID NO: 158236 - DNA, 150 bp, Homo sapiens
tgagtatttctgatggacttttctcttttaatcaacagaacagtcctgaggtaggcactattagacccactttacagatgaggaagaaaggctcagagaggttaactaatttgtccaaggtcacacagcaggagttaaaacccaggcttt

SEQ ID NO: 158237 - DNA, 226 bp, Homo sapiens
cgaactctgagttctctccagtgaagatacttatcgtccttgaaagaaatcaagacaagctagtctttcagggagctaccagggagttcggcgctctcacggtggctcagaatcaaagtctgagggaacgggggcctgcgaggttcctcctcaagggtggaggggcccccgactctcagggactgggtcccggggccggacccgcggccgaggcacccctgccgct

SEQ ID NO: 158238 - DNA, 247 bp, Homo sapiens
ggcattcacatttaaggataaaaaccatgtaaccttagaaatgtcaccatggatctgggcctgtgcctcactgttccttacgagagaaggcaggcgttaatgttaccctgtcagcctcagaagtttggggacataccctcccaaagactgtttgctcctctccccaacttccaccccaaattgatatcacacatcttatcagcagaatgtaatcatttgaagagatttcccagtttgcttatacagg

SEQ ID NO: 158239 - DNA, 172 bp, Homo sapiens
tccctcaaaatcagcatttccagaccaactcccaacatagcaagagaagacagctaggtgggcttgttcctcccttggatgaaacaataccaggggaacatgtccccctgtcaagtaagattaataaaagctctgccagcaaaggtaaccatggggggcaccccatccccta

SEQ ID NO: 158240 - DNA, 426 bp, Homo sapiens
caggatccttgactattttactccccactgtttgctcaagaatctcctctggggtgactttggaccatgctgtcccatggaacctggcctctccagcatcaccgtctctcactccatgctgggcacacctggtgctcttcccagcatctgtcctctacccttgcttgtggcgacactcctcctgctctcagggtccttccacagccctctcctgtgtctcggcttctttactgtggacacacctgggatcaaaccctggcctccgcccctctttcattgcattctctttccccaaagaattgacccatcttcaaggtttccattctaatggcttctttaattctggaatctttcacttccagtctccacaaacttccctctggaattctgatcctgggcttctaacctacaaacagattcaagctg

SEQ ID NO: 158241 - DNA, 574 bp, Homo sapiens
gcactagaaagtagaaagaatcactcaattcagggaaaccgttttctcttaatgtgaacatttacattaatgccatttccaaaacctttctgggacttcttaaatgcaaagatgctatctgctttacttcatgctgcctgtttttaggagcttggagtgctttaggaagcttcccaatactggtttagcagtaatttggttgactgatcaaggcatgttttaactttgacactgaaattttaaaaagacaacagttatcttgcccggagagtcaagtttctgcttccaaggaggtcaggaattgttctctttggtgatgtggctgtgcttggtagcccttaaactgcaacagctactcagctgcttaagctagcctacaagtacagaccagagacaaagcaagaggagaagcagaggctgttggcccgggccgagaagaaagctgctgacaaaggggacatcctgggtaagagtccacgtgtccttagagccgccacattaactctgtcgccaccttggtagagaaaaaaaaagttcagctggtggtgattgcgcatggggtagcccttaagct

SEQ ID NO: 158242 - DNA, 555 bp, Homo sapiens
tgaaatatgccaatcacaaaaagacagataccatatgatttcacttatatgaggttcctaagtcaaattcatagagacaaagtagaatggtggttgccaggggctagtgggggatgggagaatgggtagttatgcttaatgggaatagagtttcatgtttgccagataaaaagcgttctggaaatggatggtggtgctggttgtacaacattatgaatgtatttaataccactgaactgtacacttaaaaatggttaagatgacaaattttatgggggaaaaatgtgccaaagatggcaagaggtgcataagtggagggatggtggtatcattgccaagtacaggaaagatggaaaggataagtattatttgggtgaatttgaggtggtagctaaccctcctgtctgttacactgtattgatatttgtctttacacaaaatggtaccaaaattcggctagatatgcttgcttaattgtctctttttccttcttttaacagttgtgtttccttctgcagtccatagttttatgcttctaatctgctgtcacttatt

SEQ ID NO: 158243 - DNA, 396 bp, Homo sapiens
taaaaaatatgctgttgttgaagggttaaactttgccctccatttttcagaagtagcttgaggaaggttgattgagcacactgaaaagactgtagaacctttctgacccttatagtttggtggaaaataaaacaaaaagtaggcaagtattcagtgtgttaaatactcctgaaatatcattatttggacaaaattagaattttcaactaaaggtgcagaataacttcttggatcccaaaggtagttattgaattaaattaatgtttgggtctaattcatccaaacgtcgaacggtgagaaaatgagccaatgactgaaattttttgagggggtaatcctttttgtttcatttaatttaaaaaatctgtaagttcaaaagtttgatcaagtcatcct

SEQ ID NO: 158244 - DNA, 208 bp, Homo sapiens
aactaactacccacagcactgcctccctccagccttgctgggatcaaggggatgctcactcgggaggccgagtttcctctgcgcctcttgaagtattttggggctgtgctggaagagccccatctcaaccatgactgaacgcaagcaccctcctcagtaggtatgaatctcacaagatcccagcctgtaggggtgcacagctgagcag

SEQ ID NO: 158245 - DNA, 548 bp, Homo sapiens
acagagtaacctgacggctgctgaagccgggcgcagcggggggacagtaggcacttgtgacgtgtgtgatatgagagctgtcttggctttggttctgggataacccccatcctgcttgctgtggccgccctcctctttgctctgtttttagaaacttcgacaagcagagctcacagaggagtggaagccgcaagagcccctcctgcacctcccaactccctggtgtgtggccgcttccttctctctgcaaggtgcgctttgtgttacaggatctttggggtggtgtttttctggccagaaatctctgtggccggtggcgcctttgcccaagttttgctcaggctgggcctggcaggccacgtttggctcacactaccagcctgggtcccatgcctgccaagggcgagtcaggcatggagtggcgaggggtgtgtgaggagcacggggtctggccacaccagtcaggcacgctgggtgctgcagcagggtgggcagctccaggtgccagcatgggtgcgggctctctgtgaggctgcggccagaccaga

SEQ ID NO: 158246 - DNA, 421 bp, Homo sapiens
cggccaggcctgagcggggcccccgccaggatcggtctccgcaggcccgagcgcccatgaacttggccggagcagccttcacgaacgcgcgcgcgccgggccgtactctcttctggcattcgatttccgagcgccccacccgccccgcgcccccaagaacaaagctcgccgccgccccggcccgtggcctccccgcgcgcggtcaggtgtcgggcggtcggggcgccgctgtccccacgccccccatcgcgcgtccccgccccgcgagggcatctccgcttgccctccccctggcggccccggctccgggactcgggggtctgtcccctttgcagagtccgaccctcccggcgccccctctccggaaaggcgagacgcagagatgccgccggggcctccccgccccccttccaagccccaa

SEQ ID NO: 158247 - DNA, 585 bp, Homo sapiens
tttaagttctgggatacttgggctgaacatgcaggtttgtcacataggtatacatgtgccatggtggttggagcaatgtgatttttctaaaccctgaagctataaagaagatgcaataaacaacagcattttaaatgccaaatttgaatgaataaataaatgaccttcccacaagaaagcaggctcccttgatattttagcaaatagagttgtaactaacagattcccttattcatggaaaatgaagcttcattaatattgaacttctcagttatctacatgagtaacatagatttttgtgcaaaggaagatgcacttattagtatttacctctttgtatggtacccgtacctgataagttagcataaccataccctgagaatgaccccgtatggcagatacacctgaatgtgtgtttggagtgccaaactaaggaatctgggagtagccaacctggagattcattccttacctatgagaaacacctgaacacccagttcatcccatggaatacgggcctacaggagatcgaggctctcttgtttgggttaaatgaaggttgccaggtggaggtttctagggtga

SEQ ID NO: 158248 - DNA, 206 bp, Homo sapiens
taagactcggtacctggtatgacaccaagatacaacgttctaatcaagactatgccggaaagctcaggaactaggattatcatacccaacgcatttgatttgctagtcactgttgccccaaccacatcctgcgttttccctcctctctggccttgtccaggatatgtttctcctctatgctttcatcaggagaaattagatcaaga

SEQ ID NO: 158249 - DNA, 465 bp, Homo sapiens
aattatattgacaaggtgaaaatactctttcaataaaatgttataatctttaagtgtgtttttgatatgttagatttttttttccagaagtaacacatctctaaacaaagcccaagtcagtgggaaagtctgattcatgtcattaacattcactttatactctttacaacatcatatcatgtttaaattgaggtcagattcaagactagtctcaggtaaagttataaagtaagaaattggttctcttcttcattgttagtaatggtataaatatcttttacagaaggcagtttagctataggttttataacttaaataggttcataacttttgacttagcaatttcacatataagaattctaaaacaataatcagaaaggcataaaaattcattggaatgtgaggccattcaggatagagttctttatactagtgacaaaggaggaatataaatgcccacaacag

SEQ ID NO: 158250 - DNA, 309 bp, Homo sapiens
caagaggcccaagcttggcgtggaggagcccaccgactggagaccatttggggcctgcagatgccattggagggcaggagctgagcttggagaggccaccgtgaggcctgacctgggcctggggagcttggcttcgggaagttgtgggtctaccagggccgctgggagctgggcaggaactgggccaaaaaaggctgttgtgaggcagcagttgtgcctgtagacccagccaagaggaagaggtgggcctggagaagcccccataaggcagaggttgggcctgtagacgctgacaggaggcaggagctg

SEQ ID NO: 158251 - DNA, 251 bp, Homo sapiens
tatatgagactactggcatgtgacaccacgcctggctaatgtttgtatttgtttgtctgtctgtttttggtagagatggggtttcagcatgtttctcaggcttccagtgagttttatactttcttgtttttgtgttgctaattagcatccttttctttcaacatgaagcactctccttagcatttcatataaatttattaccgtcagacctgtctaagaaatataagacaggtctggtggtgataaactcc

SEQ ID NO: 158252 - DNA, 344 bp, Homo sapiens
tgtttgactcagcacattgaaagctatgttgggttttatttttgaaatgtctcaatatgtatgaggtgccgtcctagtctgtgtgataacgagtggttataacagtgtgaatagccgtcttctctcctacgtggcacccctggtcctgaacttcatggacctgttgaagtaactttcctgtagtacacatctgctgtggtctgaatgttggtgtcaccccaaattcatatgttggcatcccaagccccacagtgatggtattaggaggtggggcctttggaggtgatgagttcatggagacagagtcgtcacaaatgagattagtgtttttataaaagaggcct

SEQ ID NO: 158253 - DNA, 103 bp, Homo sapiens
cttttcaacctatttgtgtctttgaatctgaagtgtgtctcttatagacaatacatagttggatcctggtgtttttttttttttaatccagtctgacgatctt

SEQ ID NO: 158254 - DNA, 339 bp, Homo sapiens
gtggggaagaggctggacaggaaagaggagcagatcaacaattttatgactgagtgtgtggtgtcttggcgtgcgctagaggacggttttagcacagggcattttgagcccagccccgtgtggggaggcactcctctggacagcatggcattcccatgcgagcccagacagccctggggagcaggatgaatgggcttccctcccactctcatgcccgccggcctcagggtccagatttctctctgtgaaatgaggtcaggacagtgatgcctggaacaaaatcatagtttcttgaggcagcggggcctggggagatccctccgaggaacaggggagcag

SEQ ID NO: 158255 - DNA, 497 bp, Homo sapiens
cgtttttagaagctgccttttgggattgccttgagcagcctggggtcattttgtgacagttccctaccagtggttggccaaggaaaagtcaatgtgttttagctcagttgtttgacctttgggtgtatttgctctttagtaagcatccctcatatggaccacatgagttttacctgaagtcttaactgggttagagtctgcctttttgaaacaacatgatgaggaggccattttccaaaaggtgtatcttctaagccaggcacggtgactcgtgcctgtaatcccagcactttgggaggccgaggcaggtggatcacctgaggtcaggagatcgagaccagcctggccaacatggtgaaacacgtctctactaaaaatacaaaaattagccgagcgtggtggcaggtgcctataatcccagctactcgggaggctgaggcaggagaatcacttgaacctgagaggcagaggttgcagtcaaccgagattgtgccact

SEQ ID NO: 158256 - DNA, 414 bp, Homo sapiens
tacattcagtttacataaccatacaaacgtgccctctcagaatatgtcagcaggtaagggagtaaggggaaccacatataaaaccaccgtggaagccacacaggtcccctgagaactccttaaacaaccaatataccattttttaagtctacacagttccaccagtatgaaaggccatgactcctcatgcccaagatcactggctagaaggaggcctcatcttgcaaaggttactttaggtctcacccccaggcctccctaaccactgcgggtaaagaagagggtaaaaacacaggctatgatgttagacacaccagttgttagtttctgacttaagaaacttaagagctacagtgatgtaaggcaggtaattggacgtatgtgaccctcaaattgctcttgtgtaaactgatg

SEQ ID NO: 158257 - DNA, 594 bp, Homo sapiens
gacgtttgtctcctgggaaagagaacgcaacactggccacctgaggcgtctatttacctactggagaaggtgggggggacgggaataaagaggaagagctagttcccaccatctccactccgaagtctaacacacatccctctaaacctaacacggccagaactgagcccctgggtctctaccctgccagaactagctcctcttatgcgtcatccttgcttctgctcacggcaatgctgttcttccactcgctccggcaaactacttggtcacactcgagtcctctcttctacatcctacgtctaatccatcagcagtttctgtcagctccaccttccaattatacccagacttccaccacttttcaccactagcttctctcaccaagatcattctaacagcctttacctggactcctggtttctgttgttggccctcctattcctccttcccaccatctgttctcaacacagcagccagtgctcaggcacattaagtcagatgatctttctcctctgctcagaactctccagtggctctccagctcactccaagttaaagctggagatgtgacttcacctgcacgtggcccca

SEQ ID NO: 158258 - DNA, 252 bp, Homo sapiens
cccggtgggtacactggggtgacccgctcgcccgatctaggtggtgctttgatacctcttaaagcattttttggagtttgcccttcaccttggaaagctgggtgggggattctgtcctccatgaataacggcgccaggaaccttgggcgatcttgagaaaactccttcctgtaacctctgttttccacgttggatgtgttttaggccacagtcaggcctggcttttttttttttttttttttaagacttatt

SEQ ID NO: 158259 - DNA, 660 bp, Homo sapiens
acaagaaggagccagtaacagaaacggacgtcctagaatctggaataagaagaaagagtaaagtttcaagtcatagtatcctaaatgagcatttcagattggctactgagggcccgtggaacacaagaggaatctggtactttaccttcgtagatctactttttaaaaatgagttccagaactctcagctcttcttacaattcagggcttgagatactggtacaagttcagttcaaaagctggcaaaaggcaccttaaaaaggctctgtgaatgtactttgctggtaacgttttgaggagggaaaaaaaaaggaatcctctttaccattcttttatcctatttgcatggaacagctggaatcctgttccatgcctatcccgtacatcacagccacttgctgagccaacatcccactgcagtgcctcggaatctgcagtgtcactcctcttctgcttgttctctgcaaagtgaagtcacagggacggatcagccaacctgacttctcactgccctgcccagaatcctttgtgaactgaaatgagtcatcgctccaagaaaagctacagcctctgtttgtctgtgcaggctcctttgtctgtgcagtgcggagacgcgaggtcagaatgtaccccaggcgcggggtggcgaggggcacactc

SEQ ID NO: 158260 - DNA, 415 bp, Homo sapiens
tctcactgttgtttatttgggtcatttttgtccctcctgccctgtctttatcctatggaatatcttcaaaacagtgacgaataggaggtcaaatagaattaagaggctcaaagcagttggaagttttttcctcaactttttatgtcctgtgctactcatattcacacatctattcctcagtatttcctgtttgagaaatattgtggctcagttcatctatttctattcactgaatgcattcatcagcaaataatgaaatatggatgggacgcttccttcccgatgccaccatttctatcaccggatataaattagccacttcctttctgaaagataccatatatttctgtgcctttctgaaaaggcaggggattttcagttacagtaatggccatgtgatggcagtctctgtgag

SEQ ID NO: 158261 - DNA, 171 bp, Homo sapiens
ctaacatataagaattgggagacaatacccaaaacaatccaccttgcaattctgaaagaaactattttccccttgacccttccttcactgcttcccattcccaaagactactttgtgccaaagaagtgcaataatccaatctttcctctcaaagagctctgagaagatctc

SEQ ID NO: 158262 - DNA, 293 bp, Homo sapiens
ccttccagttcactggtgagtgttaccagaaatcacagtggctacgctggtgctgcttttctcagaatctctctgtattagtctgttctgaaaaagaagtctaatggaatcatagtttcacgtggctagggaggcctcacaattcatggtggaaagtgaaagacatgttttacatggcagcagatgagagaatgagagccaagcgaaaagggaaaccctttataagaccatcagattttgtgagacttattcactaccatgagagcaacatgggggaatctgcccccatgatt

SEQ ID NO: 158263 - DNA, 587 bp, Homo sapiens
caaaaatatccacatgctcttttgttcatctctaattactattatttttctgaaacagaccaatacactattcttggtgattcctatcaccaagaatatcaagcattccttctctcttggtatttctgtgaccgtctttctaggactttaggagcaattttctaagtgcctctcaagcccaaatcttcagctattaatgaacattcaaagagaacatctttaaatccccaacttgaatttttatatttttacttctttagaggtggaatgttgagagattccatatatttggttaaaacaaatatgaaaagattccttatttttctccacccttccttacattcctcatgaccaaccatcctcccaaaaggaagcggggtacaatttgtctacattatgccaaatatttcagctttttagtttcaccatggaaaaagcattaaactcagctgaattattcatgagatcctaggtaacatgatcattgtttttggcctttggcttcaatactttcagccttgcaactcattttagagtttctgaatggggttaacaagggactttgctatatacacatcattaaactg

SEQ ID NO: 158264 - DNA, 455 bp, Homo sapiens
tgtaaatatacaaaggcttcctaaaataactgtacacttctagggaacatttacattgacttgttcttaaccattacctttaaagctatggatagcttcagaattaaaaatatattatttaccttccacacttttgaatttgaattatgacacaatataataacagaacaagattaaggttgttcacaatagccacagaggaaattacattgctcttttgtatcttgaaaaataagacacctgtaagtaggtcatgcgggttctttagggctgggaagagatctacactccagcacaattaatattcctattactttctcttggttttctgtatcaaatagcagctaaataagtactaaagttattgacgttccctatttgtaaaaaggcaaattaaccttttgcatccaacacatgctgcagatatttttccagtacgtcactttttttttttt

SEQ ID NO: 158265 - DNA, 378 bp, Homo sapiens
attaaatctgagtgatgacatttgataaatgctatattttccagagttggaaggattttttcaaaaaacaaatgatgtctatgcatgacagagacatctctttaagtgttaaacactgttatttaggtaattatttagtgataaacattttaaagagttttggggtttttttttgttctttcttttttttttttttgagacagtcttgctctgtcccccaggctggagtgcagtggcatgatcttggctcactgcaacctccgcctcccaggggggttcaagtgattcccctgcctcagcctctggagtagctaatttttgtatttttagtagggacagggtttcaccatgttggtgaggttggtcttgaactcctga

SEQ ID NO: 158266 - DNA, 152 bp, Homo sapiens
gagcccaccagcatgcaggaaagaatctcacttttacctaagtgaagggcctctgccacggcgccctaaaagatggatcctttgaaggcattttgagtccagctgtccccctctggaaaggggcaagcagactgccctaaagcccttaaata

SEQ ID NO: 158267 - DNA, 448 bp, Homo sapiens
ccgtctcttagaagttagaccagttctggcctgggcaacatggtgaaaccccatctctacaagaaaaaaaatatacacaaaaaaattagctgggcatggtgatctgcccacctctattaaaaatacaaaaattagcctggcatggtggcatgttcctgtagtcccagctactcaggaggctgaagtgggaggaccagttgagcccaggaggccgaagctgcagtgagctatgatggcaccactgcactccagcctgagccaaagagcaagaccctgtctcaaaaaagtaaaataaaatgtgttctaaagttttaaaatgtactttaatataaaagcctatgcaaaagaaactgtatgtttttaaatgtttataaaaagaataaactttcctttttgaagaaataggaaaaccaaaacaaaacacttgatttctaagagagaggtaaga

SEQ ID NO: 158268 - DNA, 439 bp, Homo sapiens
gtttattgagcgccaattctgtgccaggacttcagacacgtaagctcagataagcaaacttcagtttcttccctcaaggaagatttatagcctctaagtcagcaggaaaagcagcaaacaagcaactagaatccatggtagggcttgctacacagaaatatgcagagttctgtgataacctgggagaagccacaaactgactgggagtcaaggagactgcacccaaactgacttctatagagaggataggagaggagggtaagcgcaggtgatgaggtattctaggcaaggggatcatcacgtgctccccttagggaggggatgggggtagatcattcagaaaatttataatttgttttgcatactgctggagcttggagggagagagagaagaagtcagggggatggaccatattaagagatgcgactagacaggggg

SEQ ID NO: 158269 - DNA, 480 bp, Homo sapiens
tcactgcaacctctgcctccagggcttgtgattctcttgcctcagcctcccgagtagctggggttacaggctcccaccaccatgtctggctaatttttgtgtttttagtagagatggggtttcagcatgttggccaggctgttcttgagctcctgacctcaggtgatccacccatgttcgcctcccaaagtgctgggattacaggcgtgagccactgcacctagccaggtgctaattcttgagctgcattgttagaaactatagagatagccacagatgttagttttggaattttccacccaaacgtttttttctttagttagttttagtagtttttatgtttctagaaatttgttcatttcatctaggttatataatttgtttgcctacagttcttagtattcccttataaaccttttttattcctgtaagattcatagtgatatctccttttcatttctggttttagtagtttgaatc

SEQ ID NO: 158270 - DNA, 380 bp, Homo sapiens
  misc_feature (232)..(232): n is a, c, g, or t
acccccaaggattctgtttgtgttcatcaaatacgtattgagcacttgttatctgccaagccactgagctagagtccagggacccagagatatgagtaagatatgactgctgccatgagggagctcacaggggggacagcatgtaaatgaataattattctattatgagaaatagtaggaatatggcctggttacaaaggcggtcccgttaacccgggaccgcctttggcantcagagctcctagttcttaggcctttgttctcagactgaatgacaccaccagctttcctggttctcgggctttgagacagcatattgtggaacttctcagcctccataactaaatgagccaagtcctaatcccctcttatatatttac

SEQ ID NO: 158271 - DNA, 187 bp, Homo sapiens
cctatccttgtcctctcacctctgatcacccagtcctttctctggggacagccatgtgattcgtttattgggaatccttcaacagctgtgttagaggtatactggcaaagtgtttttatctactcctcttttacacaaatggcaacatactaaccacgtgggtttggactttgcttttttcccttcg

SEQ ID NO: 158272 - DNA, 361 bp, Homo sapiens
ctgcaaatgcagagattcacaaagcagcaatgtggaaacttgtcagttcacttggagaacaactcaattctcatttgaggggaggagcatcctgtccccaggctgagctgaagtgggtggcgagaaaagagtggggaggagctggctgcaggccatacccacactggtgaatggttccactgagtggtaggtgcctctgcaatcaggatgaggtcttccccaaaaggttgttgtgtcctgagaggagagttggggagtcacctaaggaacactggagaatggatgctgggcaggtggaacaacacaccacagcttccaactaagctgaggaaagcaggtgcttgccaacccacagcctgtc

SEQ ID NO: 158273 - DNA, 363 bp, Homo sapiens
gggcttcagtccagttaaagggttctgtgagctgtatggtgccaccattgtgtgcggcacgtgtcaagcagcttcatggtcactgcaggatattttagcactgaggcattttagaagcagtccaggccgtgccaccagctggcatgaactcactcattaaacacttactgagggcctgctcatgccaggagctgtgtgagcggctaaggttttgtggtcactatttggagatatggagtccttgggaacatagctgcacaccagtcctagtggcgcaggagttgccatagggcgttgtttacagggtccccacgcgagcccagagcaaaggcctcctgagtctgccaaggaggcagaggcttc

SEQ ID NO: 158274 - DNA, 281 bp, Homo sapiens
tcaatgtctgtcgggcttttcaagattataaagcactttcatatacaacaactctatgttcctcaggaaaggagattaaagctagggaaggttaaactgtacctttagatcaccaagttacaatctggctggaccagaccttgtacccatattccatctacttgtcattcttttttttttttttttttgaagatttctctagagaatgttggtaaggtactttaagttctctccactccctcaaaaggagagaggctacagggagctgtcagcttcttacc

SEQ ID NO: 158275 - DNA, 322 bp, Homo sapiens
gttttataagcagtgtgtagcagcatgtactcacgtgacactgcattcatgtgtcaatgtcaggtgacttttgaggagtcacattaatatgctatgagcagaacccgaggattctgaagactcgaacgggtccactacttgctagctttgtaaacttggaagtcatttacccagtctgacctgggtgtagttgggcatgtatcagtgagaatgcctgtaaactgccttttttagcatttgaacatggtttcctagtgaggcctacctgatcccttaacctgtatgtcctgtttctgtgtcagtcacaatctgatagtttctt

SEQ ID NO: 158276 - DNA, 120 bp, Homo sapiens
ttatcagttgggagaagagaaaaattgagagagaatcaattaattttggcatttagggtttactgaaatatactatctagacagtcataaatagattatttccttggggaaattatcatc

SEQ ID NO: 158277 - DNA, 380 bp, Homo sapiens
gggaagttcaggaggagatcagatttcaggtccttatggctccaggcacacaaagaatgtcagacagccaagggtgggaggtcaggtgcttctcattgcagcagggatgatgctggtctcaaaaatggtgatgggtgagtctccctaggacttggaccacagcatttggtacccactccagatctggagatactgactccagatcaaagagtcccttagagcaatagcaggtaaggacttgggccaaggggcaatacagcaatcctgtgtaattgtgtcggcgatattggctttattttagcaatagcatgattcctcctattctccaacacatgagaatttcaacaaatatttattttaaaccccaaccccagtactct

SEQ ID NO: 158278 - DNA, 336 bp, Homo sapiens
gtgttgctcgactctagcaggatgccctcccacttaatcttaaatttggaaaggaaaaggagacaaaagtggtttttgtctctttattcatgtgtcttttctttttactagtgttccgtgtgcgttgataaatttttccttttctcatgtcaatctgccttttgtcagctcattttcagcaaaactttagaaggtggaggggaggctacctttgtgcctattagcaacatctgtgctcagatgaaggcgcatcatccagaatttttgtactttttccagcccccaaaatataatcatctcccatttccagctcaagatctcgttccctcttcttcc

SEQ ID NO: 158279 - DNA, 131 bp, Homo sapiens
tgagaagggtgggaaaaaagtgactatgtggggaatattttctttgccttatcttatcacgtcagcaatatatgtaggaatagtttgagttaaactcccacttcccatttactttttctgtttagtcgtga

SEQ ID NO: 158280 - DNA, 537 bp, Homo sapiens
catccatggggtaaatactcccaccataactgaccgcatgactgggtgtggagctgggaatagatacacacagttcagctgttgctggtgtgaacacaccactgtacagtaatgtgtatgtgtgtgagagagagattgtacggtgggtgggagtgtgtttgtgctatgtttaggagtggggcagggggtgtggctggaggcactgagaccctaactcctttcctttggggggctaggatgaaggcagggtctgtgcccagagagccatggtgcaggtcaccctacagtggacgtagagagcctaaggagtcctgggttaacccgggaccgcctttgtgtccgtcaaatgcactctctatgaatgtaagctacagcatggtccttggcaggccagggttgtgggatcaggcgtcctgaaggcaatttgactttcaacaggaaaaaaactattccattgccatcaactgaacacaccaccctcgtccattgtctcacagatgccaggttgaaaggggagcggatcagaggctgtgctga

SEQ ID NO: 158281 - DNA, 286 bp, Homo sapiens
gaatatcctgcgtgagtgtggtacgttgtttcaattgaggaaccaagttatgttataccggtataacataacttggttcccaccatctgcctcctcacgtggcctctcctcccccaacgccacacaccagcaagttcctttctccacctctttgctcatgctattttaccttcctcgaatgcctttgccttcccagcacaagctctgtttgtccttccatgaccaggtctaagttcttccccgcggtttcccgtgacaacctccaggccccagagtccagcactta

SEQ ID NO: 158282 - DNA, 255 bp, Homo sapiens
gactcagagaaagcaaagctaaagaaagacattgacaaaaattgctcaggagtctgagtcggggggcctccctaaaaggagggtttctggggcaagaacgtctacaaaagaggagacccttgatcaggccatgcaggtgaggccctgtatctggcaaggagggtggcaatgtgggcgccttggggccaggaggcctttccaaattccgaggcttcagtcctacaggcagggcctgggcagaactcagatgtttag

SEQ ID NO: 158283 - DNA, 643 bp, Homo sapiens
tgtgcgtctagctatgctctgaggacaaatgtaggaaggcagggtgccattcgggagccttttgcaacggtcctactaagagctcggtgccagctgaacaaaccacatttttttcttggagttttagcagaggaggagagtagccactgttctgaaccagagcaccccattcatgcatgcatgcagtttacacttaatgagtggctcctatgttccatgccacgtgctaggtgcaaaacatacaaaccaatgtggttctggtgcttaaggagcttccactgagtgtccctcctgctcagctctctccaaaatgacactggagattgcttctgtggccaaagtttaatcgggagaagcgatgggggctaatttaaaactaaaaggaaagagaaagcagaagcccaaaccgctgctgtctcaaagtgggagaaagggaggctggctgtgatgttctaagggtagaaggggccctcagaaattctcacctccctccctcacttgcagatgaaacaactgtcacttccacagagaggaagcaactggcccagggtacatagcaagctagcagcagacagaactggaattgccatcccggccagggccggtgcttttagaagcaccctgtgttttctccttttgtcgt

SEQ ID NO: 158284 - DNA, 432 bp, Homo sapiens
tcaggttccccagtgagggtgtgtgttcaggagcagatgatccccctttcccatgttcacagtttgggcactcagtgtatttgggctgtcttctgggtcctgcaggagcaatctgcttccttcaaagggtctgtggattttcttggctttccttgtatatccctgtagtagttctttgggcagaaattcatgacacgagtctccacatgctgctgtgtccgtccaagtgggagctgcaatttagtcctgcctcctatctgccattttgtttctagatgcagcctttaaagtcacttcatgccttgctaccctccaaggtgtccctttgccacaggaaacatcaagtatttgttcactgcggtttgaataaatgatgtcctcctttttttgccttgtaattgtcattcctgtcactgtcatttgcttaaacaa

SEQ ID NO: 158285 - DNA, 226 bp, Homo sapiens
cagagagaaaactataaaatgtacatttcagtgttgaagagaagtttaaaatgaaacaagaatagttaatacttaacaagtacactgtcaccaagaaacaattatactagacatatactttctatacaagagaagtaagcctgacaagattagtaaaggtttatttctccagaaatgtagccagtgttttgttaatgataaccatcagagtacacagcatgggaac

SEQ ID NO: 158286 - DNA, 283 bp, Homo sapiens
cgggccattggagagtagaggatttggggttccctgctgtgcttgttgacgtagacccccccacctgaccttttgtttggccctcatgcatatttagggtttcacctggtggagtgggggaggggaggctccttctctggcgtttcctctgtgaaattctggagtggggtcagctcctgtttctgccctacggccgcatgcctcttctggttgctcaaccaccctggaagaattcccaggtcattttatacccacatcttgatttttgtaactgggtggacca

SEQ ID NO: 158287 - DNA, 183 bp, Homo sapiens
tgggtacattcggccaggtcacctctgcaggccgttctggatcagacagtccacagcccctgacttgaggaaggaggcactgcagtcactgatagcagcatgccacctcacctctggtaccgcttgggctaggaaagaggcttcgagtcagagcatcaggccctaccctgtattttgcatatg

SEQ ID NO: 158288 - DNA, 173 bp, Homo sapiens
tccgatggaaaaacaactacaaatcaatgccttgcgtgggtcagcagtgttagccaacgctgcattcagaggacagtattcctttaccgcttacattaaaaggccaagaggtagatgatttggggtcagctggtgcttttataaattatgaaaaaagttgagaaggtaaccat

SEQ ID NO: 158289 - DNA, 331 bp, Homo sapiens
cagcaaaggggaggcccagaaagagctatttcaggcttcctatttttaaagccggggtcagggtgccctgctcaccaccaacatttccagtactggaagcttcaaaaacttcaactccctccagcccagcaccagagacaggctctgtgcacagggctgtgcagtgaccatgggcagccaggagagaggcctccagcatgggtggaggaggttttggagtgccgtggtgcaagaaaagccagagaggttgaccaccatgggtgggatagagccctgggttcaaacccagctttttcattttccaccagcatggccttgagcaaatcatctc

SEQ ID NO: 158290 - DNA, 325 bp, Homo sapiens
gtcaagtcattcgccttcccctaagccctagaccccaaagattcatccgagtggctgtgtgtgtctgtgtgatgggtggtggtgtcttcaaggtcctcctcgcctccctcaatcagctttgccccctgggcggtcacctttcaagcacttccaggctctaactcgttttctgggtcgccctctatagaccaacagacgcactgcgatacctgagtctatgggcagggaccaagcagggctccttttccagggagctgcccctttgacttggcctggtcatccacagaacctccctgggttctgggtggggagtcgagccagagac

SEQ ID NO: 158291 - DNA, 479 bp, Homo sapiens
gcaaagccacagaagactcagctctcttaatgagcaattcccaaaccccactgtaatcttttcctcctccactaacgagatcgtgaagaagcccagaatcttcataaagctaaagatcaaaccaaaacacagcaatctcttctccaagtctctactaacagaaaagcatagaaaattcctaattctaaagttaccttccctgcttggctccctctctgaaattcccaaatgtgccccaaactgggctttctttctttctttaggaagagcatggggtgggtgcggtggggatgaattagaaagaagttctcaagcgggtgaaaccctccagcagctaggcaatcatcttcctgtagtgatttacagcgttcctctaaaaatatctatgagatcacagtacattaagtgcatgacaccaaacatttgtaactaatccatgaaaataaagggcgtcacgttgcatggggaacgtggtggaa

SEQ ID NO: 158292 - DNA, 517 bp, Homo sapiens
acatcactgggagtcatcttggaggctggccttgcaggaagttaaatggaaatttttagatgttcactgggacttcaagattgatttttttaatttgaaaaattttgttctccccagtcagccctgtctccctgtcttctcccaaacctttatgtctctgaaattgtccaatatgtatatggcaaatatctctttctcttcctttgctgtctcagccataagcgctagtaaaaactttccgtttttctaaagcaagccagtaagcatgatcgatctacctcctctacccgttttgctgggacatccatggcagctggtcaaaggaggcttctgctcatgagagcacttcaactggattcagataatcctttgtggtttctccacctatttactactgatcctctaaaatttggtgcaaatgaactagactgactagagttacagtgttaccatgtttttttcagactgagatatataatgatataatgatatgagctctttttggattctatccagg

SEQ ID NO: 158293 - DNA, 118 bp, Homo sapiens
aagaggggtcccgagcgcggatgcgtgaggattatgacagcgtggagcaggatggcgatgaacccggaccacaacgctctgttgaaggctggattctctttgtagctggagtccatga

SEQ ID NO: 158294 - DNA, 866 bp, Homo sapiens
ggtgggcaggcgcctgaggctgacggctggcaagcagggcaccgcggtgcgctgaagctagagattccgaaagggggttcgggtagttcgctccggagaagtctgagaagggtggctccggtgatcccagccctagctgtttcccatattcctttatccacctgcctttgaaggagaccagactccggctccgcccggcccgtgccgggtggtctgcggccccgagtccgtgaccaagccctccgagtgatcggcctgccctcgggtgcacccgcgggtcccaacgtgggggatccctccatccgcaaagccagaggtctctttggtcatgatgtagttgagctccctgaggtcctggctggctctggattgctcctgctgatcctgctctgacagcgtttggggggctagaagtgattcattggcagagtctgttagagtcctcaaagaacagccttggaaagcacctgaggaaacgtctctaagtttccctagaacaggaaaaggataatgccaaggcctcactatgggtcggtggcaaatatgggccccaacccaggtcatctggcttgtctgtctccacctcatcctgctgctcaatgtttagtcaacaaagaacaaggagtactgagtgcctgctgtgggctcaggacacagatggaagaactagaaagacgcagcccctcacctcatggaattcactagaaagatgtggcccctgaccccatggaactcactagaaagatgtggcccctgcccccatggaactccatgaaactaggaagacgcagtccctggctccatggaactcgctagaaagacactgacccttaccccatggactcgacccagtgtgaggatcctct

SEQ ID NO: 158295 - DNA, 3118 bp, Homo sapiens
ggtgggcaggcgcctgaggctgacggctggcaagcagggcaccgcggtgcgctgaagctagagattccgaaagggggttcgggtagttcgctccggagaagtctgagaagggtggctccggtgatcccagccctagctgtttcccatattcctttatccacctgcctttgaaggagaccagactccggctccgcccggcccgtgccgggtggtctgcggccccgagtccgtgaccaagccctccgagtgatcggcctgccctcgggtgcacccgcgggtcccaacgtgggggatccctccatccgcaaagccagggtcctaaagatcgctctgggaaaagggaaggatgccgctcttcttccggaagcggaaacccagtgaggaggctcggaaacgcctggagtaccagatgtgtttggcaaaagaagctggggcagatgacattctcgacatctctaaatgtgagctctcagagattccatttggagcttttgcaacatgcaaagttctgcagaagaaggtgctgatcgtccacacgaatcacctcacttccctgcttcccaaatcctgcagcctcctgagtctggcaaccatcaaggttctagatctccacgataatcagctgacagcccttcctgacgatctggggcagctgactgccctccaggtcttaaacgtggaaaggaatcaactgatgcagctcccacgttccattgggaacctgacccagctccagactctcaatgttaaagacaacaagctgaaggagcttccagacaccgtgggggagcttcgaagcctgcgtaccctcaacatcagtggaaacgagatccagagattgccgcagatgctggctcacgttcgaaccctggagatgctgagccttgacgcctcggccatggtctacccgccgcgggaggtgtgtggtgccggcactgcggccatcttgcagttcctctgcaaagagtcagggctggaatactaccccccttctcagtacttgctgccaattctggagcaagatggaatcgagaactctcgggacagccctgatgggcccacggacagattctcaagggaggagttagagtggcagaacaggttctcagactatgagaagaggaaggaacagaagatgctggagaaactcgagtttgaacggcgcctggaactggggcagcgggagcacacccagctccttcagcagagcagcagccagaaggatgagatccttcagacggtcaaggaggagcagtcccggctggagcagggcctgagtgagcaccagcgccacctcgacgcagagcggcagcggctgcaggagcagctgaagcagacggaacagaacatttccagccggatccagaagctgctgcaggacaatcagagacaaaagaaaagctccgagattttgaaatcgctggaaaatgaaagaataagaatggaacagttgatgtccataacccaggaggagactgagagcctgcggcgacgtgacgttgcctccgccatgcagcagatgctgactgagagctgtaagaaccggctcatccagatggcctacgaatctcagaggcagaacttggtccagcaggcctgttccagcatggccgaaatggatgaacgattccagcagattctgtcgtggcagcaaatggatcagaacaaagccatcagccagatcctgcaggagagcgcgatgcagaaggctgcgttcgaggcactccaggtgaagaaagacctgatgcatcggcagatcaggagccagattaagttaatagaaactgagttattgcagctgacacagctggagttaaagaggaagtccctggacacagagtcactccaggagatgatctcggagcagcgctgggccctcagctccctgctccagcagctgctcaaagagaagcagcagcgagaggaagagctccgggaaatcctgacggagttagaagccaaaagtgaaaccaggcaggaaaattactggctgattcagtatcaacggcttttgaaccagaagcccttgtccttgaagctgcaagaagaggggatggagcgccagctggtggccctcctggaggagctgtcggctgagcactacctgcccatctttgcgcaccaccgcctctcactggacctgctgagccaaatgagcccaggggacctggccaaggtgggcgtctcagaagctggcctgcagcacgagatcctccggagagtccaggaactgctggatgcagccaggatccagccagagctgaaaccaccaatgggtgaggtcgtcacccctacggccccccaggagcctcctgagtctgtgaggccatccgctccccctgcagagctggaggtgcaggcctcagagtgtgtcgtgtgcctggaacgggaggcccagatgatcttcctcaactgtggccacgtctgctgctgccagcagtgctgccagccactgcgcacctgcccgctgtgccgccaggacatcgcccagcgcctccgcatctaccacagcagctgagtgctgcccgcccacctgggcctggtcctagccctgcctcggccactgtgagccccgggctcctgctcagccttgtgccagccagactcgtatgaggctcccccctgccctgggccccttccccactgcccaggagcccccatcctaagctccaagcatgtctgggccaggcagaggtgctcctcatccatgacaccaccagtctgaatggtcctgggggctggggctggagaggccgctgcaccaccacccgagcctgggagccagcgtcccagcctaatcacggatctgctgcctcccagctgtcttgactgaaggccaccgcccctgcaggagcttgggtcctcatctgggggccatgcacaggcccgtcccaccctgcatgtgggaagggagcaggagggcctggctgggtgaggggaggccttcctgggaaggcgtgtggtgcaggcctgtgctcacagtggcaccagcaaccctgggtctccctctctgctgctccccagaaccccggggccctcctgctctccacaactgtccctccttaccccatgtagctcgatccgaagcaggagtgtcaataaacctgtcttcagtgcg

SEQ ID NO: 158296 - DNA, 3377 bp, Homo sapiens
ggtgggcaggcgcctgaggctgacggctggcaagcagggcaccgcggtgcgctgaagctagagattccgaaagggggttcgggtagttcgctccggagaagtctgagaagggtggctccggtgatcccagccctagctgtttcccatattcctttatcgtgagtgtcaccccggtccccgtcacccaatcccagagccccgcccctcccctgaggggtccgtagtcccattccgagaccccagtaccgcggcgacccctgctccctcgagcacttgttgtgtgcactttagttatcaaaacagtctatgtggaaatccagtcccgctcttcattcggagagtccgcgattcctagagcctcagacttcgtcatcccggtctgcgtgactttatgagattctgagtttctgttcccagcacctgcctttgaaggagaccagactccggctccgcccggcccgtgccgggtggtctgcggccccgagtccgtgaccaagccctccgagtgatcggcctgccctcgggtgcacccgcgggtcccaacgtgggggatccctccatccgcaaagccagggtcctaaagatcgctctgggaaaagggaaggatgccgctcttcttccggaagcggaaacccagtgaggaggctcggaaacgcctggagtaccagatgtgtttggcaaaagaagctggggcagatgacattctcgacatctctaaatgtgagctctcagagattccatttggagcttttgcaacatgcaaagttctgcagaagaaggtgctgatcgtccacacgaatcacctcacttccctgcttcccaaatcctgcagcctcctgagtctggcaaccatcaaggttctagatctccacgataatcagctgacagcccttcctgacgatctggggcagctgactgccctccaggtcttaaacgtggaaaggaatcaactgatgcagctcccacgttccattgggaacctgacccagctccagactctcaatgttaaagacaacaagctgaaggagcttccagacaccgtgggggagcttcgaagcctgcgtaccctcaacatcagtggaaacgagatccagagattgccgcagatgctggctcacgttcgaaccctggagatgctgagccttgacgcctcggccatggtctacccgccgcgggaggtgtgtggtgccggcactgcggccatcttgcagttcctctgcaaagagtcagggctggaatactaccccccttctcagtacttgctgccaattctggagcaagatggaatcgagaactctcgggacagccctgatgggcccacggacagattctcaagggaggagttagagtggcagaacaggttctcagactatgagaagaggaaggaacagaagatgctggagaaactcgagtttgaacggcgcctggaactggggcagcgggagcacacccagctccttcagcagagcagcagccagaaggatgagatccttcagacggtcaaggaggagcagtcccggctggagcagggcctgagtgagcaccagcgccacctcgacgcagagcggcagcggctgcaggagcagctgaagcagacggaacagaacatttccagccggatccagaagctgctgcaggacaatcagagacaaaagaaaagctccgagattttgaaatcgctggaaaatgaaagaataagaatggaacagttgatgtccataacccaggaggagactgagagcctgcggcgacgtgacgttgcctccgccatgcagcagatgctgactgagagctgtaagaaccggctcatccagatggcctacgaatctcagaggcagaacttggtccagcaggcctgttccagcatggccgaaatggatgaacgattccagcagattctgtcgtggcagcaaatggatcagaacaaagccatcagccagatcctgcaggagagcgcgatgcagaaggctgcgttcgaggcactccaggtgaagaaagacctgatgcatcggcagatcaggagccagattaagttaatagaaactgagttattgcagctgacacagctggagttaaagaggaagtccctggacacagagtcactccaggagatgatctcggagcagcgctgggccctcagctccctgctccagcagctgctcaaagagaagcagcagcgagaggaagagctccgggaaatcctgacggagttagaagccaaaagtgaaaccaggcaggaaaattactggctgattcagtatcaacggcttttgaaccagaagcccttgtccttgaagctgcaagaagaggggatggagcgccagctggtggccctcctggaggagctgtcggctgagcactacctgcccatctttgcgcaccaccgcctctcactggacctgctgagccaaatgagcccaggggacctggccaaggtgggcgtctcagaagctggcctgcagcacgagatcctccggagagtccaggaactgctggatgcagccaggatccagccagagctgaaaccaccaatgggtgaggtcgtcacccctacggccccccaggagcctcctgagtctgtgaggccatccgctccccctgcagagctggaggtgcaggcctcagagtgtgtcgtgtgcctggaacgggaggcccagatgatcttcctcaactgtggccacgtctgctgctgccagcagtgctgccagccactgcgcacctgcccgctgtgccgccaggacatcgcccagcgcctccgcatctaccacagcagctgagtgctgcccgcccacctgggcctggtcctagccctgcctcggccactgtgagccccgggctcctgctcagccttgtgccagccagactcgtatgaggctcccccctgccctgggccccttccccactgcccaggagcccccatcctaagctccaagcatgtctgggccaggcagaggtgctcctcatccatgacaccaccagtctgaatggtcctgggggctggggctggagaggccgctgcaccaccacccgagcctgggagccagcgtcccagcctaatcacggatctgctgcctcccagctgtcttgactgaaggccaccgcccctgcaggagcttgggtcctcatctgggggccatgcacaggcccgtcccaccctgcatgtgggaagggagcaggagggcctggctgggtgaggggaggccttcctgggaaggcgtgtggtgcaggcctgtgctcacagtggcaccagcaaccctgggtctccctctctgctgctccccagaaccccggggccctcctgctctccacaactgtccctccttaccccatgtagctcgatccgaagcaggagtgtcaataaacctgtcttcagtgcg

SEQ ID NO: 158297 - DNA, 2479 bp, Homo sapiens
ggtgggcaggcgcctgaggctgacggctggcaagcagggcaccgcggtgcgctgaagctagagattccgaaagggggttcgggtagttcgctccggagaagtctgagaagggtggctccggtgatcccagccctagctgtttcccatattcctttatccacctgcctttgaaggagaccagactccggctccgcccggcccgtgccgggtggtctgcggccccgagtccgtgaccaagccctccgagtgatcggcctgccctcgggtgcacccgcgggtcccaacgtgggggatccctccatccgcaaagccagggtcctaaagatcgctctgggaaaagggaaggatgccgctcttcttccggaagcggaaacccagtgaggaggctcggaaacgcctggagtaccagatgtgtttggcaaaagaagctggggcagatgacattctcgacatctctaaatgtgagctctcagagattccatttggagcttttgcaacatgcaaagttctgcagaagaaggtgctgatcgtccacacgaatcacctcacttccctgcttcccaaatcctgcagcctcctgagtctggcaaccatcaaggttctagatctccacgataatcagctgacagcccttcctgacgatctggggcagctgactgccctccaggtcttaaacgtggaaaggaatcaactgatgcagctcccacgttccattgggaacctgacccagctccagactctcaatgttaaagacaacaagctgaaggagcttccagacaccgtgggggagcttcgaagcctgcgtaccctcaacatcagtggaaacgagatccagagattgccgcagatgctggctcacgttcgaaccctggagatgctgagccttgacgcctcggccatggtctacccgccgcgggaggtgtgtggtgccggcactgcggccatcttgcagttcctctgcaaagagtcagggctggaatactaccccccttctcagtacttgctgccaattctggagcaagatggaatcgagaactctcgggacagccctgatgggcccacggacagattctcaagggaggagttagagtggcagaacaggttctcagactatgagaagaggaaggaacagaagatgctggagaaactcgagtttgaacggcgcctggaactggggcagcgggagcacacccagctccttcagcagagcagcagccagaaggatgagatccttcagacggtcaaggaggagcagtcccggctggagcagggcctgagtgagcaccagcgccacctcgacgcagagcggcagcggctgcaggagcagctgaagcagacggaacagaacatttccagccggatccagaagctgctgcaggacaatcagagacaaaagaaaagctccgagattttgaaatcgctggaaaatgaaagaataagaatggaacagttgatgtccataacccaggaggagactgagagcctgcggcgacgtgacgttgcctccgccatgcagcagatgctgactgagagctgtaagaaccggctcatccagatggcctacgaatctcagaggcagaacttggtccagcaggcctgttccagcatggccgaaatggatgaacgattccagcagattctgtcgtggcagcaaatggatcagaacaaagccatcagccagatcctgcaggagagcgcgatgcagaaggctgcgttcgaggcactccaggtgaagaaagacctgatgcatcggcagatcaggagccagattaagttaatagaaactgagttattgcagctgacacagctggagttaaagaggaagtccctggacacagagtcactccaggagatgatctcggagcagcgctgggccctcagctccctgctccagcagctgctcaaagagaagcagcagcgagaggaagagctccgggaaatcctgacggagttagaagccaaaagtgaaaccaggcaggaaaattactggctgattcagtatcaacggcttttgaaccagaagcccttgtccttgaagctgcaagaagaggggatggagcgccagctggtggccctcctggaggagctgtcggctgagcactacctgcccatctttgcgcaccacccacccgagcctgggagccagcgtcccagcctaatcacggatctgctgcctcccagctgtcttgactgaaggccaccgcccctgcaggagcttgggtcctcatctgggggccatgcacaggcccgtcccaccctgcatgtgggaagggagcaggagggcctggctgggtgaggggaggccttcctgggaaggcgtgtggtgcaggcctgtgctcacagtggcaccagcaaccctgggtctccctctctgctgctccccagaaccccggggccctcctgctctccacaactgtccctccttaccccatgtagctcgatccgaagcaggagtgtcaataaacctgtcttcagtgcg

SEQ ID NO: 158298 - DNA, 2681 bp, Homo sapiens
ggtgggcaggcgcctgaggctgacggctggcaagcagggcaccgcggtgcgctgaagctagagattccgaaagggggttcgggtagttcgctccggagaagtctgagaagggtggctccggtgatcccagccctagctgtttcccatattcctttatccacctgcctttgaaggagaccagactccggctccgcccggcccgtgccgggtggtctgcggccccgagtccgtgaccaagccctccgagtgatcggcctgccctcgggtgcacccgcgggtcccaacgtgggggatccctccatccgcaaagccagggtcctaaagatcgctctgggaaaagggaaggatgccgctcttcttccggaagcggaaacccagtgaggaggctcggaaacgcctggagtaccagatgtgtttggcaaaagaagctggggcagatgacattctcgacatctctaaatgtgagctctcagagattccatttggagcttttgcaacatgcaaagttctgcagaagaaggtgctgatcgtccacacgaatcacctcacttccctgcttcccaaatcctgcagcctcctgagtctggcaaccatcaaggttctagatctccacgataatcagctgacagcccttcctgacgatctggggcagctgactgccctccaggtcttaaacgtggaaaggaatcaactgatgcagctcccacgttccattgggaacctgacccagctccagactctcaatgttaaagacaacaagctgaaggagcttccagacaccgtgggggagcttcgaagcctgcgtaccctcaacatcagtggaaacgagatccagagattgccgcagatgctggctcacgttcgaaccctggagatgctgagccttgacgcctcggccatggtctacccgccgcgggaggtgtgtggtgccggcactgcggccatcttgcagttcctctgcaaagagtcagggctggaatactaccccccttctcagtacttgctgccaattctggagcaagatggaatcgagaactctcgggacagccctgatgggcccacggacagattctcaagggaggagttagagtggcagaacaggttctcagactatgagaagaggaaggaacagaagatgctggagaaactcgagtttgaacggcgcctggaactggggcagcgggagcacacccagctccttcagcagagcagcagccagaaggatgagatccttcagacggtcaaggaggagcagtcccggctggagcagggcctgagtgagcaccagcgccacctcgacgcagagcggcagcggctgcaggagcagctgaagcagacggaacagaacatttccagccggatccagaagctgctgcaggacaatcagagacaaaagaaaagctccgagattttgaaatcgctggaaaatgaaagaataagaatggaacagttgatgtccataacccaggaggagactgagagcctgcggcgacgtgacgttgcctccgccatgcagcagatgctgactgagagctgtaagaaccggctcatccagatggcctacgaatctcagaggcagaacttggtccagcaggcctgttccagcatggccgaaatggatgaacgattccagcagattctgtcgtggcagcaaatggatcagaacaaagccatcagccagatcctgcaggagagcgcgatgcagaaggctgcgttcgaggcactccaggtgaagaaagacctgatgcatcggcagatcaggagccagattaagttaatagaaactgagttattgcagctgacacagctggagttaaagaggaagtccctggacacagagtcactccaggagatgatctcggagcagcgctgggccctcagctccctgctccagcagctgctcaaagagaagcagcagcgagaggaagagctccgggaaatcctgacggagttagaagccaaaagtgaaaccaggcaggaaaattactggctgattcagtatcaacggcttttgaaccagaagcccttgtccttgaagctgcaagaagaggggatggagcgccagctggtggccctcctggaggagctgtcggctgagcactacctgcccatctttgcgcaccaccgcctctcactggacctgctgagccaaatgagcccaggggacctggccaaggtgggcgtctcagaagctggcctgcagcacgagatcctccggagagtccaggaactgctggatgcagccaggatccagccagagctgaaaccaccaatgggtgaggtcgtcacccctacggccccccaggagcctcctgagtctgtgaggccatccgctccccctttccccactgcccaggagcccccatcctaagctccaagcatgtctgggccaggcagaggtgctcctcatccatgacaccaccagtctgaatggtcctgggggctggggctggagaggccgctgcaccaccacccgagcctgggagccagcgtcccagcctaatcacggatctgctgcctcccagctgtcttgactgaaggccaccgcccctgcaggagcttgggtcctcatctgggggccatgcacaggcccgtcccactcctgctctccacaactgtccctccttaccccatgtagctcgatccgaagcaggagtgtcaataaacctgtcttcagtgcg

SEQ ID NO: 158299 - DNA, 2857 bp, Homo sapiens
  misc_feature (4)..(4): n is a, c, g, or t
  misc_feature (6)..(8): n is a, c, g, or t
ggcngnnnatcaggaagggggtgcaagagggttagtgattggggagcagaaggggtcctaaagatcgctctgggaaaagggaaggatgccgctcttcttccggaagcggaaacccagtgaggaggctcggaaacgcctggagtaccagatgtgtttggcaaaagaagctggggcagatgacattctcgacatctctaaatgtgagctctcagagattccatttggagcttttgcaacatgcaaagttctgcagaagaaggtgctgatcgtccacacgaatcacctcacttccctgcttcccaaatcctgcagcctcctgagtctggcaaccatcaaggttctagatctccacgataatcagctgacagcccttcctgacgatctggggcagctgactgccctccaggtcttaaacgtggaaaggaatcaactgatgcagctcccacgttccattgggaacctgacccagctccagactctcaatgttaaagacaacaagctgaaggagcttccagacaccgtgggggagcttcgaagcctgcgtaccctcaacatcagtggaaacgagatccagagattgccgcagatgctggctcacgttcgaaccctggagatgctgagccttgacgcctcggccatggtctacccgccgcgggaggtgtgtggtgccggcactgcggccatcttgcagttcctctgcaaagagtcagggctggaatactaccccccttctcagtacttgctgccaattctggagcaagatggaatcgagaactctcgggacagccctgatgggcccacggacagattctcaagggaggagttagagtggcagaacaggttctcagactatgagaagaggaaggaacagaagatgctggagaaactcgagtttgaacggcgcctggaactggggcagcgggagcacacccagctccttcagcagagcagcagccagaaggatgagatccttcagacggtcaaggaggagcagtcccggctggagcagggcctgagtgagcaccagcgccacctcgacgcagagcggcagcggctgcaggagcagctgaagcagacggaacagaacatttccagccggatccagaagctgctgcaggacaatcagagacaaaagaaaagctccgagattttgaaatcgctggaaaatgaaagaataagaatggaacagttgatgtccataacccaggaggagactgagagcctgcggcgacgtgacgttgcctccgccatgcagcagatgctgactgagagctgtaagaaccggctcatccagatggcctacgaatctcagaggcagaacttggtccagcaggcctgttccagcatggccgaaatggatgaacgattccagcagattctgtcgtggcagcaaatggatcagaacaaagccatcagccagatcctgcaggagagcgcgatgcagaaggctgcgttcgaggcactccaggtgaagaaagacctgatgcatcggcagatcaggagccagattaagttaatagaaactgagttattgcagctgacacagctggagttaaagaggaagtccctggacacagagtcactccaggagatgatctcggagcagcgctgggccctcagctccctgctccagcagctgctcaaagagaagcagcagcgagaggaagagctccgggaaatcctgacggagttagaagccaaaagtgaaaccaggcaggaaaattactggctgattcagtatcaacggcttttgaaccagaagcccttgtccttgaagctgcaagaagaggggatggagcgccagctggtggccctcctggaggagctgtcggctgagcactacctgcccatctttgcgcaccaccgcctctcactggacctgctgagccaaatgagcccaggggacctggccaaggtgggcgtctcagaagctggcctgcagcacgagatcctccggagagtccaggaactgctggatgcagccaggatccagccagagctgaaaccaccaatgggtgaggtcgtcacccctacggccccccaggagcctcctgagtctgtgaggccatccgctccccctgcagagctggaggtgcaggcctcagagtgtgtcgtgtgcctggaacgggaggcccagatgatcttcctcaactgtggccacgtctgctgctgccagcagtgctgccagccactgcgcacctgcccgctgtgccgccaggacatcgcccagcgcctccgcatctaccacagcagctgagtgctgcccgcccacctgggcctggtcctagccctgcctcggccactgtgagccccgggctcctgctcagccttgtgccagccagactcgtatgaggctcccccctgccctgggccccttccccactgcccaggagcccccatcctaagctccaagcatgtctgggccaggcagaggtgctcctcatccatgacaccaccagtctgaatggtcctgggggctggggctggagaggccgctgcaccaccacccgagcctgggagccagcgtcccagcctaatcacggatctgctgcctcccagctgtcttgactgaaggccaccgcccctgcaggagcttgggtcctcatctgggggccatgcacaggcccgtcccaccctgcatgtgggaagggagcaggagggcctggctgggtgaggggaggccttcctgggaaggcgtgtggtgcaggcctgtgctcacagtggcaccagcaaccctgggtctccctctctgctgctccccagaaccccggggccctcctgctctccacaactgtccctccttaccccatgtagctcgatccgaagcaggagtgtcaataaacctgtcttcagtgcg

SEQ ID NO: 158300 - DNA, 3019 bp, Homo sapiens
ggtgggcaggcgcctgaggctgacggctggcaagcagggcaccgcggtgcgctgaagctagagattccgaaagggggttcgggtagttcgctccggagaagtctgagaagggtggctccggtgatcccagccctagctgtttcccatattcctttatccacctgcctttgaaggagaccagactccggctccgcccggcccgtgccgggtggtctgcggccccgagtccgtgaccaagccctccgagtgatcggcctgccctcgggtgcacccgcgggtcccaacgtgggggatccctccatccgcaaagccagggtcctaaagatcgctctgggaaaagggaaggatgccgctcttcttccggaagcggaaacccagtgaggaggctcggaaacgcctggagtaccagatgtgtttggcaaaagaagctggggcagatgacattctcgacatctctaaatgtgagctctcagagattccatttggagcttttgcaacatgcaaagttctgcagaagaaggtgctgatcgtccacacgaatcacctcacttccctgcttcccaaatcctgcagcctcctgagtctggcaaccatcaaggttctagatctccacgataatcagctgacagcccttcctgacgatctggggcagctgactgccctccaggtcttaaacgtggaaaggaatcaactgatgcagctcccacgttccattgggaacctgacccagctccagactctcaatgttaaagacaacaagctgaaggagcttccagacaccgtgggggagcttcgaagcctgcgtaccctcaacatcagtggaaacgagatccagagattgccgcagatgctggctcacgttcgaaccctggagatgctgagccttgacgcctcggccatggtctacccgccgcgggaggtgtgtggtgccggcactgcggccatcttgcagttcctctgcaaagagtcagggctggaatactaccccccttctcagtacttgctgccaattctggagcaagatggaatcgagaactctcgggacagccctgatgggcccacggacagattctcaagggaggagttagagtggcagaacaggttctcagactatgagaagaggaaggaacagaagatgctggagaaactcgagtttgaacggcgcctggaactggggcagcgggagcacacccagctccttcagcagagcagcagccagaaggatgagatccttcagacggtcaaggaggagcagtcccggctggagcagggcctgagtgagcaccagcgccacctcgacgcagagcggcagcggctgcaggagcagctgaagcagacggaacagaacatttccagccggatccagaagctgctgcaggacaatcagagacaaaagaaaagctccgagattttgaaatcgctggaaaatgaaagaataagaatggaacagttgatgtccataacccaggaggagactgagagcctgcggcgacgtgacgttgcctccgccatgcagcagatgctgactgagagctgtaagaaccggctcatccagatggcctacgaatctcagaggcagaacttggtccagcaggcctgttccagcatggccgaaatggatgaacgattccagcagattctgtcgtggcagcaaatggatcagaacaaagccatcagccagatcctgcaggagagcgcgatgcagaaggctgcgttcgaggcactccaggtgaagaaagacctgatgcatcggcagatcaggagccagattaagttaatagaaactgagttattgcagctgacacagctggagttaaagaggaagtccctggacacagagtcactccaggagatgatctcggagcagcgctgggccctcagctccctgctccagcagctgctcaaagagaagcagcagcgagaggaagagctccgggaaatcctggaagaggggatggagcgccagctggtggccctcctggaggagctgtcggctgagcactacctgcccatctttgcgcaccaccgcctctcactggacctgctgagccaaatgagcccaggggacctggccaaggtgggcgtctcagaagctggcctgcagcacgagatcctccggagagtccaggaactgctggatgcagccaggatccagccagagctgaaaccaccaatgggtgaggtcgtcacccctacggccccccaggagcctcctgagtctgtgaggccatccgctccccctgcagagctggaggtgcaggcctcagagtgtgtcgtgtgcctggaacgggaggcccagatgatcttcctcaactgtggccacgtctgctgctgccagcagtgctgccagccactgcgcacctgcccgctgtgccgccaggacatcgcccagcgcctccgcatctaccacagcagctgagtgctgcccgcccacctgggcctggtcctagccctgcctcggccactgtgagccccgggctcctgctcagccttgtgccagccagactcgtatgaggctcccccctgccctgggccccttccccactgcccaggagcccccatcctaagctccaagcatgtctgggccaggcagaggtgctcctcatccatgacaccaccagtctgaatggtcctgggggctggggctggagaggccgctgcaccaccacccgagcctgggagccagcgtcccagcctaatcacggatctgctgcctcccagctgtcttgactgaaggccaccgcccctgcaggagcttgggtcctcatctgggggccatgcacaggcccgtcccaccctgcatgtgggaagggagcaggagggcctggctgggtgaggggaggccttcctgggaaggcgtgtggtgcaggcctgtgctcacagtggcaccagcaaccctgggtctccctctctgctgctccccagaaccccggggccctcctgctctccacaactgtccctccttaccccatgtagctcgatccgaagcaggagtgtcaataaacctgtcttcagtgcg

SEQ ID NO: 158301 - DNA, 1225 bp, Homo sapiens
acaggttttattaccattttgtgactaacattgcctgcttcattcctggcagacggagttagaagccaaaagtgaaaccaggcaggaaaattactggctgattcagtatcaacggcttttgaaccagaagcccttgtccttgaagctgcaagaagaggggatggagcgccagctggtggccctcctggaggagctgtcggctgagcactacctgcccatctttgcgcaccaccgcctctcactggacctgctgagccaaatgagcccaggggacctggccaaggtgggcgtctcagaagctggcctgcagcacgagatcctccggagagtccaggaactgctggatgcagccaggatccagccagagctgaaaccaccaatgggtgaggtcgtcacccctacggccccccaggagcctcctgagtctgtgaggccatccgctccccctgcagagctggaggtgcaggcctcagagtgtgtcgtgtgcctggaacgggaggcccagatgatcttcctcaactgtggccacgtctgctgctgccagcagtgctgccagccactgcgcacctgcccgctgtgccgccaggacatcgcccagcgcctccgcatctaccacagcagctgagtgctgcccgcccacctgggcctggtcctagccctgcctcggccactgtgagccccgggctcctgctcagccttgtgccagccagactcgtatgaggctcccccctgccctgggccccttccccactgcccaggagcccccatcctaagctccaagcatgtctgggccaggcagaggtgctcctcatccatgacaccaccagtctgaatggtcctgggggctggggctggagaggccgctgcaccaccacccgagcctgggagccagcgtcccagcctaatcacggatctgctgcctcccagctgtcttgactgaaggccaccgcccctgcaggagcttgggtcctcatctgggggccatgcacaggcccgtcccaccctgcatgtgggaagggagcaggagggcctggctgggtgaggggaggccttcctgggaaggcgtgtggtgcaggcctgtgctcacagtggcaccagcaaccctgggtctccctctctgctgctccccagaaccccggggccctcctgctctccacaactgtccctccttaccccatgtagctcgatccgaagcaggagtgtcaataaacctgtcttcagtgcg

SEQ ID NO: 158302 - DNA, 2450 bp, Homo sapiens
ggtgggcaggcgcctgaggctgacggctggcaagcagggcaccgcggtgcgctgaagctagagattccgaaagggggttcgggtagttcgctccggagaagtctgagaagggtggctccggtgatcccagccctagctgtttcccatattcctttatccacctgcctttgaaggagaccagactccggctccgcccggcccgtgccgggtggtctgcggccccgagtccgtgaccaagccctccgagtgatcggcctgccctcgggtgcacccgcgggtcccaacgtgggggatccctccatccgcaaagccagggtcctaaagatcgctctgggaaaagggaaggatgccgctcttcttccggaagcggaaacccagtgaggaggctcggaaacgcctggagtaccagatgtgtttggcaaaagaagctggggcagatgacattctcgacatctctaaatgtgagctctcagagattccatttggagcttttgcaacatgcaaagttctgcagaagaaggtgctgatcgtccacacgaatcacctcacttccctgcttcccaaatcctgcagcctcctgagtctggcaaccatcaaggttctagatctccacgataatcagctgacagcccttcctgacgatctggggcagctgactgccctccaggtcttaaacgtggaaaggaatcaactgatgcagctcccacgttccattgggaacctgacccagctccagactctcaatgttaaagacaacaagctgaaggagcttccagacaccgtgggggagcttcgaagcctgcgtaccctcaacatcagtggaaacgagatccagagattgccgcagatgctggctcacgttcgaaccctggagatgctgagccttgacgcctcggccatggtctacccgccgcgggaggtgtgtggtgccggcactgcggccatcttgcagttcctctgcaaagagtcagggctggaatactaccccccttctcagtacttgctgccaattctggagcaagatggaatcgagaactctcgggacagccctgatgggcccacggacagattctcaagggaggagttagagtggcagaacaggttctcagactatgagaagaggaaggaacagaagatgctggagaaactcgagtttgaacggcgcctggaactggggcagcgggagcacacccagctccttcagcagagcagcagccagaaggatgagatccttcagacggtcaaggaggagcagtcccggctggagcagggcctgagtgagcaccagcgccacctcgacgcagagcggcagcggctgcaggagcagctgaagcagacggaacagaacatttccagccggatccagaagctgctgcaggacaatcagagacaaaagaaaagctccgagattttgaaatcgctggaaaatgaaagaataagaatggaacagttgatgtccataacccaggaggagactgagagcctgcggcgacgtgacgttgcctccgccatgcagcagatgctgactgagagctgtaagaaccggctcatccagatggcctacgaatctcagaggcagaacttggtccagcaggcctgttccagcatggccgaaatggatgaacgattccagcagattctgtcgtggcagcaaatggatcagaacaaagccatcagccagatcctgcaggagagcgcgatgcagaaggctgcgttcgaggcactccaggtgaagaaagacctgatgcatcggcagatcaggagccagattaagttaatagaaactgagttattgcagctgacacagctggagttaaagaggaagtccctggacacagagtcactccaggagatgatctcggagcagcgctgggccctcagctccctgctccagcagctgctcaaagagaagcagcagcgagaggaagagctccgggaaatcctgacggagttagaagccaaaagtgaaaccaggcaggaaaattactggctgattcagtatcaacggcttttgaaccagaagcccttgtccttgaagctgcaagaagaggggatggagcgccagctggtggccctcctggaggagctgtcggctgagcactacctgcccatctttgcgcaccaccgcctctcactggacctgctgagccaaatgagcccaggggacctggccaaggtgggcgtctcagaagctggcctgcagcacgagatcctccggagagtccaggaactgctggatgcagccaggatccagccaggtacaagcacagctccagcctcttccaggcagggctccagccgtatgtgtgggctctggtggggacagtcatttgcttacatttcaggatgactcctgagggctggttctagcctctgctggtcggtaaggtttcctcccaaggagcaggcttagggatcagtgagcccattttacagatgggaaaaatggg

SEQ ID NO: 158303 - DNA, 172 bp, Homo sapiens
taatgtctgttattcctttttgctaccttcagtaaattttagtgcccttagtttttgcttctcaaaatcacccatctctgtctgggcatctcctgcagtgcacagagcagcacagtggatagtttggagtttcagtgagtgctgctttacaccacactctttgttgagacag

SEQ ID NO: 158304 - DNA, 483 bp, Homo sapiens
cttaaaaacctgaggattttagccagaattttcctgttctaattagacctatgtcagtggttctcaattggaagtgattttgccccccaggggacatttggcagtcttataggcatctggtggatagaggcaggggatgcacaggacacccctctttcccacctacccacacaccaaagaattctccagctggaaatgtcaataatactgagattcaaaacccctggtctacatgtgcttgaggaacagtgaagagataatggagcctagccacctgtctaccatttgttttatgtgaccaatgcctcaaggagttatagggctgggctgtgaacagttagtaagtggcatatgattaattattcagtcctgagttattcagcgtacttcagtgaaaatcacagtctaaaccagggacttaataaaggattactgacaaaagagaactatatatgaatgaaacatcatctttttgtacttgac

SEQ ID NO: 158305 - DNA, 836 bp, Homo sapiens
ccagagctttgggagagcccctggaatttgagagtgacgccacaaccagcatagtattggacattcactggaggactgaaattcctgggttgactgaatggagagaattttctgcgcattttggtcccggtatgaccattatcccgtattcgcgcccggtatcccccggccgggcgagtcctcaagctctaagataatctctgccctggtgaagctggtaatttggttagggtgacagatcaggtatgacaataaagaacatggatttcccttaaaccagccacaacagaagtcaggcatcaccggcggcgtagccattcacacagtagttacctagtttgccttacagacttcttccagtgttgctaccaagtactcaaaatagcttgtcctttttgagtataaaaagcaacatcatacccaagtcccagtacagtaatacacattaaatgccacacagcatttttgcctcggataataacagccgtattaagttgttacagacattgcctctatctcatctctggaggtggtataggattcttctggaacgaatcacagtctgggaaagcaaacccagaccccttgccccattggttcagctgcttggaaaaattccccacttaattaagatactcttcttgaaatatggagtttcagagtaggctaagcaatgaccaggccagagctttgggagaggcccttggaagttgagagtgacgccacaaccagcatagtattggacattcagtggatgactgaaaatcctggttgactgaatggagagaatagtcgggcagtttcttcgagaaaagtcaatagcctgtgagggcgcc

SEQ ID NO: 158306 - DNA, 348 bp, Homo sapiens
tatatttatcaaaaccgatagaacaggcaactccaagagtgaaccctaatataaactgtagactttgagtgataatgatgtgtcaatgtaggctcattggttgtaagaaatatacctctctggtatgggatgttgatcatgagggaggtttgcaggtgtggagacagggaatgtatgcatgctgtctatattttctgttcagttttgccatgaacctaaaactgctctaaaaataaagtttattaatttaaaaaaattaaaagaagttaagtaacaagggcaaattatgattagattagaatacatgttttcgcacgtgtagagttgtaataagactcatgtgtactg

SEQ ID NO: 158307 - DNA, 176 bp, Homo sapiens
acagatatttaatacatactcaggtaagctctttctgtgtacatttgccattaaaatatatgcagttcctactagggaattccatattactcagataatatcaaggtatagaaaagattttcgttttagtgatttttcagaaatttttaagccgttcctctttcccctgcagttta

SEQ ID NO: 158308 - DNA, 665 bp, Homo sapiens
atatctgctcgttctcccatcggacggcagctccgtgaggacaatgtctggctccctgccctctctcccctctgagaacagtacctggtacctagtatgtgctcaagaaatctgctgggattacaggcgtgagccaccgtacctggccctgtttttaaatttttaatgtcatcctgtgcttgacaaaactccttatgttccctacggggttgccacactcaccaaactcacaggaaagctgttcttacaccagaattcatgcacgtgtccatctgactgatatttcctgaggtcctgtggtaagccaggccttctgctgactgaccagtttccaaagggcctgacacattcctggcaccggaatgcatatgcccaccttccgagccactggtctgaggtatcttggggtcagcaggagactggccagtgtgtgtggcctcagagaaagggactggatgggtctgagtggcatcccactacagtagtggtgactatagtcatggtgacgacaccactggacctaccagcccacgccacgcacactcccagactagcacctcagcttctgggcatcacggtgcaaatcctcacgggttcttattccacagtccccctttgtctggactctgggatgacttgcccccttggctaatgccatctttgtc

SEQ ID NO: 158309 - DNA, 389 bp, Homo sapiens
atatgactttttctattcctcgttctttgatttgtgcttcctctgccctaatctcacctcccaatattccactttctcccacgcttttcctctgtgtctctggaacctgaattctgacaatttccctgacatctttgatttatgccaaaaacattcgcaccatctcctgtcccttgaggatactccttccctctcacatctgtctcagatttgggagtcagaaggtgacatccttggcctcggtgccattttttggctattaattcccttctagatataaaggagactgctgtgggctccacttctccaactacattgctctctgctccacctcactgctatcatccactgactgcctggttgcccctattttattcaagacttgtgca

SEQ ID NO: 158310 - DNA, 420 bp, Homo sapiens
gttttggacctcttgggggtgagctaaagagcaagtgagtccgggattttcgagacatcatggctgtgaaaatgctttgttttccctaccgtggaggatctcaagcctggcgtccttcagggtcaccctagggggcaaactgcacatgcaggtgcctgagctccatttcagacccaccgtgggggatctcagaggatgcgcccaggaatatgccccttttccccagtagctttaggggtacatgtggttttgtttccgtgggcaaatcataaagtctgagattctagtgctcctgtcagccaagtagtgcacgctgcacccagtatgtagctttttattccttagccaccttctaaaagaagacttgggtaacttgaggcctggcccagtgacaacactctggcaaagtcgtgcacggtg

SEQ ID NO: 158311 - DNA, 268 bp, Homo sapiens
aggtgggggagggatgcagtaggaagtgcaggtgcaaggaccaacatctagccgggaagtactggtaagtggttagaagtaaattgcctggtgcggtggctcgtgcccataatcccagcactttgggaggctgaggcgtgagccaccatgcccagcctcaagtagcttttaaacaagctcactgagatgagaggtgaggcggtgagcttagaataggtggttaggaagtgattaaagtaggggtttccagtgctggctctatactaat

SEQ ID NO: 158312 - DNA, 228 bp, Homo sapiens
caaacaccagttgcagaaaaataaagctagtgggaacactttctaagtgacacatgcagttttcctggaaggtggcataaatggaacacttttaaaacgtttgagtgctttcccaaaagctggtaggttcggtgggctgaggaactggcttatattaatatatttgttttgttcagccttcacagtgctgtaaagactttaagccaatagagaatcaggagactggca

SEQ ID NO: 158313 - DNA, 300 bp, Homo sapiens
cgcagtggcttccttttcccagtctctccccggggcaagcaactgcaccctgcacactcactaggttttctaagccctgctttcatgacatctcttcttgatttaaccattttgaatgggtccccattggttactcaatgaagtcaaatttctttttttttttgagacaaagtctcgaaaaaaaaaaaaggaaggaattttttttttttcaggtttttttttatagcaaggggagaatgactaatacaatcttttgcacccgggggtcatccaaaagagcaccatcaaagttctgttttg

SEQ ID NO: 158314 - DNA, 585 bp, Homo sapiens
gggtcccggtacactgaggatgatcgcgtctgagtgcggtatcctcctagactggagcatgtgtccgtggtgaatgagtggatggggggattttctgcttctctgaagaattggaagacctggcaacacagggtctttgttcccacctaacttgggcccaggggaacagccccagcctggggcatccccttcccccagtcccaggccccatgggcagtcatttgtggccctgctctgtcgtctctcctcatcaggcttgtcaacaatctatgaaggcccagcccatatgccagcccctcccacaaacaactcttccggtctcccttgcttacacacagatacatcctctttctctgtccctcccaagaactcacagagtaccttgcctggcaccagctatttctctcttggtttaaggaattgtgaccaatcaagcaagacccagtttagttaaagtcccatccaccttaccaccatgtctaatgtgtgccaggcacagtgctaggcacaggggctgaagaggggcatctaggtccagctggtaagacccgagtctggctggaaaggcagccgttgtgggctgcg

SEQ ID NO: 158315 - DNA, 665 bp, Homo sapiens
atattttccttggctcgcggagtggtttttaaaattctgaactagtcgccaacactttgaattgggaggttgtacctaacaggctgagaaggcgaggactgcagtgtctcgccgtgtgctgtatccccagggcagggcacgtgtccgtggtgaatgagtggatggggggattttctgcttctctgaagaattggaagacctggcaacacagggtctttgttcccacctaacttgggcccaggggaacagccccagcctggggcatccccttcccccagtcccaggccccatgggcagtcatttgtggccctgctctgtcgtctctcctcatcaggcttgtcaacaatctatgaaggcccagcccatatgccagcccctcccacaaacaactcttccggtctcccttgcttacacacagatacatcctctttctctgtccctcccaagaactcacagagtaccttgcctggcaccagctatttctctcttggtttaaggaattgtgaccaatcaagcaagacccagtttagttaaagtcccatccaccttaccaccatgtctaatgtgtgccaggcacagtgctaggcacaggggctgaagaggggcatctaggtccagctggtaagacccgagtctggctggaaaggcagccgttgtgggctgcg

SEQ ID NO: 158316 - DNA, 536 bp, Homo sapiens
acttccacatgctctacctaacaattttagtgtaaagtttcattttccttatcaaattctatgtaagtgagacattggtgttttagccaaggtaccctgctttatggagtatctgtgttcctagaaaatttgttttgaaatatgattttgtaaatcagattgtattgtaatatacttggtgaccttttgcttcaaatcaccttaaaataaattcatttatattatctaattcatattttataaatcctaatttttatatgtactcatttttcttgaattgggggtaattctacaaacaataaacaaggtaaatgatttttttttgccagtttgtactaagagaacatgttattttgtttcgggtgaatgtatgtatcttaatacactgtactacattagacatcaatagggaggaatgtaacgcatttttcttttgtatggaaatctgttgaaacctatcttaaagagttttgagcagaaattgaaggatgagcctgaggttttctgattagttggagaatattgttttcagtaga

SEQ ID NO: 158317 - DNA, 323 bp, Homo sapiens
tacaatcttcaaatctggtggagaggaaagcgtgtggacttgggaccctgagttggagaatctgctctctgccctgtgaccctggccaagtctctcagctccaagcctgcatttccgcacctgtaaggtggagctaacgggacacgtgcagcgcagaccaggccacggtgagcacaggcaggaggccacggggtgcagtgctcaggcctgtgaggagtcagatcctggctccgaggagttgttactggatgcccagaagcacagtggcctcatcctcaaagcagtggaggtggggggtggtaagaacagggccgatcttgcag

SEQ ID NO: 158318 - DNA, 200 bp, Homo sapiens
ttttaggcccctccctcctgaaaatctgattctacctaatctggcgtagttgcagaatgctagggtataatacagttacactctagaattgtttctttaatgcaagcagtattctaaaactgtttcagatctagtttccctttctataaaatacttttcatgctctctttgtcatcctaaatgaatttcatggggaaaaa

SEQ ID NO: 158319 - DNA, 571 bp, Homo sapiens
ttacttcctaagccccaacttttttttttttttttgagtcttgctctgtcgcccaggctggagtgcaatggtgcgatctcagctcactgcaacctccgcctcccgggttcaagcgattctcctgcttcagcctcttgagtagctgggattataggtgcctgccaccacacccggctaatttttgtattttttagtagagatggggtttcaccatgttggtcaggctggtcttgaactcccgacctcaggtgatctgccctccttggcctcccaaagtgctgggattacaggcatgagccacctcactggcctagccccaacctttgatcttgggtttggcctccctagatttgggctggggagagcagatagagacatttaaggtctaatgagagaatttagattgctcctgccaagcccccagctgaagcagcttccttcacagaaaggaccagaatctgaggttaaacttctaatatatccccattctggttagatagtttccttgcctgcattctcagtgtgataaggagtgaaaactgtcaaagataacttcagttccaaacatgtc

SEQ ID NO: 158320 - DNA, 149 bp, Homo sapiens
aaacatcctcaaagggacttctcatctcattcatctcttcctcccacacaatcctcccacccccaccccaaaatccacttgtcaaaagtcaagacaagctctaatcctacctgcattaaaccttcccgaagcctcccggtcagaactat

SEQ ID NO: 158321 - DNA, 311 bp, Homo sapiens
cttgcctgtaaaagcaaaaggcaaagttggttggagaaatgaataaaaataactacctccttgggttattatgagtgttcaatgaattgaatgaaataattgatgcttagtgcttaacacagtgactagcaccatccatatcaatgggattcagctattactgttgttattagagttgttagttggtctccccagccttgctcatgagtttcattatccatgtgtaaatgaataagtccccataacaacttctgccgtatggatgctggatagctttgctcatgtgagaagcaactcaaatcaacacaaat

SEQ ID NO: 158322 - DNA, 325 bp, Homo sapiens
ctcaatttctgcaaatagggcctaggaagcaaaatatcacaacattatcattgccattaccaccattgaaagagctgaacatttactatgttctaaggcagtagtttccaaaccttagctgcatcagaattgctggaaagggtggttaaaacacatactgctgggcctcacctccagagtttctggttcagtgggtttgggttcacaaatttgcacttttttgtctttttaatcttttgtagaaacaagttctcgctttcttaaccaggctggtctcaaattcctatcctcaagtgatccccatgcctcggcctcccaaagtgct

SEQ ID NO: 158323 - DNA, 155 bp, Homo sapiens
aggtcataggacaacagcggagggaaggtcagcaggcaaacaagtgaacaaaggtcctgctgcaatcggagaagcttctcaagaccaatgctattgttaccagggaaacgatactttatcatggaaatatattattctaagagtctacttaattg

SEQ ID NO: 158324 - DNA, 534 bp, Homo sapiens
tgtgttcctctgaacgttattacaaaagaaaagaacattgttctctagaaatatgaaagaaaaagaaaagaacaaggtgttactctagcatagttttttctcaattatctgagttgtgaaaaaaaaagtaatgaatagtggagcttcctcaaaacagattctgagcgctgtcagtagttaacagtaactactgtggtggaattcctgtgtggatctattttggcactgtgttacgtaattatttttatcttaggatcagatctgaatcattcaaagccaatgtcttcagggcactggtgtgactccaggtgttctcacatgcctgtctttcttctcagatcactgcccaacactgaatctcaagtgatggacctcagtgcatatgaattcggggcctatatgttttgtaacagcaaatcctaccccactggtgaaaaagtctaataacctgactgattttctattttgatgagccctcaattgagagattatattgtggtagtaggttacacctgcccaccatgtgaaaaacaa

SEQ ID NO: 158325 - DNA, 434 bp, Homo sapiens
gttcaagacgagcatggccaacatggtgaaacaccatctctactaaatatacaaaaattagccaggcatgatggcacacgcctgtaattccagctactcaggaggctgaggcacaagaatcacctaaaccgggaggcggaggttgcagtgagtcgagatcacaccactacactccagcctgggcgacagaatgagactctgtctgaccaaaaacaaacaaacaaaaaaaacaaaaaagtaaactaaaaagtttttagaagaaaacatagaaggaaaaaaatcttcataaccttgagctaaaacagagatgttagaaatgacaccaaaaccatgatccacaaaagaaaaaattggtaaacggaacttcattcacatttttttttctctgcaaaaaaccagttaacaggttgggtccggtggctcacacctataat

SEQ ID NO: 158326 - DNA, 131 bp, Homo sapiens
tcagctccatgtatataatcccacatgttctttgacctatgagcaaggtattaatgcaaaattgactcatctgctattggtttttaccttcctttcagtttgtctcctttaatatatatatgtttgttctt

SEQ ID NO: 158327 - DNA, 628 bp, Homo sapiens
acttggtttcacataatgcctgataatgctgatgtttatcacttctgaacgaaaggtttagatctggctaacaggttcatattatatagaccagacattattactcaaaagccacaatcaggtcaatttcaagttaagatcagatgtgacatttattgccaaaagtgatccatcttttcccgtcattccgatggcttgaagtagccctatcgccagtggaaaaggggcagcagagcctcatggtccccaccctcacgtgggtgcctgggccctcttcccatcatcccaatgcctcgaagtagccccatcgccagtgggaaaggggcaacagagcctcatggtccccaacctcacgtgggtgcctgggccccaccccttaccctttcctcttcccgttttctttacttggccatgttacaattccacatctcttactctctataatctccttcaatagctctgttttgctttttaactgcttttcaacatttcactaaccttttgctgaaaatgaaataaaacttcactcagtggaatattattcagccataaaaaggaagggaaattggcagggcatggtggcacatgcctgtaatcccagcacattgggaggccaaggtaggcagat

SEQ ID NO: 158328 - DNA, 290 bp, Homo sapiens
tgggaaccacttttctagtttataatacaatccacaaacttatgtaaacaagaaaaatgtaatctgtaaaattcccatgtacaggaataccaaatacagtgtgccaaaagtggtaggacaattgaagacttcattgtcaaccctgctgtgttgtgcagctgccacttttccctcagaatgtgtgtgttcacaaggtgtgttgcttttgtagatcaacataagaaatacttactagtaaagtttatttcttatctgtttttaagataagtaaattaacagttcactatttt

SEQ ID NO: 158329 - DNA, 273 bp, Homo sapiens
gtagccgaggtgctaaggagagttatcttaacagggctagtcataatcatgcagcctgagagagagctccaagtgggctgcaggagatcccagtggggagctgtcagccttccaagttctttctgtgccaggtcaccacagggcggcttcattattttgtttgaagtagattcctaagacatcagatgttctcatttgtaagttcataaacacattcccaagccagaagtaaatgacttttacttagccacagctcaatacccctttgtgctt

SEQ ID NO: 158330 - DNA, 609 bp, Homo sapiens
attcttggctgcagtgcaaggaaagcttggactcccagtcaggagacttgaattcaagtcccagctccacacttagatgtgtagcctgggcgaccccttgacctcccacttcccaccttacaccttacctgcccaggtgtaaaacaggaaaaaatgatacttcccatgtggtatacagattttgctctccttatttctaaattgtgttgtccactgcattatcttaaaaagcaaactataaaaacatccgggccgggtgcagtggctcatgccagtaatcccagcactttaggaggccaaagggagcaaattgcttgagcccaggagttcaagaccagcccaggcaacatggtgaaaccctgtctctacaaaaaatgagccaggcttgaggaatgtgcctgtagtcccagctactcaggaggctgagatgggaggatcgattgagccctggagttcgaggctgcagtgaaccaagattgcaccactgcactccagctggggcaacagagcaaaaccttgtttcaaaaaatgaaaaagaacagggaaaaacaaagaaaatatccccccagcacacaggagagggttgctatttgggagagcgaaatccat

SEQ ID NO: 158331 - DNA, 278 bp, Homo sapiens
ggggacacgctaggcgcgtgccctcatccaaggaccttctacaggaattccagggcagaatccatgtggaactcctgctgtgattctccaggggctccccggctcttggaaaggcttctgtgttccaggggtgtgtgtgaaagccctacattgagcgaccccacctttcatccaggcccggagaccttggctgctgcaaccctattgccagcttaccatgggacccagctcttaaggcgagaagggcttgaggcctcttccccacagggcttacagac

SEQ ID NO: 158332 - DNA, 327 bp, Homo sapiens
ggcaacttcaatagctatgtggatggatccactcaaaactcttagctcacaactgattccctgacatcaattccacttccacttgagtcacccacacttttgcacaaaccctgaacctggcgtacccatctcaaaaccttgccctctactgtctgaccacaatttcccttcctgtctatcttttgaccattcactacctgacagctgctctctgaacttggccaggcctctgttcccttaggcctttttcctagagtatatcagccacctcttggcctttccttctgccaatccaggctgaaatccatgattcatcacaaatggatc

SEQ ID NO: 158333 - DNA, 423 bp, Homo sapiens
ttgccagaggctggggagagcagggaatagcaagttattgtttaaggggtacagaatttctgtttgggatgatgaaaaagttcagaaaacagataatggtgatcactgcacaacactgtgaatgtacttaatgctaccaaagttctgcacttcaaaatcattaaaatggcaagttttatgttaggcatattttaccacaataaaaaaatgcaaaagaaaaaagtattttcatgttaattcattaaagttaggaattctctctagtctgaaattcatgcaaacaaatatgctcttaaaattggaccaggggagcactggctttggtcatctgatcactgattcaaatccagtgtttactcttcctaactacggagtcttcatacaagttatattctaaacctcagttttctccccgggatacag

SEQ ID NO: 158334 - DNA, 202 bp, Homo sapiens
gggggtgcgccgtcctcgctgaggaaaggagaacgggcagatggctgtaagtgatggctctgtgaagggcctgctgagtgtggtgcggggctggagccgtgggccagccccggacccgtgcctagtgccactggctctagaggcactggtaggtgcagtccatgtcttgcatgccagccgcgcacctcctcgtggcccagag

SEQ ID NO: 158335 - DNA, 418 bp, Homo sapiens
tccaaatagtggttccttcttgaaggaagtattgactgggaagtggcaccagggaattttctttttagaaaaaaattttgtagagatgggggttttgctctgttgaccagtctggtcttgaactcctggactcaagcaaccctcccacctcggcctcccaaagtgctggaattataggcatgagccactgtgcctggctggaactttcttgagtgatagaaatgttctctgtcttgatctgggtggtgttcatgtgggtttctatgtatgaataaaaattcaatgagctgtacatttaagactcgtgtgctttactgcatgttgagtatatgtcagttacaaaagcaaattgataatggcttattcagagaaaggaggaaaggaagaaatggaactggcctcgcagtgccaaagctgg

SEQ ID NO: 158336 - DNA, 180 bp, Homo sapiens
ggttctggccagtgcagtgtccgctacaggagacttgctcatttatggtttacaacacttaaggtttctcttagcaccaacaagagagtgctttcaccttagcttctatagagtgaggagggagaactagctaataaaaacagtgataatagtagctgccattgagtgcttactccatgt

SEQ ID NO: 158337 - DNA, 1166 bp, Homo sapiens
  misc_feature (934)..(934): n is a, c, g, or t
  misc_feature (987)..(987): n is a, c, g, or t
  misc_feature (1061)..(1061): n is a, c, g, or t
  misc_feature (1074)..(1074): n is a, c, g, or t
  misc_feature (1077)..(1077): n is a, c, g, or t
  misc_feature (1144)..(1144): n is a, c, g, or t
cccggtggacggaagtgggtgttggaggctttaaggtagctttaaattcgtgttgtcctgggagctcgcccttttcggctggagtcgggctttacggcgccggatggctctggacgtgaagtctcgggcaaagcgttatgagaagctggacttccttggggagggacagtttgccaccgtttacaaggccagagataagaataccaaccaaattgtcgccattaagaaagtcccactctgtcgcacaggctggagtgcagtggcgtgatctcggctcactgcaacctccacctcccctaggctcaagcagttctcctgccgcagctctcaactgctgacctcaactgatctgcccaccatcggcctcccaaagtgctgggattacaggcttgagccaccacacccagcctgcaacttgtaattctgagtcaacattatttccgaaatcctctatatcagacaaggtttcactttgattgtccagtctggtgtcgaactcctggccttaagcaatcctccagcatcggcctcccagggagctgggattacaggagtctctgctggtagccactacagctgtgaatgtgctgtgtcatacctgaagccaatatgtctcggagttcacctgaggcccatgatcaaacttggacatagatcagaagctaaagatggtataaatagaaccgccttaagagagataaaattattacaggagctaagtcatccaaatataattggtctccttgatgcttttggacataaatctaatattagccttgtctttgattttatggaaactgatctagaggttataataaaggataatagtcttgtgctgacaccatcacacatcaaagcctacatgttgatgactcttcaaggattagaatatttacatcaacattggatcctacatagggatctgaaaccaaancaacttgttgctagatgaaaatggagttctaaaactggcagatttggctggcnaaatcttttgggagcccaatagagcttatacacatcaggttgtaacccaggtggtatcggcgcccgagttactnatttggaggctanggntgtatgggggcggtgttgggcctgttgggcgggggcggatattagcgaaggtactccaagggtcctnttgcgcgggattcagggcgaga

SEQ ID NO: 158338 - DNA, 704 bp, Homo sapiens
  misc_feature (472)..(472): n is a, c, g, or t
  misc_feature (525)..(525): n is a, c, g, or t
  misc_feature (599)..(599): n is a, c, g, or t
  misc_feature (612)..(612): n is a, c, g, or t
  misc_feature (615)..(615): n is a, c, g, or t
  misc_feature (682)..(682): n is a, c, g, or t
cccggtggacggaagtgggtgttggaggctttaaggtagctttaaattcgtgttgtcctgggagctcgcccttttcggctggagtcgggctttacggcgccggatggctctggacgtgaagtctcgggcaaagcgttatgagaagctggacttccttggggagggacagtttgccaccgtttacaaggccagagataagaataccaaccaaattgtcgccattaagaaaatcaaacttggacatagatcagaagctaaagatggtataaatagaaccgccttaagagagattggacataaatctaatattagccttgtctttgattttatggaaactgatctagaggttataataaaggataatagtcttgtgctgacaccatcacacatcaaagcctacatgttgatgactcttcaaggattagaatatttacatcaacattggatcctacatagggatctgaaaccaaancaacttgttgctagatgaaaatggagttctaaaactggcagatttggctggcnaaatcttttgggagcccaatagagcttatacacatcaggttgtaacccaggtggtatcggcgcccgagttactnatttggaggctanggntgtatgggggcggtgttgggcctgttgggcgggggcggatattagcgaaggtactccaagggtcctnttgcgcgggattcagggcgaga

SEQ ID NO: 158339 - DNA, 758 bp, Homo sapiens
  misc_feature (526)..(526): n is a, c, g, or t
  misc_feature (579)..(579): n is a, c, g, or t
  misc_feature (653)..(653): n is a, c, g, or t
  misc_feature (666)..(666): n is a, c, g, or t
  misc_feature (669)..(669): n is a, c, g, or t
  misc_feature (736)..(736): n is a, c, g, or t
cccggtggacggaagtgggtgttggaggctttaaggtagctttaaattcgtgttgtcctgggagctcgcccttttcggctggagtcgggctttacggcgccggatggctctggacgtgaagtctcgggcaaagcgttatgagaagctggacttccttggggagggacagtttgccaccgtttacaaggccagagataagaataccaaccaaattgtcgccattaagaaaatcaaacttggacatagatcagaagctaaagatggtataaatagaaccgccttaagagagataaaattattacaggagctaagtcatccaaatataattggtctccttgatgcttttggacataaatctaatattagccttgtctttgattttatggaaactgatctagaggttataataaaggataatagtcttgtgctgacaccatcacacatcaaagcctacatgttgatgactcttcaaggattagaatatttacatcaacattggatcctacatagggatctgaaaccaaancaacttgttgctagatgaaaatggagttctaaaactggcagatttggctggcnaaatcttttgggagcccaatagagcttatacacatcaggttgtaacccaggtggtatcggcgcccgagttactnatttggaggctanggntgtatgggggcggtgttgggcctgttgggcgggggcggatattagcgaaggtactccaagggtcctnttgcgcgggattcagggcgaga

SEQ ID NO: 158340 - DNA, 651 bp, Homo sapiens
tatctgtgggaatccattctgaagaaggattaaagtaagtctattttccccaaatgatcaataaccacccagacctaatcactatctctgattacatgatgaaaaagattctggaagcagcacagcaaaaatatgacaatgacagagaactcaaaggtgaccctgtactcaccatctccatgcagacatcacaagtgcagggatgagtaagccctttagttggagatctatgttgctaataacaagacattctgagttttcttcttcttagtgagagagccttccatgaccattttcccatagtttgcctttattcgtttctaagaaactatttttccagttttgaccatggtgctgtaacccacagaggcaccgttacactgaaactatgcaaccctatctgttaagtattatccaacgcccacttgggttttcactggctcatttagagaagcacctttgagtacaatatccaattaaacagtaggtttacatggagtgcttcctgctcgtgttaaaaatctcattctggccgggcgcggtggctcacgcctgtaatcccagcactttgggagcccgaggcaggttgatcacgaggtcaggagatcaagaccatcctggctactacggtgaaaccccgtctctactaaa

SEQ ID NO: 158341 - DNA, 467 bp, Homo sapiens
cagataaatcccagaaacactgccacataaagattcaattgagagctgtctctgaccaatagcttcttctctcatcttctctctctacctccatccaagacttcttatagaaagacaatcctgaaatggactattttcaatgaagtaatgttaggatgtcttcagagaccaatttgtttcacttattaaaagtggaaaagaaataaaatcctaactaaatttcctaacacccaaaccatgcagccagaaagctcatgaaattttctgtggttcccactgaaacctccagccaagtcttcgagaacaatctcaggcctccacaggtaggtcaaccaaccttaaggaactatgagaagaaagtctaatttaaaagaactgggaagaagtattacatttccatggtttttataagccaataccattgttaactccctaggcccaaacactcaccactcctgagactttta

SEQ ID NO: 158342 - DNA, 367 bp, Homo sapiens
ttggtttccctacttcaaaatgtagcatttgccttcttcatgaccaaaagtaaacatgtttgtaaagctatttatcattactattaaagcttgacaaaaccagtgaatttggcaaatcagtgattcagcaaattggctttcaacacattttgttgatgattttatgtcaattgactattcaatacatttatattttctcaaactgaatttcagctacttgtctgcttctttcacatcacaaaacttatttcactaaattgtaacaatacagaataactaacatttattatgtttttaatttgtgccacttttaagctaactgctggccgggcctggtggctcatgcctgtaatcccagcattttggg

SEQ ID NO: 158343 - DNA, 107 bp, Homo sapiens
attcacctatttcctatttctcagcactaaaaagtctgacaattttacttcctgacaaatgtctttcttaaaaggaattataaaattttatatagatctatatttat

SEQ ID NO: 158344 - DNA, 471 bp, Homo sapiens
gcactttgggaggcctaggtgggcggatcacttgaggtcaggagttcaagatcagcctggccaacatggtgaaaccctgtctctactaaaatacaaaaagtagccgggcattatagcgggtgcctgtaatcccagctactcgggaggctgagagaggagaatcgcttgtacccaggaggtagaggttgcggggagcagagatcacaccactgcactccagcctgggcaatagaacgagtctccatctcagaatgaaatgacatgacatgatgaaatgaaataatgaaattaataatgaaatgtgggtggcgcactccagcctgggtgatagagtgagtctctgtcatgaaatgaaatgggaaatgaaatatgaaatgaataatgaaatgctgggtgcactccagcctgggtgttagagcgagtctacgtcatgaaattgaaaaatgaaatgaaatagatgaaatgaaaaaa

SEQ ID NO: 158345 - DNA, 493 bp, Homo sapiens
aatcatctctcctctactattagtgacacagtttctcattcatatctcccttatgtcacccattagcttgtataacaattttgtgaacacactcacttggatagtctctgtaggtctaaagcttcttacagagaagatcctagtgtgtttcacttttgcatatagtacccacaactcttgcttatagcacccactcacctaggattcagaaatgaaccagtttgttcatatatttccaagttattagccagtaaagttagaactctctaatttctcataatcaaatgttaactttttgttcatcctttttgttagatgcagttgagatggagacgatattatttttgttaggatacacagctgaactgttaggataaacagtgtaactgtcacccacttgaagatattttaaattaattatatactagtagacgtatttgacataaagtgtaaaacaatgtaaaacatcaaataaataaaatttttcttctaa

SEQ ID NO: 158346 - DNA, 417 bp, Homo sapiens
  misc_feature (378)..(378): n is a, c, g, or t
aagttctcgtattacttttacactatttttttttaaactgcatcctttcgaaaatttcaacttttattttagattcaggggtacatatacaggtttgttacctaggtataatattgcatgatgctaaggtttgggtcactcagatagtgaacatagtacccagtagacaagtttttcagtccttgtctccctccctctctcctgtcaatagacacctgtagtccccactatcaattgttcccatctgtatgtccctgtgtacccaatgtttagcttccacttatgagaacatgctatatttggttttctgtttctgcattaatatcttaggataatggcctccagcttgcatccacgttgctgcaaatgacatggttngtcgacgcggccgcgaatttagtagtagtaggcggccgc

SEQ ID NO: 158347 - DNA, 232 bp, Homo sapiens
agactccacaggcgtgatcctgagccagagctaccctggaagctatccccagttccagacctgctcttggctggtgagagtggagcccgactataacatctccctcacagtggagtacttcctcagcgagaagcaatatgatgagtttgagatttttgatggtccatcaggacagagtcctctgctgaaagccctcagtgggaattactcagctcccctgattgtcaccagc

SEQ ID NO: 158348 - DNA, 415 bp, Homo sapiens
gagggggatgtgcaggcacagatttattatgcaacatctgagaagccagatgaccgtatttctggagggttcaccagagactgctttgactagtggggggtctaggcatcaatgggcaatcggcatggccgtcctctgaggccagggtagaagagggcaaataggactggagccgggctcggaaaggtcagcaggagataggattccagagagcagaggttcggttgatgtgactgtcagaacaggagcaaggccagagtggctgccagggatcctgggcgcacaggagtctctggtgaatgctagtagaccacggtattcccaggggccacggaagccccaacactgcttgactgcgctaagcaaagaaagatcaaaaacaaaaaacgagcgaacaggacagtaatggcagctg

SEQ ID NO: 158349 - DNA, 156 bp, Homo sapiens
gctttagtaggggaactaacaaaggcagatagacttctaagctagcattctgtactttggctggaatattccacaagctcatggctttgggccataagcccaaaggagtcatttcccaacttcagtattttgaaacattagatatcctgtttcctt

SEQ ID NO: 158350 - DNA, 345 bp, Homo sapiens
aaaaaaaagaagataccctgggtaaaagagaaggagagcgagtccttcttgtgtgcttttgacccctctactgaagaaatgctaaatagtaggaacagcaacccaaccactgagggttttgaatatatacttcaaaattctaagggaaaaaccttcatgcttatagttgaatttataagggtgagtgatgtggaaaagagcgttgggaagcagcgcctgtttgtgttctagtctggggacttggtctcgtttggaacaagcagcagtttgcaaaggcctaagcctagtgcttcactttgacttagtggttctgtttccttttctccgtagttagaggcacgtgat

SEQ ID NO: 158351 - DNA, 529 bp, Homo sapiens
tctgtcttgttttcctgccaatagaagaactatgataaatttattcatagcagtgtgataagaacttgatcttaatcatacactgtagccctcaaatcgtgtattatgctggcttgtttttggtgtccctagtaatttcatcagattgtgagctccttgggagcagagaccatgtttatttgaaatggtggcagcacagttcctagcaggtgcttgcattttggtagatattcaataattatttttcggcttattaatctttgctctccaaactgccatataaaagaaaacatcgaagaggagtgatgttttacacccaagaatggatccctcctggtagaatttcaaataatgacctggggttccactgcctttcaaatctgtaaagtgttaactaccacctgcattgtttatacagcaagtaggtgatttctagaatgaatcttttcttgagtatgaattaacctcaaagtttagaaggaactatatttcttctgatgagaaagtcaaatggcatcatcaaagtact

SEQ ID NO: 158352 - DNA, 569 bp, Homo sapiens
gcctcccgagtagctaggactacaggcacttgccactacaccccactaatttttgtatttttagtagagacggggtttcaccatgttgaccaggctggttttcaactcctgacctcaggtgatctgcctgcttcagcctcccaaagtgatgggattacaggcatgagccaccacaccccacctaactctgctcataatgcaatgtttcatctgggcaatgccctgcccctttctgagtctcacttttctcacctgaaagaggaggttactgttgatgacagtgaacatttaggctgtgctgagttttacactaagcatactgtctctaactctcccaacactcccacaaggcaggtgctattatccccattttacttttgagaaaattaaggcctaaagaagtgagaaagcttgtccaaaccgctatagctcttgggcaaaggcattagtgaccaatgtgtatttgactccaaagcccaggatgttagccacagtgcagggctactatccttttatacaatctgtcagccttcttccatccgtggcatgtattcatctaattttattaa

SEQ ID NO: 158353 - DNA, 198 bp, Homo sapiens
taggcagcttgtctgtgctccgttttcacagcccacagctataaataataccattaggaaagcacacattgccttagatggaaggcacaaagaaaagcactttctctgatagtttagcaacacattcagatttcatgtttcaaggtaaaaataggcctaacaaatgaattaaatttggaagctgagctgaagtgaaga

SEQ ID NO: 158354 - DNA, 398 bp, Homo sapiens
tgccctccctggtggggagcagctgccccatgcaacaaggcaaggggcccactgagctgataacgtaccgctgtccacggacgacggaggttagcattgtaacacactctctggggcttcaggggtcgcaggcacccctacctggtctggccgaggggaccccacagagcctgctcctgccggcacccaaagcagccagctgggtcctgcactcgctctctcatgaactccatcctacaacaggctgagcgaggcgctccaagtaaacagtacccctgttgcaagtctgatgaaggggtcaagagaaaactcctgcatcatcaagaccctggtttctatcgcctatgctgttcttgagtttcctagtgctttagggaactaatatttattacacaaaa

SEQ ID NO: 158355 - DNA, 544 bp, Homo sapiens
gggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacattgattgatttgcatatgttgaaccagccttgttacagatatttctaaactaagggaaacattgcatcaaacacatatttccttggagactttgcttactaaaggtctatatttaggttactgaattcaaaggttttataagttaattacttgtgtgtaattatataaaatattaataaccagttgagttaaattgtttctgctatttgattttaaggttttctttttcattatttgtggtacaaggtttgtcttgacttacaaatattttcgtggttcaaaagttctgtttctctctgataatactcctttatctcaagttagctttgtc

SEQ ID NO: 158356 - DNA, 561 bp, Homo sapiens
accttatagcagcagctgaggcgactcaggagacagtggagtccctgatgcagaagttcaaggagagtttccgcgctaacacgcccatcgagatcggtcagctgcaaccacccctgcgcagcacatcggcagggaagaggaagcggaggagcaagtctcgaggtaggccctcctggcacatctggccaggaagtcagaaggttgtcctctgattccaaagatgctagggagatctgtgcattcttcccttgcttccctgtgctcataaaacttgtgccactttctccctgataaatccccttggaggctgcagacctatgctccctacacccagagctaacctctctgagccccaggtgcctcaactgagaatgagaatggatagtataaattttacagtgattgagattagcaactatatatggaaagtgtgtagcaccaggacctctgcaaagtagatgttctttaagttgttgccggtcagagagtacaaagtggcagaacattctagtaggagacatcctcagtctgggagccagaaacaggggtctgcgcctactt

SEQ ID NO: 158357 - DNA, 576 bp, Homo sapiens
gcatgttaatgtattattaaatatcagtgggaatagtctgcatgctatttcacatctcaggcacacttaaggaagaccttgtgatgtgcatgttgctcatttaatctagaaaggataccaagattcatttagaacttctttatgcacagtttttttttgagtatgttatgtcctgaggcattaagggtattactaaagcaagcagcgggacttctcagagaaattaaaggtttcatatcaaccacacgttgtcaaaatcttcactttgaataggattaaatgatgtttcatcagtattcttggcacacatgacattgtttttaaaataacagttttattactcttggctgtgacagtttctcagactttccttaatatcatacaattctccaatttaaactgtatagtcagttttacaatattttaattaccctgtattcattagcactttcctcattttctactacctcctccccagctgcccctaccctaggcaatgccaaatctactttctgtctatatatttgcctattcttgaaatttcaaataaatggaatcgtataatatgtggccttt

SEQ ID NO: 158358 - DNA, 260 bp, Homo sapiens
tactggtaatcaagaattattatacaatctacttatttattcaggtgcctaataaaatagtttagattcttaggggttttagtattttcttcctacttctgtacctattacattgctcatgagcaaaggcttgcaaacaaaatgcatttactaaaaccatattatattttatatatcagcagttcccttttagaatataatccatttgtaattcaactgtttggaactcagaattcattttcccttaaaaacaatgttgt

SEQ ID NO: 158359 - DNA, 457 bp, Homo sapiens
aatgatttctactcatcagtgaattttctggaagcctaaaaattgatttttaaaatccagccaatgttagtttgttttattcccaacaaggttttacttgctgggatactgaaaccactgagctgctcctagtccagtggtacaatgttaaaatgtaaaacactttgcaaaacatgtttatgtatatttttatttaagtattctaataactttatgagataatatgacaggtaggatttttattgtaactcaaattaagtgatggtagttggacttgaacttaccatttccgatgcctagtttagttctttttataatagtttcatagtgtttttccaacacacaatttaatatctaggtatacttcatttatgcagcagatttattgctgaaaaagtcatgtgcaaataagtgtttagaacaagtgttattttaaatgtgactagagtggctttct

SEQ ID NO: 158360 - DNA, 305 bp, Homo sapiens
agggaccaggcaccaagcctggccgagttgaccgataaaaccatcacagtgagggattggtacccagagacatcacctctcatgctgaaggtctgaccggtaaactgtctgggttccctgtctccagtagtccttctctctcttcggtagctgcatgacatgatgcaggaaacttgaggctgtggtgtttcatgcagagatttttgatacaaggtcttttacctgggggcaagtgcctgttgaagaaatgacattggtgagatgatgaaggaagggaagtcacatgtattgctgcagctgctccc

SEQ ID NO: 158361 - DNA, 373 bp, Homo sapiens
aaatcctgtggactgataagaatgctcgggagagcatcagacactgagccaaacacagaaaaaaatcaaagaccaaattctgttttccacgcactccttcaatcaacagatatttatggagcaccaaacctactcccaacactatgttcataagctcaaaaccaagatgggctctgatctcgtgggcttattgacaaatgatgcatacaaacaaggtgatgtgatagaagtttcaaaacggatgtcatgagggcacatatgagggacatctcatccagatttgaggagttcaagaaaagaccccagggagataagacctaggaaagagccatcagctgggataagagagatagaaggagtgtttcagggagtg

SEQ ID NO: 158362 - DNA, 422 bp, Homo sapiens
aagctgctctgactagctgtgtccccactttgagagaggccttctatagcgcaccagctaagcaatcaacccagagtagaggagggaaggtggaggcatgaaagacaggaattcacccactaaacggggagtggggtggagacagcggacccaatgcagaggaactgcaggggctaaaggaacacaggggaacagcagaagccaggagaggcaaagcccaagctgaatgtgagagggtaggctgggggcagacggtgaaaactcagttgcacaaacaggaatcaggcccagctcggtgcaaagtgctggaacagcggaggataccgaggtgagcagagcctggcccagtagcctgcctcagtttgaatcccatctctgactctccccatgtgggtggctcccagccagttactctgtctccc

SEQ ID NO: 158363 - DNA, 398 bp, Homo sapiens
  misc_feature (60)..(60): n is a, c, g, or t
  misc_feature (62)..(62): n is a, c, g, or t
  misc_feature (66)..(66): n is a, c, g, or t
  misc_feature (70)..(70): n is a, c, g, or t
  misc_feature (82)..(82): n is a, c, g, or t
gtccgaagtgcggtacgttggggagaggggtgtatagggaaccacatctttgggggaaancnatgnatcnggagaggacttngtttctctggacatttatccagaagaaagaaaagtcaagggtgacaaggacagaaccatcaaccagccagagctatagtcatgggccatgtgtgggccagacccagcctatagacatgctgtttggcctacacaagattcccaacggtgaccggcgacttcgaagtcgccggtcaccgttgggtgggggatggtctctcagcattttctctcagtgctgaaaagattccattactttatgtctggtctttttcagaaccttttaaagtcaaatggactccccatatggggtgattaccagttttcttttcttcttc

SEQ ID NO: 158364 - DNA, 431 bp, Homo sapiens
cagcagctacgtctggctccagccctacagccagggctggccagactctagccaacacttcttgagggacttggctcactccttttagtctccccagctgcacccaagtcgatatctctccactccaacaccccctgccatccctcactgcagtactgctggagggctgagacctgtcagggtccttgaaggaagagacatcagattcttccaaacagccctgggttcctcaggctgttcacagccaacctagagactcacctcaaatggacagaggagaagaagaaataacaggaagcagaattggccaatcttccctggatagcaacgggagcagcatggggaagaggaaccccccacccccaccgaaacatatgagcagagagaggcgaccactgtgtggccagaggtaggatcccataggtacctcc

SEQ ID NO: 158365 - DNA, 639 bp, Homo sapiens
ataaatgatggatagctctctgaagcatgttagggatttgggctcagtccaaaagacagtggaaagccattgaaggctattattattaatttattttattttattttattttttcgatagagtctccttcccaggctggagtgcagtggcaatcttggctcactgcaacctccgcctcccaggttcaaggaattcttgtgcctcagcctcctgagtagccgggattagaggcatgtgccaccacgcccagccagttttttgtatttttagtagaaacagggtgttaccatgttggccaggctggtctctaactctgggtctgaagtgatccacccgccttggccttccagagtgctgggattacaggcgtacacaccatcacacccagctaatttttgtgtttttagtagaaacagtgtcaaccttgttggccaggctggtttggtactcctggcctcaagtgatctgcccgccttggcctcccagagtgctgggattactggcatgagccaccatgcatagccaccattgaagggttttaagcagaggagtgataaaatacttgccctttggaaaaaaatcattctggcgtccacattcagactggtttagaggagagtaatactgaagacatgcccc

SEQ ID NO: 158366 - DNA, 592 bp, Homo sapiens
attcctgtgtttcaacagagggtggagcacagaaggcatggggtgtttggagatagccagaagccaaaggcaggaggcaaagggcagtgaaatcaccactactgagtgatgtacagggtacaggccagcaccttactttatacagattacctcagtgaagcctcacaacaaccttatggacgaggtgaaaggagccaactggggacaactctgatccttataacccccaaatcttagaaaaacgaggctgtccagtgagagtccaactataaaaccaacagggcatgttagagacacagcctccttaaggaggcttaaagatggttgggcacagtggctcacacctataatcccagcactttgggaggccgaggcaggcggatcccctgaggtcaggagatggagaccagcctgaccaatatggtgaaaccccatctctactaaaatgacaaaaattagctggacatggtgacaggcacctatagctgagatccattgtgagtgccattgcactctagcctgggcgacagagtgagactccatctcaaaaaataataattaaaataaaggtcgattaaaaacaaaagagaca

SEQ ID NO: 158367 - DNA, 249 bp, Homo sapiens
atattttgtcagtaaatacttcagaacaattgccatggggtgccactgaaggacaaataaaggatggatcttcaagggaggtgcattatccattgaaacaagaagagagatttttgtagtttgttcagtaggccaagttctggctgggccccatgtgggcatgagagacccagactcccagccccacctgcggcaggaaagctggtactataatatgtggcttaaaagtgtaaattgtccccaaaagcc

SEQ ID NO: 158368 - DNA, 113 bp, Homo sapiens
acctattgaagaaaccacactggctgagaaattgggcatgtcagaggtgtcaagggttggcagaggaattatgaccagaggaacttccattcctgcttggcattcagtaaatt

SEQ ID NO: 158369 - DNA, 453 bp, Homo sapiens
cccagatacttccagtgtcacttcttagaacaattgtgaggataaaatgaagatgggtggtttattgtctacttgtcctcattggcgagccactttcctgagtccccacaactttcctggctcattgaggccatcccatggattacttaacatacttcttcataaactcagagtgggaactacagattaaattaccttagcattttggcaagagcccagagcctggaaattagtatgtgaatgtaatgtgagcccttaagccttcagtgcaagtgatgtctctagggagagccctcagcgtttttcaggggaaatcagaatccttcatcagttccagtagggaagagctgaagcttacagatttaacagaaggcggtagcccaaggaaacctgttccagtgtgagtggaaggaatgtgctgagcagagccggctaatggtgcctcttggtggc

SEQ ID NO: 158370 - DNA, 579 bp, Homo sapiens
cagggatgctgttgtcttgtgctttgagacacccagggaggaggagagtatttgaaagcccactcatccttgggtaatgcccaggggatattaagtggccatcaatacgttagacgtaggctgaaaggagatcagaacaagtccagggtttggagtagcagaagctaaacatggtccaagagtgtccttcactcccagctggctggttagtggaccgacctctggatttgagttaggggatggaattctcatcctggctctgccaactactggccaggtggctttggacaagggattgaacctctctgtgccctagttttctcatctgcaaaatgtgagtaatattctaataagtgaggatgagaaagagaatgtgagggtactttttcaatataagatttggaaggatgttcacacaggtgatggacttgtgggggttcatcctgtgttttttgcttgtctgttatatctggttgtgtatgagagatggcaaggagacagacagagagggattaatagatattgctttagtaatcactcaaatgacaaagttattccataaaatgaaaaaatataaca

SEQ ID NO: 158371 - DNA, 511 bp, Homo sapiens
atgagtcaccacccacagtttaaacagcactgaatcatagctagaaggatggaggccaccattcgaacctaaatagtagggctccggagcctaacctctccatataaaggatggcttgggaaaggagagagaccccgaagtcttgaggacagatggacactgtgctgctgaggagactggaggcctcaagaatcccactgccctgcatcactcccttcccacattccagcaaaagatcatacaaaattcactaatattgcctttggaaaacaaacttgttggcgtagacacacggttgttcttttactttgtcttcacatcagcctatgaaggaagtaagaaggactgagaaactgactcacgcagtttaagtgatttgacaaaggtcacagagcccagtgtcctgttgcctggtccagggagtttttgatcccatcctgagctcacccttgcagataacaatggtgagggtggagctggtggtagagagaatgggatgacagtggtaacg

SEQ ID NO: 158372 - DNA, 288 bp, Homo sapiens
attcagaggagatattcagccatggatcatactctgaaagaacttataatctaataacagagttaagattcatttacaaataagtctaatacaagagacaaagtgatgagagatgtagcaaatcatatgcagaatgagaggtggcagggacaacttctagataggaaggactccagaacgatttctcagagaaggcagtacttggctttcacactcagaaatgaagagggtggaccttcgatgtgatgaagcagaatcattacagacacagaggatgggaagcaaagg

SEQ ID NO: 158373 - DNA, 353 bp, Homo sapiens
gggtgtgtgcacacttgcaggggtgtgggggttgcattgtgtgtgcacacgtggacacatgtgagtgcacttgtgtggctgcatgtgagtgcgggtgtatgtgtgcgcgggtgtgtgggtgcatgtgtgtgtgggtatatgcatgtgtgggtgcatgtgagtgggtatatgcatgtgtgggtgcatgtgagtgggtatatgcatgtgtgggtgcatgtgagtgcaggtgtatgcatgtgtaggtgtgtgtgtaggtgcatgtgtctgtgtatttgggtgtgtgcatgtgtgcaggggtgcactgatgcatgtgtgcatgtgtgtggggcctcgtgtgggtgcatatgtgtagg

SEQ ID NO: 158374 - DNA, 381 bp, Homo sapiens
gagcaacctaaaagaaaaatcataggcgattcacaggaaaggacggctaacgaacatattaaaagatgctcaggttcatgaaaattcagaaaaatacaatctaaaacactgagatactacttttgaccatcatgttaacaaaaatttatatggttggtaataccaattgtttataagaaattgaggctgggcacagtggctcatgcctataatcccagcactttgggaggccgaaacagaggattgcttgaggtcaggagtttaggaccagcttgggcaacatagcaagactccatctttacaaaaattttaaaagtgaaaaaatcagcctggcatggtggtgagcacttgtagtcccagctacctaggaggctaaggtca

SEQ ID NO: 158375 - DNA, 428 bp, Homo sapiens
tggtgaaaccctgtctctactaaaaatacaaaaaaattagctgggcgtggtggcgggtgcctgtcccagctactcaggaggctgaggcaggagaatcacttgaacccgggaggcggaggttgcagtgagctgcgatcatgccactgcactccagcctgggcgacagagcgagactccgtctcaagaaataaataaataaatagataaataaataaataaataagacttctctcatgaggtgatggaatgccttagagatctgctatttccaaaccaccaggaccagccccagtgagccaaatccttaatgcttacatctttcctcttcctacaacacatggacgggggcatgtgagtaaccaaggaagccaggcccaaagagaaacttcctggtgccaggatcattttgggtgagccacttgtttttt

SEQ ID NO: 158376 - DNA, 1037 bp, Homo sapiens
cggcccaggaccatttgttaaactccccatcctctcatcaaattgacttgatactttgttcaaaacaagttgattgcatatgtggatctatttctggattttctcttttattctactgatctctttgttgatctttatgctcataacacactttcttgactactgtagctttataataaatcttgaaattaggtagtaacaaaaaaacaaacccaaacaaaaaacaaaaacacaaaaacaaaaaaacaacaaaaaacaacaaacaacaaacccaaacacaccaaacaaacaacaacacacacacacccacacaaccacacacacacacacaacacacaacccaacccccccccccaccccacccaaccacgcgagcgcgctgtggcgcggcggcgagcgacgactataacttcttgagcgactcgccgacttgactgcgaagccgtagtgtggacggcgcgttgactgtgtctgttcgcgggtcagtcgggcgagctactcgacggcggcgagaggaagcgcgcacgaggggcgggcgcactcgcggatcgccgaaacagggggaacgagggggccaaggcaagcgaaaggagagagagggaagaagaaaggaaggcgggcgcgcgagcatgggagaacgatccacaccaccgtctgcctagagggcgcgagccaacctgccgatgagtcggcgataggcgtacggcgtagcgcgagtagaagcgtagagcggggctctacgaggcgcaagaggccatagccgaccgagtggtgcgaacgaccagcgatacatagtagagacttgagtgcggtgcgaagcccctcagcagcgcgcagtgccatggtcagatctggagcaagaagtgcagacgagcagggggatagctagacaggagaggaggagaacgagcacgtagtcagggtgagagcagtagcgaggtagcggcgttgtaggagaaggcaggacgaagctcgtagtagtacacgcggcaaagcgcgcgggcagtgattcgatcaccagaccgagtgagcgagcg

SEQ ID NO: 158377 - DNA, 646 bp, Homo sapiens
tcttctctttggttggcaggcatttgaagaatgaggatatttaataacgccctctataacctttcaggtagcctcttattttttggtttcaagtaatcagaaagacttagcctcaaagaaaaaaatgttgtgtttatttagctttttgtttaaggactatcccaaggaaagggtgggttgatagcctttttaatctagggtttgttgaactcaattaagtccagtgtccaggtagaacaggtggtttatctaagaaaaatgacaaattttgctgacatttttgaggtcacccttgcagccatgaataaagtggctcatagtaccaatatgagttacaataagaagttacttaacctctctgtgcctcagttttctaatctataaattagggaccctttctgtttgaggggcatggcacatttaggagccaggactagacttgcgtctccaggatggtcatatctcactctccatttagctatggagtgggggagagactgccaatctaaggcttaagggaagtcactctggctgtctagcatcttatctcccttaaatcccatccttgtctcttgactctacaactggcctccttctgacaccctcatcgtcttatgtgggctcaggttggcatcaatgtctgttg

SEQ ID NO: 158378 - DNA, 608 bp, Homo sapiens
acaggtgcctgccaccatgcccagctaagtttttgtatttttagtagagatggggttttgccatgttggccaggctggtctagaactcctgacctcaggtgatccacccacgtcagcctctcaaagtgctgggattacaggcgggagccattgcgcctggcctgcttcaattttttttgcttgatgtcatgtttttcttcatttgccaggcaggtgttgttttctttctagaagttgttctttgtccttggttctgaaaaattcatttatcttgctagttatttcttaaattctttgtttcctttttattcatagtttttttttaatgatctctttcatttgctactttgcttaaaatgtttgatgattattagttcatatttaagaatgaggcaataaaaagttgtttgagagttaggtgtatgtgagcagtgcttattgaacggctgtcaatgttctaggaccctgaaaagccaaatatcttttggtgccagaacccatattagctccttatttgtgtttgagagaatctacctttcctttttgtttcggtgtcgttgttatgtttatgtgtttgcttatattcatgtagacaactgtgcattcaa

SEQ ID NO: 158379 - DNA, 614 bp, Homo sapiens
acaggtgcctgccaccatgcccagctaagtttttgtatttttagtagagatggggttttgccatgttggccaggctggtctagaactcctgacctcaggtgatccacccacgtcagcctctcaaagtgctgggattacaggcgggagccattgcgcctggcctgcttcaattttttttgcttgatgtcatgtttttcttcatttgccaggcaggtgttgttttctttctagaagttgttctttgtccttggttctgaaaaattcatttatcttgctagttatttcttaaattctttgtttcctttttattcatagtttttttttaatgatctctttcatttgctactttgcttaaaatgtttgatgattattagttcatatttaagaatgaggcaataaaaagttgtttgagagttaggtgtatgtgagcagtgcttattgaacggctgtcaatgttctaggaccctgaaaagccaaatatcttttggtgccagaacccatattagctccttatttgtgtttgagagaatctacctttcctttttgtctctagaacgtggcccgcacatccgtactgcccggggagtccgtctagagcgacctcgcaagttgga

SEQ ID NO: 158380 - DNA, 623 bp, Homo sapiens
taactatatgtgaccacactggataggccctaggtctgcctggggtcacgcaggaaaaataagtattcccagacagatcattatcatgctgtactctggaaactttgttcatctcttgtcttaaataaattcttatgtgaaaaccaacacataaaggtagagacgtttcagctgaaacgaaagtctgcagtctgctgtggtaggcatcagaatccttgaagacaaggcgaatacagcatcaccccctggacaaggtcactatgccccacggacagggtgcctgtgtcccacagacaggactcctatgccccatggacagggtgcctgtgtcccacggacagggctcctatgccccatggacagagtgcctgtgttccatggacagggcacccatgcctcatggacaaggcacatatgccccatggcattgacatcttatttccccaaaggcggtccgggtttgcctacctgggcgtatggcactgggggtggtgggtaagccggttggtgcatcagggcaatcctcaagcctttcgggctcaggggagtcaggctccaggtaggagtcatcctcatcgtcgtgctcatagtcttcattgtccgtggggaacgggaaaggctgt

SEQ ID NO: 158381 - DNA, 756 bp, Homo sapiens
ctcaacctcccgcctcggcctcccaaagtgtggggagtataggcgtgagcccccgcgcccggccaaaaaatgcccgtcttaagaacaacaaaacagcctccttcaccctcgctatcctccagttacctcctcctcggctccggtttgcagccaaaggccttagtctaccctcactaatgccttttctcctccaagtcttgaacccttgagcctctagtcaggctttggtctccaccactccactaaaaaggcttcttgtcaaagccaccagtgatctctaggtggccaaattcattgttaagttaggtctcagtcctgttcagcatttgatgctgtggatcactgcccctccttgaaacactgttttcatttggcttgctgaacgttctcttcctttgcctctgctctctctggcttctcctctgctgattctaacctaggcatcatctcacatttttgtttttattagagacacgttctctgttgctcagactggagaacagtggtgctattacagctcactgcagcctcaaactcttgggcttaagcagtcctcctaaccaaagcctccccaaatgctggaattacaggcatgagccaccgcaatcccagtttcacattttaaatgtaaatactggccaggcgcggtggctcatgcgtgtaatcctagcactttgggaggccgaggtgggcagactgcctgagctcaggggtttgagaccagcccgagcaacgtggtgaaatccagtctcttct

SEQ ID NO: 158382 - DNA, 787 bp, Homo sapiens
tcatgggcaaggccgcaggtgctatatcccaagtgtatactgcttttatttttacatgtacaaaatattagaataataaatatatggtaaggcttctagaaatgaaaactgttgtcaatctgtaatttatagaaaatttatgtaagaaaacttatgttgtcttttaagcaattctcctgcataataacttagtttagagtaagaaatatgcatcttatctaaactgatttatagaccacatgctatttttacaaatatttaagaaaattcctagataaactttggaaccaaaaacaatgtagcctaataacaatgtcaactatacttacagtataattttatatataaccttttatctttataataataaatactatcacagccatttagagaaggcaattttagtttacctctattgcttaaaggctttagctattatttatgcacaacaagaattctgactttttaaaattagttttaaaattttggatcagctttataaagaaacacattgttgttaagtgcagacaaatgagaaccttgccatttctgcatttatgaccagaagccaacagagtcaattttcatgtttatttattctttgctttagaatgttatgtcagttgacagtattcagggcttgtgttgatgtaaattgccataaagcaaggaaacacgggctatagtactgtcagggaggctcagcactgcagaacaacacaatttaagaaaagcatttgcagaaagattcagtgtcagtcttcggaagttgactgtagatgcaaat

SEQ ID NO: 158383 - DNA, 180 bp, Homo sapiens
taacacaatacaactgtaatgccaatcctgtaaggcaaaggggcttagatctaaacccaaagattggcttcaggtagtcagtcacgtggaaccttcaaaactagatgccagtgttttatatatgtctatattttctacactacaaatcttcagtgctcagattctccgaaatgttctttt

SEQ ID NO: 158384 - DNA, 653 bp, Homo sapiens
aaactcccgacctcaggtgatctgcctgcttcggcctcccaaagtgctgggattacaggcgtgagccaccacgcccggctatttttttttgagatggagtttcactcttgttgcccaggctggagtggagtggtgcaatctcagctcactgctacctccgcctcctgggttcaagtaattctcttgcctcagcctcccgagttgctgggattataccggctaattttttgtatttttggtagagatggggtgttaccatgttggccaggctggtctcgaactcctgacctcaggtgattcacctgcctcagcctcccaaagtgctgggattacaggtgtgaaccactgcacctggcctgctgtaccctttaaaagagtgtggtcaaccagtgtacctgctattgactgaatgtgtgcacccccaagttaatatgctgaagtacgaacacccaaggtgatggtttgaggtggtgggggtatttgggaggtgactgggttatggcagtggagccctcatgaatggggtttgtgcccagagatctcctgcacctctcccaccatgtcagatgcagagaaaaggcagcatctatggagcaagaagcaggtcctcacagccggccaatctgcgggccgctggtctcggacttccagcc

SEQ ID NO: 158385 - DNA, 275 bp, Homo sapiens
ggacaaaatctgtccatgtattatccatgcattcttttttttttttcattcttattatcagatcccagaataatgaattgctgtttgaaaatgcatggtttatgtttatcttttccagaagcacttttatacgcatctctccctagtactgtttgctctttcagaggctggttttgttcctaagcaattaagatgcttccctgtgttttggaataaatagtagtatctaaatattttgctcttctgtttatttcctataacagatatttacacat

SEQ ID NO: 158386 - DNA, 119 bp, Homo sapiens
ccctgtctcaaacaaaacaaaacaaaaaaatcattctggctactgtgtggaggatggaattagagagaccagttaagaggagtgacagtgtctaggagagaagaagggggctttggtta

SEQ ID NO: 158387 - DNA, 422 bp, Homo sapiens
tactaaaaatacaaaaaattagctgggtgtggtggcaggcacctgtagtcccagctacttggaaggctaaggccaggaaaatggtgtgaaactgggaattggagtttgcagtgagcagaggtcgtgccactgcactccagtctgggcgacagagcgagactcagtctcaaaaaaaaaaaaaaaagaataggtggaattgaattgaggcggtcagtgaacagtcaggaacattggaaggctcatccatgtgatctgacaggaggtggagctcaggcaataatactcactcgcccgcggctcaactcctgctgtgcggcctggttcctaacaggcagcagaccagtactgtccacagcccaggggttgtggacccctaccccaacagacagcaaaaataaaatgctcaaccctattgtagtttg

SEQ ID NO: 158388 - DNA, 248 bp, Homo sapiens
acatggcctgtttccatttcttgttcactaggacttctcatttactaacacacagaatttcctgtagtatgtccacttaatcagttcaagcctaataattccttgatttgggtatagtgctttgcatttatatactgatggtccgagcggacggtccgctcggaccagatctttgtgagcgattcctccaccacggtctgagatcctgatgatcagatcgacatcattgttggcgatggtgatgacca

SEQ ID NO: 158389 - DNA, 441 bp, Homo sapiens
agtaaggaaggatcaggcaacattgaaagaggaatattgccacacagttgccaatctgatgaaaatactgcttatgctaggtcgaattgagactctgaaaggtatttgggagccagacacttatgagaatacatattgctttgaatattggaagaaagcaaagcagtcaaacgaatttcttcttggcttggagttttgtttacttttctcaggttagaattgatagttctaatggttttaagaagtcatggagaacaggcccaccatgaacctgaatatttggttctgagtttatagccattgtctagtaaatactgtttaagggttattagcacacaatgatcataaaatcttgtaatacttttaagaggtgtaagaaattgaagtcacctgagaatacctccttctgattttacagtggagaaataaaggaatcagagt

SEQ ID NO: 158390 - DNA, 288 bp, Homo sapiens
ggagcacatgagaacattgatgtgaggttgtcttgcaagtgccagtgaattaaaagtggattgtctgctgtgagggtcttctcttctttcagatgactagagaataaatgaaatataggaaatgatcagctgaggggtgtgatggagaatgaatgctggtaaggaagtagaaataaagtgagaaggaggatatactaatatttggaacatactgtttgaactttaaaatagggtgatttttgcatttattttgtgtgcattttaaaatacggccttttggttatttat

SEQ ID NO: 158391 - DNA, 426 bp, Homo sapiens
gcttttttgtttgtttgtttgttttgttttttgagatgaagtttcactcttgttgcccagaatggagtacaatggtgtgatcttggctcactgcaacctccatctcccaggttcaagcaattctcctgcctctgcctcccaagtagctgagggaggagaatcgcttgaacccaggaggcggaagttgcagtgagccgagatgcaccattgcactccagcctgggagacaagagcaaaactccgtctcgaaaaaaataaaaataaaaataaataaaaatagcagttgctatctgcttcaaaaaggttatatatttattgtttatgttatgcttcactaagcttcaaattgttatacaatagcactcctaataacaactgtttctggtactccgtactgaaatctctaaggactgtgactcagtgtgg

SEQ ID NO: 158392 - DNA, 235 bp, Homo sapiens
caggtaatgggaaaaactcagaaatttatagtgttttgggaagcaaaagtaggacattttactgatctgcttatttgttaacttacctaatttatctgtttctatagcacatactctgtaccagaccctaatgtccttactttacaaatcttcactcattctattctctcaacaaccttgtgaggtagagagtgtaattttactcattttatacataaggaaattgaagcccaga

SEQ ID NO: 158393 - DNA, 542 bp, Homo sapiens
gtttcctcatctgcacaagggggaaaataatacacactccacagggcttttgcaaggatgaagtgctctattaaagggctttgtgcagtgtctggaacagagtaaatgtgcagtaaatggtagtttaaagaaataaacttctattcacagagtctgattctgttctcctgaaggtggttgactttgtgtgaatgatgacgatggcacccctccctggatcatgccagcagctcctctgaggattttacccattatgttttcctatttgcagcacttccactataagactctgagtgatgactcttgagccccatgactttccattttgtctcttatgacgtcagaaatggacgtgccaatcacacaagagatggcagagtgaggccgggcacaatgtctcatgaatgtaatctcagcactttgggaggccgaggtgggtggatcacaaggtcagaagttcaagaccagcttggtcaacatggtgaaaccccatctctactaaaaatacaaaaaattagccgggtgtggtgatgcacgtctgt

SEQ ID NO: 158394 - DNA, 191 bp, Homo sapiens
tgaacatatctatgacttatatatccacttcaccccctactaacttgcctacaatgttaaaaaaaagaggaattattataacacaggaagatgtttaatactcaggattttttatatcatcatatttaaagtctttttctgcacagctaaatctgattccctgctactaaatctgattgagttagcaacta

SEQ ID NO: 158395 - DNA, 393 bp, Homo sapiens
tgaggcatagagaggtttagaaacttgcccaacattacacagctaaccagtggcagaggcaggattccaaaatgtctggccccagagtccatgctgttaaccactctaccaacagttgttaagcagcacccgcagcatcaggaagctggttagggaagtgaattctcaggccacagcctggatttactgcatcggaaactccagcatgctgcctagcgactggtgtttagtgagctttctgggcgattctgctagatgctcaagtttgagaaccaatgcagcccactctccggcctctcagatgtggatgggtgtattgatacaattcagaacgctgagaagtgttgactttcagctcagcttcccgctctcggatggcagctgtgcatggtg

SEQ ID NO: 158396 - DNA, 393 bp, Homo sapiens
cacagctcattgcagcctctatttcctgggcttaaacgatcctcccacctcaacctcccaaatagctaggactacaggcaaatgccaccatgtcaggttaatttttattttttgtaaagatggggtcttgctatgttgcccaggctggtctcaaactcctgggctcaagcagtcctcctgcttcagcctcctaaagtgctgggattataggcatgagccactgtgcctggcctatagctttaaaaatttccccagtgtataccatcctcactattcccaggcacagttctaagtaattgaagtctactgaggtaggtatcaatattattcccattctctagatgacgaaactggtgcatgtagcagttaggaaatatgcccaaaggtacactg

SEQ ID NO: 158397 - DNA, 694 bp, Homo sapiens
tcccagtgtttcattgaaggttagacaagatcatacaattcaatgagtgtgaccaccagtgcatggcacatttaagtactcaaacaaggcaagttttcttcccttatccatgctccccactttctcccttacttcctcctttaaaaagagttgttttaaatagctatctggattttttttctgcaccacttcaaagtcaatgaaaatcagctttagcttccttctttctcttcttcccctctcataatgggcatggctccggggctgggtctgaggctccgttctcaaccaggaagcacagggctgggctgctcgctgttggtttcggtaacttcttctcccaggaagggccctgctccaggggcttgcagtggcctcccctcacttcagtctgtagataccttgctgtacatatttgctctcccttggcttcctgggtctcactgggtgtgcagctggcttttcttcctgggtgggatttggtgatgataaagcaggcacttgttgagggctgttattacttgggagttttttggtttcaaggcacagaaaccaaacttgaatgagcttaagcaaaaatgggatgcatagcttatgcctctcataccaacactttgggaggctgaggctggaggagcgttcaaggccagcagttcaagatcagcatagtcaatatagcaagagcttgtctcta

SEQ ID NO: 158398 - DNA, 199 bp, Homo sapiens
atgaggatttgtgagtcccacaatgacctaagtcaaaagactaaagacttcagtcttttggtctagcctaaatgaattcagtgtgtggaatgatacgataaccggaatattaacaaaaagttactttgctttctcaaggtaaaattaaaattctaattgaggaattgcacatgtaccccagaacttaaagtataataaa

SEQ ID NO: 158399 - DNA, 363 bp, Homo sapiens
ggaagggcttctatataactgactttccttattctttaaatgtatagtacaaatgaccaagtcagtcatccgggactgaaggtttctttgtgggaagggtgttaactaaaatttcaatttctttaatagatacaggactatttaagctatctatttcttcttcagtaagctgaagtagtttaagtcttttgaagaatttgtctatttcatctcagctgtctaatttattggcataaagttaacaaattcccttattgtactttgaatggctataagatcacagcaatgtcccttttctcatgtccatactaaaaatttgttgcttctttttctcctgatccatttggctaaggggctaccagt

SEQ ID NO: 158400 - DNA, 516 bp, Homo sapiens
gtcaccacgctgtgacggtccagaattatttttaaatgcagtctgctttgccatgtctttgcagcaagtgtgctggaatttccggccttcctaagtgagtctttggaagtcctttgcctgaacgacaaccacctcgacacagtccctccctcggtttgcctactgaagagcttatcagagctctacttgggaaagtaagtacacatctggaggggccgtgctggctctgctggcccagagaggcagaacgcccatccctaaaccaactgggacacagaaagccaggcagaaagaagccatctactttccaagaagcagtagtgagattttcggaacagggcttgatcaaggaggtggggagagaggaagacggagtagcaatgcaatgatacacactttcactacatcacttgggctgtgatgaggagaaccactcaatcattcatcctttcattactgagctcccattgcatgccagctactgccaggggttctaggcagtgtgcaaagcttgat

SEQ ID NO: 158401 - DNA, 447 bp, Homo sapiens
gttggtgtcacagaattacatctgtatgtactctgtgtcctaaaaacataaagtaataattactttaaatgccttaatttctgaaattatgtaggaaaaatttggagttacaaaccaaagttacaatatcattagcttttaggctaatttttttaatgtaatgtttcttaaatgacatagaaatcaaaaggtagagttataaaccactatcgtatttaccattattgagatctttatttcttcatattgcttcaagtctgtctagtgtgttttcatttcactgtgcgagaaggcccctttaagcatttcttacagggaggtctcatggcagcaaactccctcaccatttttttttttttttttttttttaagaaatggtgtcttactcttttggcccaggcgggcatacagtggtacagtcatagctcacttaagtctcaaactccc

SEQ ID NO: 158402 - DNA, 353 bp, Homo sapiens
taataaagtcatacgactccaactgataccagatgctacgctccagctgatccagatgtatatgctcctgctgatccagatgcccagaggccccatcgtccatcctcttcctccccagtcggctgaactctccccttgtctgcactgtatcaaacctctgccgccctccacacctctaaacatctcccctcccacctcaaaataatgacgctgtatcactaaattctttccatttaattgtattgttcaaagctgtcttctttctctcaggtaaacttccatcacctaaatttacattctcttgaatatgctacacaaagttctttattactacatactaaagtaggggatcc

SEQ ID NO: 158403 - DNA, 560 bp, Homo sapiens
tatacgttttcagagttcaaccagtttataaatgcagtagaacaattgtacataacttcaaccagaaaagcaagtctctgaagtcgcttgatctggcatgtacctttttaatccttagcactggcccagataaaatgacatcagtagtctttcactactttgatatatctgctgtaactcacctttcaatggtggtgtcattgaagacaactgatgttattaatctgggtcattgctaaagaatatatctatacacacacacacacatacacacacacgtgaatatatgtatgtgtgtatatatatatatatataggtatatcctttatatatatatttagtatatatagatacctacatacatgtatgtgtgtatatgtatgaacatatctatatacatatatctatatgtgcatatatagatatatacatatctttatgtacatatatgtatctatatagatatattctatagcactgaccccaattaataacatcagtagtcttttatgtatatatactttagcatatagacatgcatgtatatatatagatacgta

SEQ ID NO: 158404 - DNA, 399 bp, Homo sapiens
accagctgtccagagcctcagtctcgctttgctccaattccccatcggctcttccctagtatttcaatcctgggagagacgggataattttcacgccttggatagggcatgaaagcaccagccattggaaaaagggctctctatggcaattcacaactgctgacgaatgcaccaacccggtggggctgaactcctgtgagctgcccccgggagtctgagtatctctagatggaaagaaagggatgccagcactgggaggaccaagggtgcagccttgaccagaacctgcactgaggatggccaggctaggaggtctttggggcacctggcggcctttttcactgttgcgaccttgctctctgtttcttcaaactcctacagctacaattagaccctctc

SEQ ID NO: 158405 - DNA, 171 bp, Homo sapiens
atacaataagagcacaataaatgtgtgacattattaggtctctgccatgaaacaccagcctcaagtgcactctcaaaaccatgtgattgggtcctgaaacaaccagaaaaggttctaaataaagcctttcttttcccttcttctatgctgaagacaggactacagcatact

SEQ ID NO: 158406 - DNA, 469 bp, Homo sapiens
agagctttatttttagatttcccctctccgcctatcctgtgttagagttctctctgcctgggcagggggagtgggacattggctcccgatatggagcactcttccctggctcaggcaagggaattaaagggatacacttagcttaactctggggcgagggtggagaccatgactgtgtctagtgaatcagtttatataatctgcccgtaaccttctctagataaattatctgtatcctctgaggaaagtagatgtggttaggaaaatagtaaccatttgtgatcactagatttaatcaggggcacttaatgtcttatggctaaagcattgagctgaggccctttgctaagctaacccctttatcagaacctggcttactctcttcccttttgttcctgattttggcccttcactctacacttggttccttttcttcagcatgtaaacatatttaagcttcttccattct

SEQ ID NO: 158407 - DNA, 418 bp, Homo sapiens
agggttgagaaatcccactcttcagttcatacagcatcatcattgttccatggaggcctcttattgtttcctcatttgtgcctcctttcctccatgccactggcaaccatattcgtgggttaaatataacagaaatctttaattttgcatgtttttaaaaaataaaatgtgtattgactgtagataacttatgtagatggaattgtgttaagatatctcattcagttcttttccagttaaccctatgctattaaaatcaattcatgttgctatggatccatctattctgttgctttgaattgctttcctggtactccttggagtgtgtagcagttagtatgctttgtgatgaaccatcccaaacttagtgacttaaaacaatggtcactcctttttcgtgagtctgtggggttggttg

SEQ ID NO: 158408 - DNA, 414 bp, Homo sapiens
aagtataaagacagccacgtgaatcctttaatcatgggcggatctttttccctggataaaacccccgctcttcttatatctactgggaatttctctcctgctacctttctctttcttcttaaccctttagacctcttgctttatgaaaccatatccttatggtaccagatttcccctattcagacaattcagtcttgactagaggaggcgtctctgagggtgggtgaagtggcagaaaagtagaaaggggagggaaaaggaaagaaatagttccttagttgtcacttctcatttctctcccgctgctggtttctttgctgctccatttctcacggcccagctcttgccgatggttgcaagttggaaggagattgaagagcggagagaatctactctgctatttatactaaggga

SEQ ID NO: 158409 - DNA, 539 bp, Homo sapiens
aaaaacagccttggagaaggcatacccactcagaccttcctcaaattggaactggcatattacttccgtttgtgttccatggagaagagttagtcacgtgacaccactgctccaatgcatggggttgggaaacctggagaagtgcatggatatttagtgagtgctggtcatctgtgctgcataaggactaggctcttcttatatctactgggaatttctctcctgctacctttctctttcttcttaaccctttagacctcttgctttatgaaaccatatccttatggtaccagatttcccctattcagacaattcagtcttgactagaggaggcgtctctgagggtgggtgaagtggcagaaaagtagaaaggggagggaaaaggaaagaaatagttccttagttgtcacttctcatttctctcccgctgctggtttctttgctgctccatttctcacggcccagctcttgccgatggttgcaagttggaaggagattgaagagcggagagaatctactctgctatttatactaaggga

SEQ ID NO: 158410 - DNA, 130 bp, Homo sapiens
ggagtctgtaggggctgagtcgaggatggccaggctccctggtttgagcctttatcacttaggtgtggccaggtgttttcagctgagtcgtgatgtggccacagagaggaaaattaactgatgggaactg

SEQ ID NO: 158411 - DNA, 454 bp, Homo sapiens
  misc_feature (174)..(174): n is a, c, g, or t
ccttgtatctcctaacactagaccatagttggcattcaaatatttgttaattgaataaacgtatttattttaaaacagcttcattgaggtataactgaaatacaataactgcacatatttagtgtgctattttggtaagtttacacacacacacacacacacacacacacacantgccctcttcacacacattcaccctgtggatgagaatgtgagaatgtggcaggaggataaaagtctgagaagatgactttcaagagtgaatctcaccgatttcttttatagtgctcaggtcacaatatgattaacagtgaatcgaatgtgtatatacagtgaagttagggtcttgtggccatctctgcccattatttagaaataagcatatgtttacttccatattgaatctaaaattttctttttctcttgtgtaatgtgagagatacgggtaccgagc

SEQ ID NO: 158412 - DNA, 476 bp, Homo sapiens
ggcgcctagaggaccccggatacccagcgtataataagtagtttattgaggacatctccgaaagaactctacaggatgaatgaaaaaataaatgtcctaatgttatactaattctaggattgggaacattatcatgtgatttggggagagccaatatctcacaagacttggaagtgaagaagatgggctcttcaaaatgccaaatgatgacttacagtagcactagtaatagcatttcaaagatgcacattaagtgtgaattacattatttcatgaatggacagtagaaaacagcagcgttcctgagttcatatattggtatgacttttaaatatatagttgtaactattaagtacagacatttaattcatcaccatctttagaagtttacccactcaactagatcacaaggtggtttcttcttttaattgggaagattaacagttaattattttcccatgccgctgtgtattccg

SEQ ID NO: 158413 - DNA, 228 bp, Homo sapiens
tactctgatttagtcccctttacaacaaataacccctgcgggcacttgtctgtgtgcgttctcaaatgtgttcaagatagtttttcctttaaaggagtaacagaagtgttagttgatgaagcacaaagaacatagaaaatgcatagaaagaacatttctcgttcttttaatttgctaaatacaggtaagcccaaagcaatgcagtctatttaacatgctagtaacttt

SEQ ID NO: 158414 - DNA, 548 bp, Homo sapiens
tggtcggtaccagatatagactttaaaatttggttcaaaccagaagtgtggtatagaaatacatagaaggaaatcctgctccttaacagggtgacaaaatctaagatcatgaatgtgttcaagttccaagaaaacttttgtataactctgttattttcattcagaatgcaagactattcaaagtatagaatttgtgatctttcaactacagctgttctgcagtttaagcaaacaccataaatgaaaataatgacttttgccagttgaactggattctctatccagaaaataatgtagaaaatccaggccaggtgtggtggctcactcctgtaatcccagcactttgagagattgggagaggaggattgcttgagcctgcccatatgagttcgagaccaagctgggcaacatggtaagaccccatctctacaaaattaaaacaacagcaacaaaaactaaaaaagtccagtctacctcctcaaagaaggcaattgtttttgttttgattttttttttaagacggagtctcgctctgttgcctcagctgg

SEQ ID NO: 158415 - DNA, 394 bp, Homo sapiens
gtggtaaccaacatgttttgagcatttgctaaatgggaggcactgttgagtgccttatgtgcattatctcatttagtgctctcaacagcccatgaggtaggaattattataatatagactttgccatcaagttggtcatgatccaatataagaaaataagcaaaataattacaaaatcaagttcattgattctgtacttaaatattcatccaatcgtcccatctgccattaattaagacaaataatctttctttttggactgtcaggtagctccctacaatttctcccacctatacacacctactaatgagatgtgttaaatttaaatccagtcatctcctctgtcctgcccaaatactttcaatggctcactattagtaaaggatgaagtctg

SEQ ID NO: 158416 - DNA, 922 bp, Homo sapiens
agtcctttcccaaagggcaggggctaatgacctatgtttatgagaggtataaaagcacaagactacaaaacaaatgtcaatactgtttaattctaatattctttattattaatttccaactaatatgcaaacatgagatctgttttgagccagcaagcaaccttaggcattattcccaagcatatatactatgttactgttcctcaaaatgaactctgcacttcccaggctctgttaactttgttcaagttcttctctctacctggaaggcccttaacccaacctctgccagaggaaatcttacagccatagagcctctgccaaatgctcccagttgggaagcagtttctcctcatcctccacatttagaaccctatctgaggggtatttatgatcttccagctggtctgtttcatgctgtatttatattcatgctgtatttatatatacttgtttatcttccttgactcatgggcaaaccttctgtcttgttcatcttttgtatccatcccatctcctctctaccaggactagcctaaaaacttgaacataaagatgagtaatttgttggaataaactaaacagaagggaaaatactgatgcctgtgctttgtataatcatttttctcatacacagtaataaactaccaatggaatcattctggttcaaacctaatcttcaaggtaatcagtcctcctacctattctccctccctcattttcacatcatcaattactagtgtcaaattctgatggtacttattttgtaatcacctgaactgctattacaccactattaactctggaaaccagaactaaggaataacttacctgaaatacgtgcaaatatattcatttttatggatatcttaagattatttgccttatacatcaatacaacaattctaaatctaacaattac

SEQ ID NO: 158417 - DNA, 759 bp, Homo sapiens
aggctgaagtgggaggattgctttagcttgggagttcaaaactgcagtaagccatgattgtgccactctactccagcctgggcaacagagtgagaccccatctcaaaaaaatttattcagttaaaatctttaacaataaagcaattttgagtcgtattttgcgacattctcaatatagttttccaacttgcattaaaatacattttaaacatttttgaagactaaatttatttttttaactgacatttatgtttcatttgacaaccttttgctgtatattttatgtggacttttaggtattgtagtgattcctttaatgaagaaataaaataattgtcatttaaaaatgcatattattattaccttatgctataaaaatagttttaaaatagagtatgtttattaagatttaaaaataagtatagtcatgcactgcataacagcgttttagtcagactgcataagattacgatggagctgaaaaattactgtcacacaaatacttaccattgtgttattatttccatacactgttcagtacagtaacatatatgctgtacaggtttgtagcctaggagcaacaggctatacagcatagcttaggtgtgtagtaggttataccatctaggtttgtgtaagtacactatcatgtttgtataacaacaaaattgcccaacagctcatttctctttatgtatccatgactgtatattttttattgtggtaaaaaacacttaacgtgagacctaccttcttcca

SEQ ID NO: 158418 - DNA, 262 bp, Homo sapiens
tgcaacagaaagggtcctgactaatacatgcatcttccagggaaagaaaatgacttactgtaaatccttaacacagaaactaatttgcagtagaagtgtgctatgaggaagcaggactgatattcttagaaattagagttgttttgtctcctctatttgtaagagtctaacagatgacacagcaaaatctccagccctcctaccttccataacgggtttgctcatccatggaagttcatgaagttccagttatgccacttat

SEQ ID NO: 158419 - DNA, 305 bp, Homo sapiens
gcctttttcacttaatatttcttggcagtgtgaaaagagcttccacgtcattttttatgaaggccgtctattttagatatctgttttctgtttctaaggatgctaaaaaacagtcttatttaggcagcagctttgctggagatcttaaagatcttgtgaatatttggaggcaaatatttttcttttctgtgagagcccgggggaggtgcaggggagcttctaaaggtcagctgagaagggagagctggggcactggagagtgaggaacgcattggtccttgggcccttcttcgccttgccgtctg

SEQ ID NO: 158420 - DNA, 320 bp, Homo sapiens
tacagtatgcaggctatgtactcccgtcgatggaacaacgtcgatgtactggtgaataatctccgtgtcggaacataactgaagcaaacaatgatattatttctaattatatataaacctgtgagtcagccttccaggggcggcctgctaaggtagaatcattggaatgatttggccagggtttggataggagagaattggcagcagcgttaagattgacccatgataaataatgctatgcaggtagcagggagtctgactaggagcaaaatcaacgaacttatcccttgcctaacatagtatctgtggagtcagaaaga

SEQ ID NO: 158421 - DNA, 119 bp, Homo sapiens
tagtaagtaggtaagggttttatttttattttcaagcctgctctagactttcaggagccaaaagttcaaatcacagcaggattgattcagccctttcacaagcaatttagtactatgca

SEQ ID NO: 158422 - DNA, 276 bp, Homo sapiens
agcacccatagagatttaactttatcaaatgtaacatgggaaggggagaatagccaatatatctaagacctggaaataggcttaatccacccactgaccctgggaagcattctagagagtggtcatttggccattttaataacagtcttgcaatgtaaatgctcatctattgaaatagaacatttctgagcactagaattaattctaagtgaatctgtcagaaataccttagagtaacatttccaaaggctctaatagtcaaatttaggagtcgac

SEQ ID NO: 158423 - DNA, 221 bp, Homo sapiens
actatgttggctaggccggtctcgaactcctgacctcaggtgatccacccgcctcggcctcctacagtgctgggattacaggcatgagccaccacacctggtccgtttccagtttttatctacagtttgaatctttcctcagtgcctctagtctcatatatacaaaatacctgcttaacactttcacttgcctgtctaaattaacttgtccacactcagac

SEQ ID NO: 158424 - DNA, 374 bp, Homo sapiens
gtgactccagagcctgaccaccttctgttatgtcacactgcctcctggttcctggttcccccagatgacaaaccaccaaatgaaaaagaactttgatgattaatttccattcctcccctggaacccctttggggtcattcctgaagagctgggtttggtgccaagccagaataggcacagacactcccatggtagggctcctttcttgtgagggaagctgagagtcttccagatcacaaactgcagatggcaaggggaatgttcctttactccctctctgctgtccctgctgggacagaggagcctgtcattgcctcagctggtcttgctgctgcatgtaaaatctttcattcatctcttgtattacctactct

SEQ ID NO: 158425 - DNA, 350 bp, Homo sapiens
atttacaaaatgcctcaatacctcagccttccaccatgacttctacctaggactctaaattaatcttttatagtctctgcatcatacaaacaggtttcaaaacatgtaaactgggagtacatcacacccatcattgcagagtattcattttcctgcctactccatacttctctttttctcccagcaagcaagtccttcaaggccagagtcaaaccttacctactctgtaaccctttctaattgactcagctttacttcttttaatccttagtctttagtacttacatgatattagctttttttttttttaagcatacttcctacctctaggatctcagcccttggaaaca

SEQ ID NO: 158426 - DNA, 139 bp, Homo sapiens
gggggtcaccagcagctctcagggaccgcagatgggctgaggctgcagactctggcttgttctgagtggggaggggcaccaggggctttgagcaaaaaaaaggctccgggcagacttgggcgtcgaaggccagctccgg

SEQ ID NO: 158427 - DNA, 176 bp, Homo sapiens
aggctggaaaatcgcttgaactcgggaggcggaagttgcggtgagctgagatcatgccattgcactccaccctgggcaccaagagtaaaaaaaaattataatttcatgtgctgtgctgtgaaaacaacaacattgttttcaccgcacagtaataaactactgaaattaagcttgac

SEQ ID NO: 158428 - DNA, 186 bp, Homo sapiens
catcaccatagtcaagatattagagctgttccattgtcccaattcctccattccttttagagtcaacttctagtccctggcaaccactcatgtttttctgtttaactatagtttaacctttgtcagaatgtcatacaaatgcaatcatgtatttgagattcatacgtgttgttgcccatgtctttt

SEQ ID NO: 158429 - DNA, 221 bp, Homo sapiens
ggattgagataaggggttgaacatatagttctaccatccttctagtccttgaagtgatttttaaaaggttgctaagaaagactaagtcctttgatacaagattccttcaccagggagcagaaatgttgatatactcttgcaacagaaaagagtatagggtttggttttctacagggtagagaatgtggggcactgtgtgtccctgtaatcccagccactgg

SEQ ID NO: 158430 - DNA, 299 bp, Homo sapiens
gtcaggctgttctcgaactcccaacctcaggcgatccacctcggcctcccaaagtgctgggattataggcctgagccaccgtgcccaccctcacaatttacttttaagtggccatgtatatggcagcttaaaatactctcaaaactaaaaacctacatttcctaaaaatactcttgtgcaattcaggcttttcattaaatctggcttgatactgtacccccttgtgtatttacaggattaaagcattaactttgaaattagccatatctaggtttgaggtcctgactttacccctatcg

SEQ ID NO: 158431 - DNA, 312 bp, Homo sapiens
cgatatagttgggtctgtgtctgcttttgattgcgttcttcactccatgcacatctaatggttcgattgatatagctgggtctgcgtctcctttgattgggttgttcactgcattcacatgtaattgatatagctggatatgtgtctgctttttattgggttgttcactccattcaaatctaatggttcgattgatatagctgggtcttgtgtctgcttttgattggggttgttcactccattcacatctaatggtacaattgatatagttgggtctgtgtctgcttttgattgggttgttcactccattca

SEQ ID NO: 158432 - DNA, 177 bp, Homo sapiens
gccctggcctccccacgtgctgggattacaggcgtgagccacctgagagacagtctccagctgcagcccacaagttctcaccagcatggtcctgcctgtccaggtctggcggacatgtctgggagtcaccgtttttccagacgtacgctgggtattttggtggcctgcttactccgc

SEQ ID NO: 158433 - DNA, 291 bp, Homo sapiens
atggtttaaaagtgagctaaaaatgaatcatcaggaagattacaggcacaaccttgatatgctgcagatttgaatcgcctttttttcttaacagaacaaaatacagtcacaagatcagggcaagatcaattaagtcatgacactcttctctgagttacagttttggttttcttaagtacaggcatcaaagatagagaaggccaacaaataatagaatccaattgcttaaaacagatgagaaaaccttgaatacttgagccctaataagccttaacttcaaacactagaata

SEQ ID NO: 158434 - DNA, 328 bp, Homo sapiens
tagtagtgggttggaagtgaagactttgagattttgcttcaaatttcagtttcataattaattgtacaatatcatgtatactgcttaacttatctaaaactgttttctcaccagtaaagtgggattaattccaatatatgctatatcagagaattttatgaggatagaatgaaataatgtacatacaaaggttttgtgaattctaaggtgccactcaaatatgaattatttggttgtttttgaaactgtaatgttgcttcaggaaagtcattccactggactaatgtaagcctcttgccaaaaacaaatctctacacacagtttcgtc

SEQ ID NO: 158435 - DNA, 545 bp, Homo sapiens
cttttgtttgaacatctgttttcaattctctgggttgtgtcccagaagtggaatttctgggtcatatggcaattctatgtttaactttttggggatactccaaactttttcccacagcagctgtaccattttatattcccaatcaggaacatacaagagtcccaatttctccatatcctcaccaacagttgctgttgtccattgaaaagaaattactatagctatcctagtgggtgtgaagtggcatctcttggtggttttgatgtgcatttcctttatgactaatgatcttgaacatccccttttgacttgaggccatttccttctactctatctctattttcatctctatgtctaaaattaatcacatttttttttttttgttttgagatggagttttgctcttattgcccaggctggagtgcaatggcgcaatctcagctcggtgcaatttcggctcactgcaacctccgcctcctgggttcaagcgattctcctgcctaagcctcccatgtagctgggattacaggcatgcaccactatgc

SEQ ID NO: 158436 - DNA, 329 bp, Homo sapiens
tcctcacacatctcattctaatgtagctcttgccaaaggatccagcagagaggctgcttcccagagcatagagcccttggaagtaggagaaatggggatcactgaggtagagtagccggaaaaactgagtctcccttctcgggagtataaggcaagattggccaagccttggccaggttcctgaggtttgcctatgtccttagttctccagtattctacccaaggactgttcagagtctcctatgctgtggctcttcattcctagggaacgggtgtgaatttccatctgcaaaattagtgacttttttggtccacatgttaaaggttct

SEQ ID NO: 158437 - DNA, 1105 bp, Homo sapiens
  misc_feature (270)..(270): n is a, c, g, or t
gtactcctctcccgtacgcccaaatgtcggatcccagaagtctgagggctcgtcatgtctcacaggatctgctgttccactccccaacacacactgatcacaagtctgggcctccagtaactctcttgaccgactggctccaagttggagttcccacaagcccctctttgggtttgtatttgcatggagtgcctcatagaacacttacttttactggtttattatgaaagatactgttaaggatacaggtgtgcagaagtctgcttgggntagggtgaggcatggagtaaggggtgcggagcttccatgccctcccatgggtgtgccacccttcaggaacctgaattttgattttaaggcctagtaagatatattttccatttgaatgctctgacttctttttaattatattgttccctgggattgggttgaataaggaaactaatttattgaggactcctaatatggcaggcatgtattagatgctttatatttttgttttagtttattttaaagttgggtttattgggggtataattcacccttttaaagtatacggttcgatgagtttctaaaactatatatagtcatataaattaggatataaaacatttgcatcacctaaaaagttctctgtacccttatacctccacctttagccatgtattattggcaaccactaatcagatttctgtccttacagttctgccttttccagaatgtcatataaatggaatacacaatatgtagcctttggtgtctggcttctgtgacttagcaaaatatctttgtgattcagtcataatgttgcatgcatttctcctgtttactgctgaatagtagtccattgtataaatgtgtaccacaatttatttatccattcagccgttcaggtgcagaacatttgggttatttccaggttttagtgattatgactaaatctgctataaccatcagagaacaggtttttatgtggaaataggtcttcgtttctcttgggtatttacccaagagtcttttgttaatactcagtctattgttgggtcatgtggaaatatatatttaacttcataagaaattcccaaactgttttccaaagtgactg

SEQ ID NO: 158438 - DNA, 697 bp, Homo sapiens
  misc_feature (67)..(67): n is a, c, g, or t
gcatttctgctacattgatatgtccaagaatccctcttagaaatgacgaggcacagatagcaagatnaaattctttatgcattaggcttaaatttaatgtatcttaaggttttattgcaaaatattgccttgtttcctttttaagatgatacaatttataatatgcaaatttgctgtctgtcccctccctttatgtacatagaaaatgagcaaacaggtggccatgaaacagatggtcatagaattgtttcagtgcttgtgagtgcagcaacccaagagtgtcttatctgaaataccaccaggaatgtctggacacagtagacaaaggtttttcaactggatgccttaggatacatgcttccaaaaacaaagtagccaaaaagaaaccagagtcacagaatatcagagccagaggaacatttggaggtaattcagtacctcctccttttcagcctacaggggagatagtggaagagaagcagggatgggtctgccttctgtgcccacaattcattggagattgttgtggtgaagaatttcttttatgatgaaggagaaataaactcccatcagctttaattcaggcaggtttattgaaaaggtgaagaagcatcttgcagaagcaaagcatggctgaggcttgtgggctctgtctggacaaatgagcagctgacagtggctggtgctgcccctgact

SEQ ID NO: 158439 - DNA, 407 bp, Homo sapiens
agccaggctcttctgagaaagaaatgagagcttctccatataaacatctatttaataaactgtaaagtaccaaacaaatgttagttggagccactgaccctgccagaatatggccgtgatagagtgctagtgagtcatgcagagccacagcgtctatccttcaccctcagaaagcaggagctgctggaggcttttccttagtgctgagactcattcttcagtatttccgtaggattttgtgtttttaatgtgactctcattgtttattctttccgacctcctgccttttgaggaggaaacagaggtttgccggaggattagcatgttggggccaccagagagtttccagcagggtggggattagaatttcccacccagtgttctctgctcccacagcccctcacatg

SEQ ID NO: 158440 - DNA, 1435 bp, Homo sapiens
tcagtctcctgactagctgggatttacaggcgcatgccaccatgcccagctaatttttgtatttttattagagacgggtttcatcatgttggtcaggctggtctcaaactcctgacctcgtgatccacccgcctcggcctcccaaagtgctgggattacaggtgtgagccaccgtgcccagccgaaaatgtttctttgcaaggataaatatatgaagataaacttgccgagcgtaaatatgttcatgaatatagccacttaaggaaattcaaacatgcagagatgttcagctgtatgcagttatgtattcatgaagtattcatgtattcatgaagccttatttgatgtagaatctgagggtgctgcctatacataaacttgcttaaaggttaaaacttaaggaatgttcatcaaagtcactttcttacacctaactcctgatttcatgaatataacacataggtgcttatcaaactgaataccttggagatgagctgctccagcaccagaagataaaattcagtaactgtaatccttgaggtacctaagtgatacattttttttaagactgagccaaaataaaacagctttcctccttccctaccctctccgaccaaacttttagccattttatttatttatttatttgagatggggtctagccatgtggagtgcagtggctattcacaagcatgatcatagcaaatgacagccacagactcctgggttcgagcaatcctgcctcagccactcaagtaactaggactacaggcgtatactggggcttctagccatttatatggtattaagtgacagcttctatagttacttagtacttgtccctgtaaaactgcacagtgtgtattctcttggctcaattattagcatattctgccatttccttgtgaatgttttgtattttatataggaaaacttaagtttttaaatatcctgaaataactgaagaattttgtttttgcctttaagtggtaatgtataaagtatactattgcagagatacttacagagtgctttcattgcaattaaaatactgcagctaactagcatgttccatatgtgtaatctaaatgacatactggtcatgtgctatttctatggaatactaacagtagtatggtacatttatgcagtctcaacagtttaaagtgttattttggtgataaactgtttacatttatttgtttttatatttggcagtctaaatgcaagagtctccatttcagctctttactctgcatatctttaatgttgggcattatgcctctttcttgagtttcagtcctatgactgttccattttcagtattcatgtttatgtgtctttctaaaattgttttgcttctgtttcttgctgctcttgagacaatttatgggcaaattttgttacttttcaactggccgtgtatttccctgtg

SEQ ID NO: 158441 - DNA, 397 bp, Homo sapiens
tagtgtgcaccagcattaccttgagagcttattaaaacccatattcctgggctcgaccttcagagtttctgattcattagttctggagtggaatccgagaatttgcagttctaacaagttcccagatgatgctgatgctgctggtctaaggatcacactttgagaaccacttgattagaaggttgagcagctagagtcagaaactgtcaaataacttgtttcaaaaaagtgcgtgtgagtcaggtgtgggggtatactgacataggagagttctggaaagatatataccaagctctaatggtcctcacttctgggagtaagatttagaggcttggggaatttacttttttacctttctatattatttttgcattgtgcacataatgcttttgtgttt

SEQ ID NO: 158442 - DNA, 411 bp, Homo sapiens
gagagcccaagtggagttcttcagcacaccctacaccatcccctcactaacacccccacctgtccagtcttacctgccttcatatcaaaagcactcagttaacccagagggcttcagccctgccctgcctgactttctaggaaacccctctctccacccaccctaatcagacactgtctgaaggttccccctcatcattttaaaaggaagagaaatttttctgacacagaggttctggtgaagtggccagctcccacatcacagggtgatggtggtttggactggaccaggatcagacagtgctgtcctggggctggccatctgataaggggctccagaaagggcagtgatggacccctgggaggctttctgctctcctgatcacaggtttttggtgagaggacctattgg

SEQ ID NO: 158443 - DNA, 354 bp, Homo sapiens
acagcaacctgccgagccagaagcaaagagtctcaaaacagaggaaggaaagagtccaatccccccagggttcccactctgtttgagctaaaccaatttttagcatgtttccaaactaaaactaactttagaggtcacctaatttaaaaattttatgtcccccccaccaaacactgagggtgattgcctaaagttacatggctagtcggagcagtcaggacaataattcagttctactgacttaatctaaccaacttccttcatttatgaggccaggcttcatttaaaaaataaaggagccaggtgtggtggcacacgcctgtaattccagctactcaggaggctgaggcacga

SEQ ID NO: 158444 - DNA, 407 bp, Homo sapiens
ctggtctatatcatgagcctatcctgttgatcgtatatatgtactgatcacatatatatgttatactctctgtaaagaagatgatcttgaatcttctttctagcagatgcagataatatggaacctcagagcatactgttaatgtgatgaacatttcccataatgttcttacaataaatatagcaatgagatttactaaatgatttcttatagtgttgccctgtggttgaaaacctaacaaagtacaattttgctggtggccacatatcacatgtgtttttgagtatggactgaataggctatatattttctagacagtcctgcataaattattcctttccatgccaagtctttcataaatgttgaatggcagtaagtttgaggttatagtccctgagagtacctag

SEQ ID NO: 158445 - DNA, 282 bp, Homo sapiens
aaacaccaagtccaaggaagcaccctactcatagtccctgcttcagcacaggttggcaccgacacttccaattaggcagagcttccagccaggaatgagactgactgctggtgctaaatgtgggaactctatccaaagaaagcagaactccaaaacctggcggcagagctccagaccttttcctggcaaaggcaggcagtgggctcactgacattaaagtgggcattccaggaagactctggtcctagaaaagagctggactggtaaaataaccattgagaa

SEQ ID NO: 158446 - DNA, 474 bp, Homo sapiens
ctccccttcccccacctagagtcctcagtgttaactgtttatctctacctccaatgtagttagttcccacataaatatttgacttagacaagcaagctccagatggactggggagaatgcagattggctcatggaatctggtcccacatgcctttgacccatcatccgtgaccccagtgacacagatgggtcctgggttggtgctggctgtggcagccccacaagtgcctgacttgcttttcagcacattcctgctccttccactgtgtgagccactgtggactaggacaggactgattggtttcagaaattatccaggcaaggatcaatccaattaggctgtccctggagatgtgggaaaagagaatgagagagattgagagattgaaatagacagatagattggggagaaggaggtaggggaagggatacacataagtatgggataataaagtcagaagtttgggaatgagg

SEQ ID NO: 158447 - DNA, 823 bp, Homo sapiens
ccagctgcattagtccataacgagtccattcttttttggatttttcataaaatcagcttttggttttattccttatatttatgaaagttgttctccattttattaatctctgcttacatgtttatgtccttagtttttcttttggtgcacttttgttgtttttctgtgtctaaagttcacatcatttattatcaatcattattgtgtcctagtaaatacatttaaagttataactttttctctgaagaaaatgcacactgtatcccatgatgtgtgtagcattaccattaatgttgatttctgtgtagtctgtgatttgagttttgatcatttaatccaaaatcacttagaagaatgtcttaaaatgtctaactagttttaggccaggtgcggtggctcatgcctataatcccagcactttgggaggccaaggcgggcggatcacgaggtcaagagatcgagaccatcctggccaacatggtgaaaccccgtctccactaaaaatacacaaattagctgggcgtggtggcacgcacctgtaatcccagctactcgggaggctgaggcaggagaattgctggaacccaggagtcggaggttgcagtgagccaagattgccaccacactccagcctggcaacagtgcgaggctccgtctcaataataataataatgataatgataatttttaaaaatgtctaactagtttcttctgttgtatattttgcctttaaaattaacttgctatttattgagatggatgttcagttttagtaaatgctctgtgaggattttttaaatgttcatttcttatttaggggaag

SEQ ID NO: 158448 - DNA, 258 bp, Homo sapiens
tcctaatttgttcactgctacatacctaatgcataacacaatgcaggttaaaaagcaaaagctgaataaatgttcttactaagatgaactatataattatgcccatttataaacaaggaaactgaggttcaaagaggttaaataactatgctaaagttatcaacaactgaacttaaattgagccatatctgattccaaagcctatgcccttaacctaatggttttccatctctggtgcactgctgaatcctctaataa

SEQ ID NO: 158449 - DNA, 140 bp, Homo sapiens
atcttcattgcctcaaccaacctcctccagcttctaccccattcatttatatcaactacccaattatcaataaatctaggtatagcagtcccctgtgagcaggtgcagtaattacaggcttccactttaaaactaaaatc

SEQ ID NO: 158450 - DNA, 200 bp, Homo sapiens
gagttccaacacgtcgcgtgcataggcctttggcactttatcgacgtggaatcaggcaggaattagcataaaggtggtcaggagccattgcagcacgttgagccgaggagcagcacatcttgtctgtgatgtagatgggtcagtgtggcagtggcgtaagttgggaacagaggaagggaggctggagtctgggagagaga

SEQ ID NO: 158451 - DNA, 350 bp, Homo sapiens
aggaggcagaatggggccgagaggaggagctgagctgtgaggcaggtcccacggccaactccccagggcccaggagttgtgagctggaatggcctcccagaatcacgtggctgggactttgtaccccgcatcccatcagtcactgagcatgagtgtccccaggaggacattgcctgcagggaagcaggtcctgcagctctgtctgcaccgcccctgcagcgaggccccgtccctcagggttgtcgtgcagaggacgaagtgtgctgtcaggatgtgcacaaggcttgtgggagctcaaaggatgggggcagcttgggggatggagtgcagtggggacatcttgaggaggc

SEQ ID NO: 158452 - DNA, 683 bp, Homo sapiens
cggcttatagaggatcccgtctctgctcccagaatcacgtggctgggactttgtaccccgcatcccatcagtcactgagcatgagtgtccccaggaggacattgcctgcagggaagcaggtcctgcagctctgtctgcaccgcccctgcagcgaggccccgtccctcagggttgtcgtgcagaggacgaagtgtgctgtcaggatgtgcacaaggcttgtgggagctcaaaggatgggggcagcttgggggatggagtgcagtggggacatcttgaggaggcaaagactgagccaggcctttgaggtggagttagatggtcagagggagcagaacctgggggtgcccagaggcacatttggagctgtcagtgggtccgatgttgagggaggcaggtgagccaggccctaacgagtctgtctgccgtgctaaagggtgtggacattagcataaaggtggtcacgagctgtcagtgggtctgatggtgagggaggcaggtgagtcaggccctaacgagtctgtctgccgtgctaaagggtgtggacattagcataaaggtggtcaggagccattgcagcacgttgagccgaggagcagcacatcttgtctgtgatgtagatgggtcagtgtggcagtggcgtaagttgggaacagaggaagggaggctggagtctgggagagaga

SEQ ID NO: 158453 - DNA, 513 bp, Homo sapiens
ataaaatccggtcaatagccagacatgctagccagaagcaagctaaggcaatgtgccgtctctgttccgtgtgtcttgaaagtgtgccttttttggataatgaaaatctctacaatattttcttgggctaatgagaagtgtttatttgtatttttaatatgaaagagaacatctttgcctctgggaaatatttatgaggaacataactaaatggagactaagctttccttttcatttcccttctgcgtcacagattcttgtgtttcttccaagcactaatgaaatatttaaagctgttgtcaatgcagaaatgttcctccctaacatgtttcaatgagctggaaaaaagcggagaataatttgctattgtctacatattcataacataaggatgtcaggaggtattagagtcactttcgatgtgtctgactccacagcattggtaatattagaacactttcagctttcaaggtgtaaatttttcatctcctccttttcacttccttccattgg

SEQ ID NO: 158454 - DNA, 547 bp, Homo sapiens
tttcaattaaacatttcatttgatatgaactactgtgtcaccaagacagaatctttgctcattcacataacactttttcaagaagcaggaactggccagttcctgcttcttgaaagtgtgccttttttggataatgaaaatctctacaatattttcttgggctaatgagaagtgtttatttgtatttttaatatgaaagagaacatctttgcctctgggaaatatttatgaggaacataactaaatggagactaagctttccttttcatttcccttctgcgtcacagattcttgtgtttcttccaagcactaatgaaatatttaaagctgttgtcaatgcagaaatgttcctccctaacatgtttcaatgagctggaaaaaagcggagaataatttgctattgtctacatattcataacataaggatgtcaggaggtattagagtcactttcgatgtgtctgactccacagcattggtaatattagaacactttcagctttcaaggtgtaaatttttcatctcctccttttcacttccttccattgg

SEQ ID NO: 158455 - DNA, 442 bp, Homo sapiens
cacaaaacagctcaactatttatccttaatatagtcccttcaacctgtctggcaaaaccacgtaaaaatcttatgctttcagcaggcttgctctgatgtgtaaatcagttctaaattgagttcaatcctccacaaacattctttgtctttgttactatatacgtatgatttatagttctctctctggggaaataaaattaagttctttcacaattcttagaagagaaatatgaaatacggctctatgaagttatttcaaagatgacttctaactaggcctaggatcctcatgccattagcataatgtctaaaatttcctctgttctcaaattcattctaatctatgaaagaagatatgagtaggcatgaagatgtataaagatgataccaaattacacctgggtgcagtggctcacacctgtaatcccagcactttgggagg

SEQ ID NO: 158456 - DNA, 432 bp, Homo sapiens
caaagcgagcacctgctcctcccgccggtcctcgcaggaggaccccaggctgctgcgccccggctgcctctccgggtccctgcgctccgcttctccggagctgggggaccgggggcgccccgggacccgcagccagggtccgcccagcgcttccgagccgtggtaacgcgcctccccaggtgcccgacaccccgcccggggccagcatttttcgcttcctagggccgggccgggggtctggggctgcgtcaagggcctcgtcaggcacccccaggcctgcgggggcaggatcctgagtcaccgccgcgcacgccctctcctcccggcttccatcctggggccacctccagcccgcaggtcgggccccggcgcagccggctctctgcgggtctgctgtgcgcccctctccccagcccgagtcactgcggccgc

SEQ ID NO: 158457 - DNA, 336 bp, Homo sapiens
cagtgggcgagtggcgggaaatcctcgtcaagttgtcttgctgtttcctgccatgatggcgatgagcacctgataggagaagggggaagactttagatagtgtttactttgaaaacctaattaagcatagcctgaagagaagcccccaggagcctagaggcccgggaggggtcccagctccttgacccactgtttctgtgaatttgaaccctctgatgggcctcgatcctcttatccatagagccaagggcttccactgtgatctctgtaagatcccttccaaatctcagctcctgtgacctggaggccatatattgcaatgcaagctgaaatcac

SEQ ID NO: 158458 - DNA, 180 bp, Homo sapiens
agtacagttttaagaaaagaaccttccaactaaaggctccaagtctgtggagagtccccaccgccttgcttagctcactggatcattaagatacacattggatcattaagatagatacacactgcatcattaagatagatacgggggctgggtgcggaggctcccgcctgtaatcccaac

SEQ ID NO: 158459 - DNA, 158 bp, Homo sapiens
ggcaggtgattgaattatgggggcagcccttttcctgcactgtttttgtggtagtgaatgagtcccatgagatctgatggttttaaaaaggggaatttccctgcacaagttcttctcttgtctgccaccatgtgagacgtgcctttcaccttctgcca

SEQ ID NO: 158460 - DNA, 251 bp, Homo sapiens
cttctcaaagatgtgaaaacaagtctcagaagggttaactaacttccctgatgtcacggattgtaagttatcagaactagggtgatattcctggtctattttagatccatgtcttgctttttctcactaaaccagtgctgttagctattggctgaattatgactacctgtgcttttcaaatacttctgcaaaaacaaaatatataacaacagcataaaaggaaaacaactctggttgaaatggaagtgaag

SEQ ID NO: 158461 - DNA, 549 bp, Homo sapiens
tcggcctcctgagtagctaggattacaggcatgtgccaccatgcccagctgatttttgcatttttagtacagatggggtttcaccatgttgaccaggctggtctcaaactcctgacctcaggtgatccacctgccttgccatcccaaagagctgggattataggtgtgagccaccgtgcccagctgcaccaagcttttcctgaaggctgactatgctgggccactgttctaagtgccaaaaatctgggctggacagggcaggagggatgcagtatggataaacaggtacttattgagcacctactctgtttggggtgaggtactctaagctcttggacatgagtgatgtcacccacagacaaggacatttgtgagctaaatgtgtacagaaggcaggaggaagaaaggcctagagtgcccagaaagtcagaagaggtggtcagagttaagaacacgggcttcttgcccttttaaatctcagctctgtctctcgtgaggtgtgtgaccttgggcaagtcacttcacttctctgagcctcagtttcctcat

SEQ ID NO: 158462 - DNA, 687 bp, Homo sapiens
accaacaatgagatatccacatgctatggtatgaaggttcccccaaaattcatgtgttgaaacttaatggctaagaggagggaccttttgagaagtgattaattataaggattactgccttataaaagaggtgatacaaactagctttaggcccttttgcccttctgtccctaccagcatgtgaggacacaatgtttgtcccttttggaagattcaacaacaaagggccaacttgcaagcagagaccaggctctcatcaaacgctgaacctgctggcaccttgatcttggactcccagcctccagaactatgagaaacaaacttccattctttataaattacccagtctgtggtgttttcttatagcagcacaaatgaactaagatatcatgtttaatttgcatttatcttaaatcatgctaccaaacaaatctctcagccaaggtgacaatcaatgaacagattccttctatgaactccaagtttgatatgaacaaagatagcctcttatctgtcactactcatttccttgcctagtaagtttcttttgatattaactccagctagtaagtttcttttgatattaactctaaaaagcatctcaacctcagaagtgttaaaatgggggctggagaggaaaagaacacaacacacccaacagagtggccaaattttaaaagagagaca

SEQ ID NO: 158463 - DNA, 151 bp, Homo sapiens
gttcgtgccccttcagctcttaatatacaggtggagagaaggaagaagttaaccacccggcgggcctggggcagtgaggaagggccttggaggagctggccaggaggagcagcaggaggaggagggggccaggcagagggagcacacaagg

SEQ ID NO: 158464 - DNA, 219 bp, Homo sapiens
cccccaccatcaacagtatacacaaacacacacacacgcagggagcagggctctctgagcccgagactagacccacccccactccctttagggcaatgaagcccccaatttccagaaaaggagttacaaggttcctaaaccacttcccctcgggacctgaccactggtcatctgcaacttctgacccagcacagacggggggagggggggccatgacac

SEQ ID NO: 158465 - DNA, 423 bp, Homo sapiens
gtctcgtggggaggtggtctcgtggggaggtggtctcgtggggaggcggtctcgtggggaggctgtctcaggtcacctggccgccctctcctggggcactcagtcctctgttaccctctaggggatccggctgttcttacaaatgcttggaggagagccgccagggaggctgagtgggtagcagttatttccagaagataggttttattattttcaagcatattcgcgattcctgccagcttctcaggaaagcccaaccttggagggacccttcctctgcgaggaggcggcgagtgagcgtgggtgtgtgtgcgtgctcaccacacagttggcatcctgtggggcagctcagatacaggcggagcaaggccctgctggaggcacctgccctgcggtcacacagcacacacctgaaaccacagc

SEQ ID NO: 158466 - DNA, 225 bp, Homo sapiens
ctgggtgctgtggtggtatcattgaggcttctcaaaggaagctgtgctgaggctgaggcatcaagaatgaggagtcagccaggcaaagttgtaggggagcagggcatgtgccaagatcccaagtggaagagagtgtgagatggggaagcggggccaaggctgagagaggagactggtgctcagcaggggccagatcatgttggcttgggcatgttactgaaatgc

SEQ ID NO: 158467 - DNA, 515 bp, Homo sapiens
tggctaacacacatgggaaaggtgctaaagtgctcagtgccttacatctaagcaagacagaagtggtgaggaggtgaaggagccaggcatatggctctctgaggaaagagtgttgcaggcagagggagcagcaagttcaaaggccagggcctgttggggaaggagcagggaaggcagtgcagctggagtggagagtggccgagtgcagctcaaagaactgcccatgagcaaggtggagcctgtggagcttgctggggctttggcctcaggatgtctgcatctcttcagaccttaatctcatcagaccttcaagatcttgccaatctgacaggggtaaaacagtatttcacgaatgttttcagctgtcagagtttacgttttacattttttcatgtgcttgttggttatttggactggcccttctgtgaatttttagttaatattcttttcccagttgtccctatggatatttagtataatttattgctttgtagaaatgatgtatatgttctggt

SEQ ID NO: 158468 - DNA, 729 bp, Homo sapiens
gtcccagctattcggaaggctgaggtgggaggattgcttgagcccaggacatcaagccttcagtgagccgtgattgtgccactgcactccagtctgggtgacagagcaagaccctgtctcaaaaaaaagtgatttctcattttataaaagaattctgttcaaagtagcaaactcttaaaaatctaaattactgtttaaagagcagtatattattcaaatattatattgacaaacacagattagaattatctaaatccctggggccaaattgtttggcattcagaatttttcagatcttagagaggcaatatgatacatatatgtccagaagtgtctggagagtcacacgctaatcaaactcattaatattttttcagggaatcctaacaattttcatattaaatataaataaggtctacaattaaactcataccagatcactgtagattttgcaaccaaattagtttgtgcaacaaataacaataaaaagtacctgccagtgtttggagcttttggatttcaaaattatggataagggattatgaaattattttttatttgaacacatactgtcaggtaaatcagtctactatataaatttaagtagaataaaataatctaagaaagaaaaagtgtagcttgtatgctgatgtcacgtagataaaacatcactggaaatagaaataacttttatgaaaaccgaaagacaaaaatctggtgaacaaaaaa

SEQ ID NO: 158469 - DNA, 962 bp, Homo sapiens
atgtgcctcttgccttctgccctgattgtgaggcttccccggccacgtgaaactgtcctgcatactgatggaattactacaccagcttgtctgtaagaccccagtggtgccagctggtctgaaggataccactgactcagctgatctgagggtccccacgagaagtggactcactaaagaatgcagtttctatatcgtgatgatatcaccctccttgccctgaccaatcaacaaccccaattttccaatccttcaccctcaatgatccccttaaaaatcccagccaagaactcctcgaggagatgggtttgaggatgtcctcccatctccttgcttggcgccctgcaaaaattaaactctgtctctgctgcaaaaaaaaaaaaaaaaaaaaaaaaaaaaaaaaaaaaaaaaaaaaaaaaaaaaaaaaaaagggggagcggtattatttattggtgcgggggcgcgggcgaaaaagagagtgggagtagaatgagaagtgcgctaactgggtgctaacaattgggtggttttgctgcgaacccacatgttttgttggtaacagggggggaagaagagagcggggccccccaagagggaggggccatataatttgccacagcaccgggttttgctgttgtttatgattcgatgtaggaactgaaggggagtaagaagagaaagacgggtgagaagtagagaggatgagaaagtcaagaccagacaaacaaaagacgacccgaagaagcacaaccacgcagggagcgacccaaccacggtacaagaacgacgagacgcaaagaaaaagcaccaccacacaaaaaccatcccacccaaccgacgaaacccatccaggataccacaaacccagacataagcacccacagcgatcgccaagcgagccgacgcagaaccacagcgagagacgagcgcgccgcgagaagcagaagagaaaacaagaaaag

SEQ ID NO: 158470 - DNA, 420 bp, Homo sapiens
atgttgccatgtacttctaggccaggatttagtaattttttgccccctgcgtctcccagcttgctgactcatgcatctctatcagcacatgctcatccacctcctgagccgctatccattgtctgctcacaatgcgccctcagtggctgctttctcagtgggacagaccactacactctggggatgcctgcaatggtttttgacgtgtctgagccactgctggggtttcctctagttttgttaagttgcaggcagagattgtgcatgagcagtggtttctccaagctccatgaagaccgggaaacctgaacagggtgggtgaacttttcatggcgtgcatgcagtatccttggctggacagtccattgtgtgacagcagaatctttttgcagctttttttccccctttttttaaaagaca

SEQ ID NO: 158471 - DNA, 218 bp, Homo sapiens
taccacagtgcctactgaatggctcttcttgactttcttctcatagacatctcaaattgaacttaggatcattctcctaattttgcttattcaacagggttcccctcttagagtttcttgtgccagaaacctgggaattgttctcttttccctccgtctctcttggtgtttcttctgtcttacatactcactcacctttcccattcagttctatcatc

SEQ ID NO: 158472 - DNA, 576 bp, Homo sapiens
tttttttttatgaacataatttaaagatagaatttattctctgatggtttactcatgcaaactgcacataaaagaaaatagtacagtttgtgtaacattgcaaatataaggactgaaaatgctaggtacagaagtagtatgacatcctgaaagtcaaaatggaatttgtgtttatacaactaataatgatttttatttgctcagtacagactgatttacaatgaaagttttgctaaccttggtaagcttgttaaccgtttacatgacttcttacatctatgtagttttattttacagttgcaagaattctgttaccaaagaaccttaacttgcataagtaataagatgaaagaaaaatgtactgaaggacttaagagtgaaaaattgaggcttttcctaacccattcaaactacaataaaaaatttgcggcccatttagacacccagatgatgggtcaagcaacagatttcactactactaagttttgcctactacttgttttctagatatcaggaattcacagcactagagacggggtttcaccgtgttagccaggatggtctcaatctcctgac

SEQ ID NO: 158473 - DNA, 334 bp, Homo sapiens
ctcactaaatatcagtgcatttatcagacactaaattttaaatgcaggcacctgcagagctagtgagttctaaagaatcccactccctaagtttctgggcttcttcttacctctcttccactagcgtctctttttccaccttcagcacttggacatacggctacatagagaggaaactgtctccctgcttttgcttgctagttcccaatttcaagatgttgtattacacctgatttatggcctgacagggctcattctagtccacaaccctgagcttgcagaatgcacaggggaaaatttactaacgatttcgttcatcttaatgcactgtagg

SEQ ID NO: 158474 - DNA, 632 bp, Homo sapiens
cttaccattgtaatcccacttctagaaaccttaggtagggaaataataaacaatgtgaacaaagatatatgtgtaaacacatgagcacctagatgcttaattataggaaaatggccagatgaagcttagtacagctgtaagataaaatatctagcagttatcaaaattatagttaataattttaacaggaaaataattatgttaaaatagcaagtgaaaaaaaacatgcagtatttttttcaattatatttttccaaagtatagaaataattggaaagaaacgtatcgaaatgctaaaaaaaaaaaagagggcatgaggaggagggcctgtatggcagaaaaatggctaagaggtgagcaatgaggaaatgaaatgtgtcaagcagaactaaggaaaggaaaattcagttttttgaatactctgtgcaagcaatgaaataagcatttaataattcttgttaataattaaagataaacattggagtaaggctacgaggagaaaagagcctctttccacaatgaacagaaacctcccatcttggcttagttgaaagaatggaaagctaagatactttgaagtctgaatgagtacatgagatgactcaggtggtgtggggtagcgagctccatca

SEQ ID NO: 158475 - DNA, 127 bp, Homo sapiens
ccccagtaactaggactacgagtgtgtcctaccacacctggctcatatgcaacaattttgaaaatagactgcaacaatattgaatttatgttgattctgattctttgtgaatatggctatttgatgt

SEQ ID NO: 158476 - DNA, 350 bp, Homo sapiens
gagagtagaaggatgattggagtcagagaatctagagtaagatccagagaggactcgtgatttgcctgaagtcaaatggcttgttatctgtagcttgaaataagggcagtgacctttacagaacttcttttcctcctaacagtgctcattgtatttctttcacctgatcacgtgctaattgacttattaaaattttctccaagaagcaaaaaagggaaataatataaatagatcagtttgttgattggtaatttagacaggctttccttaattggttctgatttaaaagactatactttaaagtgccttataagctcactctttcatcagagctgttagccgatcaacat

SEQ ID NO: 158477 - DNA, 476 bp, Homo sapiens
tgactgtctagagtgggaactttgattctctttaaatatagaacaacataatttgagagaatggcaagactgagaaaggtttctgtagcatggtgcatgcatgtgtgtgtgcgtgtgtagggagaggcaaagggttctgacaagaggaagaggctgaggaagcaggctcatctccacaacgtgctgctgccacccaatcatagggtctcttgcagcaattccagtcctgatctcacaaacctcataccctaactacggtccccctaattggggtccctcctcagagctttcctaaggctccctaacttttcccctcacctcggttgaggcctccatggtttggacttgctggttttgccttgctcttcccttgataaatacaccatttattccggttcagcccttggaactttaaaccttaacccaagcctcctccaccccactatattagcccaagcctagagtatcagatctgg

SEQ ID NO: 158478 - DNA, 605 bp, Homo sapiens
  misc_feature (22)..(22): n is a, c, g, or t
cgacttctagaggatccaccgntatacgcaccgtggtatacttgacagatagtcccctttgcttaacacccaactcctccaccctgtgcagtttaacttgtgccagtgatcacaggatttgctgaatgaattaccataattggatttaattcaggaaggggatgttttctgtacacaccaaacaggctgcatactggattattttccctagatgacagggatgaagaaacccaacaggaaatacatctttgcaaattagaaaagttgatgaactcctagtgaccccctggcaccttggctcacctcactgcacttcacagccagaagcatactaggtggattcacttttttacctccctgataaagcaataggaacttgccacacccagactcacatccattctcctttcctacttccactgacctcaagtctgataaaaacccagagtgataatgctattgaggtacagaccataaactatatcagcatgtacgtaagtggagggaggggaaaaggggaggaaaaagcaaaaacggccaaatggagagttcagctttacctctatgtgaccttggcagcatgtggagtggaagggaaattgcca

SEQ ID NO: 158479 - DNA, 643 bp, Homo sapiens
  misc_feature (22)..(22): n is a, c, g, or t
cgacttctagaggatccaccgntatacgcaccgtggtatacttgacagatagtcccctttgcttaacacccaactcctccaccctgtgcagtttaacttgtgccagtgatcacaggatttgctgaatgaattaccataattggatttaattcaggaaggggatgttttctgtacacaccaaacaggctgcatactggattattttccctagatgacagggatgaagaaacccaacaggaaatacatctttgcaaattagaaaagttgatgagctaagtcctgcaaacattgggcacttatccaagatgaactcctagtgaccccctggcaccttggctcacctcactgcacttcacagccagaagcatactaggtggattcacttttttacctccctgataaagcaataggaacttgccacacccagactcacatccattctcctttcctacttccactgacctcaagtctgataaaaacccagagtgataatgctattgaggtacagaccataaactatatcagcatgtacgtaagtggagggaggggaaaaggggaggaaaaagcaaaaacggccaaatggagagttcagctttacctctatgtgaccttggcagcatgtggagtggaagggaaattgcca

SEQ ID NO: 158480 - DNA, 549 bp, Homo sapiens
accgtgcccagcctataatacgtaactttttaaaataacagtgtagtgcttgtttctgcaacacatatactaaaattggaaccatacagagaacattagcatgagttcccaaggatgacacagaaatttgtaaagtattccacatttttgttaaggtggtagattttgttatgtgtattttaccacaattaaagaaaataacagtatgaatcatttgactgaaaccacagagacagatttcaataaagtggggcctttgtcactaattcaaatgtcatccgtctctgtttaaacgaatgttggtttttcctttcgtctttcaggaaaaactctaacttttctcactggtagcagttttaggtacagacacatctccagcggcctgtgaccccccagcgctccacgtttacgtgtcccccgcggaatctctctgactgctctgtgtgaagcacgcagctccccaccccttcacgcagccctctggagtccaggcattatccactctgcagggccgccctgctgatctcaggggacgcgtccagctctcta

SEQ ID NO: 158481 - DNA, 279 bp, Homo sapiens
aaacacgtctgtgggccagaatcagcttgcaagaacccaatttgtgaccactggcttaagatgtgttgataaatggatctattggtccttgactaaagggaatctaggaaagatttgttttatttttggggggtaagaacataacgcataagaaagaagtcacttactcatttttacctgagagttgtttatttgtcttgtgaaatactgaaaccttagcactcattgagcgctctgtggtagcaagtgatttgtgatgatggtagtatttttggagaa

SEQ ID NO: 158482 - DNA, 137 bp, Homo sapiens
ttgatttgaccaacattaggaataaatagtccaatgttatgaaatacggaatgtaagtgatactattttttgttgctggtgaattttaaaaagtgatgtttttaaggcagcacaaaagttcctgataacttttcttg

SEQ ID NO: 158483 - DNA, 288 bp, Homo sapiens
acttgtttgtaatataagtgtatcgctactgtggtggtgatctttaagtttttgaacaaaaaaaattctagacaaacaggacacaataagagaatgctatgaacagatttgaattccatgaggataaatgtggtagcagtatggaaggtcggtgggcagaggtgagggctccgagcacacatggtattgtgtttgtgtgaggcttctccagcccagacagtgagcttgatgctctaggacagactctgtgtcatgtagctcccagtcccggcacttggcacacagtag

SEQ ID NO: 158484 - DNA, 527 bp, Homo sapiens
actggagtgtagtggcacaatcccagctcactgcaacctccacctcttgggctcaagcaattctcctgcctcgcgcttccaagtagcggggataacaggcacgcaccaccatgcccagctaatttttgtatttttttagtagagatggggtttcaccatcttggccaagctggtctcgaacttctgacttcaagtgatccaccccacctcggcctcccaacatgctgggattacaggcatgagccaccacgtccagccaatacaatcttttttaattagggtgtatacattattcttttagacataatgctattgcacacttaatagactacaatataatacaagcataactcttatatgcaccaagaagccaaaacatttctctgacttgacttattgcaatacctgctttatcgtggaggtttggaactgaacccacagtatctccaagatatgcctgtaaccaccagacacatttaaacataattccaaatagactgtgggaaccgagtagacaaagggaaaca

SEQ ID NO: 158485 - DNA, 324 bp, Homo sapiens
gtgcttatgtggaatctgaagatgtatctgagagaatatgtgtttttatgtatttagaatttgagagttataaattgcttccttttctagtaatcctgaaatttcttcttcagagattgaactcaatattctgagattgaatctcagaatattagaattgagttggctgtcatttaaagcagaggaagctgtggaactcacataaaggaagtgatttgcccagggtcaaggagcgataaactagtatcacagatcttctaactcccagttcagtgcttttttcactgcactagtggctttccaattttttcagcttcaggaccc

SEQ ID NO: 158486 - DNA, 549 bp, Homo sapiens
cgatctagagtatccccaagcagtgaaaacagactcaacagttgctagtaggtctacaattctctcattcactggctcttcagagaactacaacatttgccatactcctgcccctctatccttcactccttacagcacaactaatcccttcacaggcactcttcttctcacacaaatgggccgtggggaagccaacagggagttgacaatgggggaatacctggaaaaaggtattctatccttcactccttacagcacaactaatcccttcacaggcactcttcttctcacacaaatgggccgtggggaagccaacagggagttgacaatgggggaatacctggaaaaagggtattctaggcagagaaagcagccaatgcaaagaacataagatagaaacatgcttaatgtattcaaggtagagcaaagtaaacaaagtggagagagcagataaggtcatagaagtaacttagcttactggatcttactgagctggatcttgtaggaccctgaaggccattataaagactttggtttctactataagtg

SEQ ID NO: 158487 - DNA, 328 bp, Homo sapiens
actcactgttgggttgagaccagttgattctgttcccccaatcccttacccctccccagaagtcccctttcttggtcaggtaccacctcctgctggtggcacagaagaagtggccacaatccgggtgtcgggagttggaaataacatcagctttgaggagaagaaaaaggttctaattcagaggcaggggaacggcacctttgtacagactgacaaacctctctacaccccagggcagcaaggtaagagtcacatatttggggttcgactaaaacctggggaaaccgctgtgcacaggggtaaagaggggatttgtggtttgacagta

SEQ ID NO: 158488 - DNA, 262 bp, Homo sapiens
atatgtacaaaatatcttttaaaagtcctatgttgatatatttgtgataatgacaaacgataaaagaagtcatactactgacaacctttgaaattttcatttgtcatctttcacattttcctctagcctagaagcaaatcagaagaattacgtctgatagactttctccaagaataataatcaagagaaatagcaattcataataaacaaagcattttcttagtttttaatgaagaaaactaagaaagtaatttcaaaatta

SEQ ID NO: 158489 - DNA, 397 bp, Homo sapiens
ggacagtattgctgctttccccgacatcgtggacgcccacaggcagatggaaaggtcaggaatacagatgaggaaagagccgatctggcctcagctcagaagccttcacaagctacagaggccttaccagagaaatctccctgcttgctcagttttgcaaccggctctggaacaagtgacctgtcaggcttctatgcctaggacttgaagggacgtggaggcttctttacttggaagctgatagcgtttggctgtgtcgccacccaaatctcatcttgaattgtggctcccataatccccatacttcatacgtgggacccggtgggaggtaattgaatcacgggggcgggtctttccggtgctgttcttgcgatagtgagtaagtctcacgagatct

SEQ ID NO: 158490 - DNA, 146 bp, Homo sapiens
catgaatatatcttgttacatatggtaagagtcaaattaaggactggccagctgggcagttgcccatgacacttaaatagaaaatatagaattttcaaaatgaaacaatttggaaacatataaatcagccctgctttcacttagag

SEQ ID NO: 158491 - DNA, 465 bp, Homo sapiens
gcggccacctggtagaagctggagccatgctatgccttcccagcaggagctggaaccacagatgaaaggtctgtctgctagaagctggagtctcagagaagacactgtggttaccagaaatacagcctgaagagagaagcaagcacttaaactccttccttcttccttcctgatttcagtcttctacctctctctcccatgggctgaacccaccaggatccagggaacaggagaaccaaagaaatgcagttttctgcaacacggaggatgaccaagatgaaaggggaatagagatgagtgcaaacaagctcatggccggcttggaaggctggtctggtaggtagcacttgaaaggagacctcaaggaagtgagggaatgagccatgtgggcatctgtgagaggaagattccaggcagagtgaggagtgagggtgagaaaacctggaagggaagcctgcttagtat

SEQ ID NO: 158492 - DNA, 697 bp, Homo sapiens
gcagggaaggtattctggcaaaatcctgaatggtcaaacggtaaattactttatttcagaaaaaatgaaatggctttgtaaacactcaggctcacaaaaaagaaagtctattagttctatatgtagcaaaatcccgaaattctgacacagagtaatgcagcatgattagaatattctaaacgaaaatgttaaatgaaaatcttgatattaaaaggcagtacagggtagtgtttaagagtgtgaaccctggagcctgggttcaaatccatatttcataatttactgctgtgtggtttaggtaagttacttaacctctctgttccttagcttcctcatgaatgaactaaggataatgtcagtacctgcccagtggactgttgtgaagatcacacaaagaaagtgaatacgacatgctcgtaacagtcctggaacaatcattattaaatattatcgtctgctggggtaagagctgtcattaatagatggacacatgaagaaaacagggtaaattctatgagggagactcagtcactcactcactcattgccacattctaaaagacgacactgtggcaggcactgggctgggcagggaggaagtgccaccgacaaagttcctgtcctcaacaaggggaaggtaactggcattccggggtgcgcactaggtgtcagagactgtggtagaaaatgatttcatg

SEQ ID NO: 158493 - DNA, 122 bp, Homo sapiens
cagtgttcaagtctgacttttaagaaccatgctgtgctacagaagcaataaggattttttcctatgtagtcacaagctggtccactcttccagttagttagcccacacccttggccctctgg

SEQ ID NO: 158494 - DNA, 1148 bp, Homo sapiens
atataaagaactacccaagactaggtaatttataaatgaaagaggtgtaattgactcacagttccacatggctgggaaggcctcaggaaccttacaatcatggcaggaggtgaagaagaagcaagtaccttcttcacaaagcagcaggaaagagagaagtgcaaaggaggaacttccaaacacttataaaaccattggatctcatgagaactcactcattatcatgagaacaatatgggggaaacagcccctaggatccaatcatctccctccctcaacaagcagggattacaattcgagatgagatttgggtggggacccagagccaaaccatatcacttgtgctggtggagcctgtagaaataaaggagtgattgtgtttgtgtttcagatgaaatgagagtggctcttatcctggataactatcggttggctaattggctggatccctcactggattataaggaacactgtcatgaaaccaggggccttgtcatgatcatcatgtagaatcgtactaggaaactaattcaaactcaataaacatttgttgaataaatacaagaatgaacagcacacagcagctgcaggaggacagggaatgctttggatttgagagctgggctgataacagacatttatagacagtagcaataggaccctttttgctgtttatccatcaaccctcaaatcccaagtagagtactggacttcccacagttaatggggaaggagctcaagcagttccatttggacatgaacagaaaaggcccccaaaagaccacataactcaggggcaatcagtttccatcatttttttatagttatctttcatattagattttttcaggtaaaatttacatatagtaagtgaaaggcaaatatcctaagtgtacttgatgcgttttgacagtattctctcatgttaccaacatataaacaaaatatagaacatttccatcacccaagtaagttccctttgtgcccctcttccagtcaatgcccaacacctttctcacagacaacacgttttcttatgtcattcaccatagattcatttaacctgtcacaaatgtcatataaataaagtcaatagcgcacactttttgtttggcttcttttgtgcaacgaatgtttttgagatgctt

SEQ ID NO: 158495 - DNA, 437 bp, Homo sapiens
ccaatgagcctgggttcagtgaggttaactgagcaaccagttcaggcacaagcctgcctcaggtcacccctgggtaactgtcacccattacacagccacgtatgcatgtcctgtgtgtgctgggatgaacagttagtcctgccctaacataagtgggaccctaaaaacgagctccctctgcagagttgcaaagtgtgatgggaactgcaggttcatgggaaacagactcagggtatgacattcaaaaacttcctcagggacacctagaaaaagataggcaccgactctaaacagcagcgccgttacgcgcatattaagtggccgagaattacatgaatgccacagcaaatcgggtactgaccttggaagagacctgaggctggtttgtggatctggtggcagcctgtgaattatgtgaaggccgggaggaggtcatc

SEQ ID NO: 158496 - DNA, 315 bp, Homo sapiens
gtctgggaaccactcagtctgtgtcagtgcagcctggtgagttcagaagactcctttgttttgagctgtggaacaagaggaaagggtaaaattggcccctctgcctgcggctggatgcagcatggtatcccaggccagcctgccactgcagtagtttaaacaaggtttgtggtcttcacgttccataccagaggaggagcgatgtcccgtagggaatagcaagtagatggtaacatcagacacttaaacgtgggaagcgggcagcccacagactgacaaggtggactctgccctctaatacttaggcaacctcgg

SEQ ID NO: 158497 - DNA, 204 bp, Homo sapiens
ttcttccactccaagagcccaaatgttagcattttaaccactgtgaaagaacgatgttctcaaaatatattagcttgaaccatatgaaattaaccttctgtatgtcaaaaatgctcaagtactaacaatttcacttggatcaatggcagtacatgcccttcaactttcttctacataggggtgggcaaattttttcttaacagg

SEQ ID NO: 158498 - DNA, 397 bp, Homo sapiens
tcccagctactcaggaggctgaggcagggggattgcttgagctcaggagttggaggcagcagtgagccatgatcacaccactacactccaacctgggcaacagaggaagaccctgtctcagaaaaacaaacaaacaaacaaacaaacaaaaaacatggtgaggtttgaagtagtattcgctatcaggtgacctcaaatgagggaagtactgagaaagagaaactgccttctctagcaactagaacttcaaaaaactcacatgacaccaagtcatatggcattgctgttataacaaaattgtctaagataggcttatatttaaaaaattgacttatgatacccgggatacaccatgtaggtaggaaaaggaggttctgagggtgatcttgaagattta

SEQ ID NO: 158499 - DNA, 391 bp, Homo sapiens
atggagacaggttctcactatgtagctcaggagtttgagaccagcctgggctacatagtgagaacctgtctccatatgtagcccaggctggtctcaaactcctgagctcaagcgattctcccacctcagcctcccaaagtgctgggattacaagcatgagccaccacgcctggcccataatcaattttagaacctcttcatcaccccaagaagaaaccttgtaccctttatagtcactccccacaactccctcatactaacatatttttaaacatgaagactccaagagaaaaatgaacaaaggatgtaacaattcatagaagtacaataagaaatggaaatggctaatatgaaaaattataattcaataaagatgattcaaattaaaaga

SEQ ID NO: 158500 - DNA, 176 bp, Homo sapiens
ccagcccattcccactggcatgtgggaggacatttgtgaaattctcacctgcttatggaaagtcattctgccatgactgtcagacaccaatgactgtcatcaaagccaaagaattggatttgcaatagatgcataaacaagactctgctcctcgctttccatcaccatctcctaca

SEQ ID NO: 158501 - DNA, 314 bp, Homo sapiens
catacgtgctggtattagagctccttggacggtgatgtgctgttttagaggagaaaaagctgagatgaaacaaaaatggtggtggcagttacccagggccacgtctgtggatgccatcctcaggatgccattgcatctcgggccagcctccctctgcttttgcaaaagcacaaccgtctggcctctacgaccaccaacacacacctctcatactctggaatttgatttctggaatgcttttttattcttcctatatctgtaagattttctgatatttaaactggctgcaactaatgaatagttttcagttttgt

SEQ ID NO: 158502 - DNA, 676 bp, Homo sapiens
tcattatctaccttatattgttgtgagagtgtctgaaggcactgtaaactgtaaagtgccatgatatgtaacatgtaataattgttttttatatgtacaaatggaatcatatatgtaattatgaatccacatgaacagttaagtaatgggaaatgcatgaaaagaacacattaaaaagtcaagtaaaaatacacagaccacgaatctggggaagcacttcttcataagaaaccaaagcaaagatcaaagtctgttttcaaaggaatacaggatttctaaagcctattaacaattaagccacaattctttttacttatactcacgaattttgattggatgtattcttagggacagtgtcaacactggatgtactgaaggagaacaaaaataagaattatacagcaaattaacaggagtaaataattagccagaaagtcctatatgtgggccacaagccccacattgaatatccaataattggtagttctaaaacgaactcttgtttctttgatcccccattgaaaattttgacttatggagacgatttcataaatgtaaaacataaaattgtagacttttttctcttcagtttttaaactaaagaattcacagagctctcaatagttaagatatcacaaaggataaatgcttgaggggataggtactccatcatcca

SEQ ID NO: 158503 - DNA, 311 bp, Homo sapiens
gcaggcttctggctttctgtgcactttcagacattttggacatataatgctcctctgctatctgttctctcagggcttccatattctagtcctgagccctgtgtttcaggggtatctaggaaatcttgatttctttcaggtgttaacatctcaagttcctttgcttcatattcacacttgaaatcagatataacattccttactttttcctcctgttatttttgcatgcaaattaagagattctccaattgctctgtgtcatacgttttcttacgaataacagggcttatagtttcacttgagtaattttt

SEQ ID NO: 158504 - DNA, 120 bp, Homo sapiens
atgaagaagctagagatagaatgaagaggaggtgcggcctggtcaccgggggtcagcaggggctggatgcccaaagtattaggtttaaaggaactgggatgtatctccagagcaactggg

SEQ ID NO: 158505 - DNA, 574 bp, Homo sapiens
agggtgtctaacttggtcaacatggacttcagaatctatgcccaattaagtgctatcactttttctaggccccacagagaaatgtacaaacatatgagacattcttatctacattggtcacgtgtatgcaactacgcctctgttaaatttgactttcattattaggggatccaggaaacagtattgagcaccagttgtcatttcagtgagcacaggggtgggatgaaaataggatcacacatttcccccttgagtgtcatacgaatagtggagaggaaatcacatggatacagaaatggagctcatgttaaaaatcttatagcaggatataccatgctacatctcacagctttatagatgattcctggactctaccagcctgtttcaaattgaacgtctcatatgattattcttactttgcgcttgtagatccttttaattgtagtcccattctacctctagctgagggtaacagctatctcccttagagagctctctagcttccagcaggggcagctcactggccagaggggagggtaaagcattgatatggcacaataagggaacctccgga

SEQ ID NO: 158506 - DNA, 442 bp, Homo sapiens
tccagccgtgttaatgtcctgaatttcaccgttgactgacagtgtacatgtgggaacttgtccctgtttgtggaaaatagagttaggtatttggtggtgcagcatgtttgcgacttattctcaaatggttctgaggcaggaaaatagggtctggaggcagggaacataaggctgattcacacttcagctatgacaggaaacatcctctccatttacatagggcgtacagcaagtaaccaatggaaacctctagaaggtatttaaatgccaaaaaattatgtaacccagcccttgagcccctatgctccgccgcacccacactgtggggtgtatttttattttcaataaatctctgcctttgttgcttcattatttccttgctttgtgcgttttgcccaattcttcattcaagagaccaagcacctggacaccctccatcggt

SEQ ID NO: 158507 - DNA, 594 bp, Homo sapiens
ggtctagcatagtgtattagtccatttgccttgctataaaggagtatctgagattgggtaatttataaagaaaagaggcttattttgactcacagttctacagcctatacagaaatcatgatgttggcatctgcttctggtgagagcctcaggaagcttacaatcctggttgaaggtgaagcagggagcaggcacacagcatggcaagaatgagaaagagagagagggaggagctatcaggctcttttaaacacccagatcttatgtgaactcatagcatgagaactcactcattaccatgaggaaagcaacaagccattcaggaggtatcctaccctgtgatccaaacacatcccactaggcataccttcaccattggaggtcccattttaacatgagatttggagtggacaaacacccaaactgtatcacgtaggtataaatagattatcaaaggaaatgagagtgaaaaaggagaagcattatgtgaagaagttatggttgagactttttgaatacctctaaaagacataaaaccagtttcaaggagtgataccaattttaacaacaccaaatgctatggaaaaattgatt

SEQ ID NO: 158508 - DNA, 482 bp, Homo sapiens
tgctgggattacaggcgtgaattactgcgcccggctgccttttatttctttctcttgactgactgcactggctagagcctccaatacaatgttgaatagaagtggtaagaatggccactgcggccggcattaagtatgagtttttaagttagcccactttgttaatgactatgagtactaatagcttaagataaagaagtttctaggtaatcttgtttgaaggatgatgtaaaaatataaatttaaactgtgagtgacaaaataaacttccttaatatttgcctacatttagagaaatggagcattcagctcagaaaggaagaatgtctgtggttttaaggtaaaatccatattccaagactcagtgaagaaagttcagtgataaagaacagactactctcatcttatgaagaaatggagcaatttcacttggaaagactaggaagacaaaatgttacagacgtatttgttgtgccacaaaa

SEQ ID NO: 158509 - DNA, 386 bp, Homo sapiens
cagtgcaaactaacccagatacataactctttcatcatatgaaatttctctattgaagaaaaataatggaacccgtggtatatccaaatatttgtagctctaccacaacaaagtcctctactacttgctcatacatatgatttattaaactacagaaggaaaatgtcttgaatgtacgctagtttctcattttaaagacctttagagttacagattaaaggataatcattttcttatgtctgaaacctccaactacccaattctcccttcataactgaactttttacagatttagatcttgcctatatttataactgctgcatacagtccaacaaacatactccacacaataagtttgaatctgaactcttgtgcaagtgtccctc

SEQ ID NO: 158510 - DNA, 150 bp, Homo sapiens
ccacccaccctcccatccattcagcagagtgaccacggcgcctgcaggaatccagtggcagcgacatggggatgactccgccccatttcacaggtgggaaactgagtcatggggagactgagtaaaggcaacaagggcgactcgggggac

SEQ ID NO: 158511 - DNA, 406 bp, Homo sapiens
gtgacatggattatggctgtggtgtctttaattttgatgaactaaataaaaagtattgcagtttgagaataataaaccatcataactctctaacttccaaaccatggatgaattaaaaatatgtgcaagagtcagagatgaaaacatcagccttctaatttggaagactggattgcaaaatgtagcttgaacacaaggtcagaagtctttctatccattgactccatgtttataacttggacctatagattgttgagaattgggttttcaggacagacaggcagagaacttcatagaaaattccatctcctcaccccttattgaccactgtgagcccaagaagagtgactgtacatgcgcagtgatgcttaatgcactgattttactcagcagaagaacatggacc

SEQ ID NO: 158512 - DNA, 170 bp, Homo sapiens
actaaattctgggtttcaggcacagttttgtttgggagaagacagttttgctggactagtgtcaagagagacaaaaggaaagggctatcacacatggagtcttagagtttagaagtctcagaaaatagtttccttatgggtcgctttaaaatattgtcttaaggctaaga

SEQ ID NO: 158513 - DNA, 547 bp, Homo sapiens
tttcctatgcctatccctccttatgtacttatattgagcttccgagataggacaggaaagaaacaaaaacaccatctcccttaacaatacctattctttacatttatcttaacactgaaatcctatttctatgaattcaccttgatgatatacttccaataatactgcacaagattattcattgaacaattatttctaatcagaaaattttaaaaacagcctaaatgcccaaacatagcaggagattaaactatagcacatccacacaacagaatactatgtagttggaaaaaataaaaaggatgaccttcatgaatcgctatggagtatttccaggacatattattaagtgaaaaaagcagattataagtgtatatgcatattatactactatctgtgcaacaaagaactatttgtataaatatgcttatttttgcaaaaagaaatactgaaaggataaccacaatccaatgacactggttatctaaataaagggatggataggaacggggtagaagggagagaagcagtaagacaaagggaaaca

SEQ ID NO: 158514 - DNA, 393 bp, Homo sapiens
ccctttgcttgtttctcccttttgcttttcgtttctcccatatttcccttcctcttatttaacaaggccttgaatgagtgccctatgctagttctcatgatataagagggctaatatgattcacgtctcatgcagcctctgttcctggaaggtgtgtggaatagtgtggggcagaaaataagagaatgctttaatcagaaattaggataaatgtttaaagcaaaataactgaaagctgagaggatatgagtagaagagcttttgatgaggatttttgggaaggtgctttaaaggtaagcctgagggatgtagagaataaggtggccaagagtagggaagaacaaagatccagaggtcttaccacatgcaaagaccccgaggacaagagcatgt

SEQ ID NO: 158515 - DNA, 281 bp, Homo sapiens
tgagcccaggagtttgaggctgtagtgagctacagttgtgccactgtactctagcccaggtgacagagcaagaccctgtctcaaaaaaaaacaaaaagaaaaaacaaacaaacaaaaaagaaacaaacaaaaaatgcttacacaagagaaggtatcaggaggtaacttggatatattttcattctctcattctctctccttctctctctctctctctctctctctctctcacatttttcaagttagaaaaaggcaacgttcccccattcgaggctttgtta

SEQ ID NO: 158516 - DNA, 302 bp, Homo sapiens
gcggccgcctactactactaaattcgcggccgcgtcgacccgtcctgtggtctgcctcagtttatcacttaataatacaaagcaaacaagaaagcaagttagtggattacctgagagagcaagacatagagaagatgttaatgcagggagctggccttctccaaacatatccctaacacacaatattcaagcaattcccaaactgtgatcagagaaccactgggagtaagacctctgatctatatttacaagtctataggtgagcaaaggtagaccttttcctgagtctgagatgggaatat

SEQ ID NO: 158517 - DNA, 179 bp, Homo sapiens
tgggggacaggacctgaggtgtaagtgacacatgctacaacatggataaaccttttaacatcatgctaagtgaaataagccagtcacaaaaggtcaaatgagattccacttacggagagacctggagtagtcataattcacaaacaggaagaagacccctgattaccaggggctggggg

SEQ ID NO: 158518 - DNA, 340 bp, Homo sapiens
tacaagaacttgcaaataaatgggttgtttgggcaagaaattttgtaggtacgtaaaaccagaactaatttatagatcagtcaggctccgtctcatgcttggcagagaggctagaggtcactggtcactgaggaaaaaaatgcttacaaactgatttccagcccagttagcaattttaccagaactctttattctatcaaggctgcagaagagaggtaatgaggtcccatatgtacaggtgtgcaacaaattaggtcaataaatatgtctgttaaaaatacttaaataggaaaggtaaaaattacttaaacatgataagaaccattcagcaaaattcaat

SEQ ID NO: 158519 - DNA, 457 bp, Homo sapiens
ttatcttccctaccattacagtccaggaagacgccatagaaagtggtgagaatgctggggaccaggggacaatacccaactcaagtctcaagtttaaaggctcctgcaggtgagggaagagaaactaggggacctcatgctatttacaggcacacctcatattactgaactcacttgattgtgctcagcagatgttgcaattgtacaatttggaggttgtggcaatcctgcatacagcaagtctatcagagctatttttccaacagattgtgctcactctgtgtctctgttgtcacattttggtaattctcacaataattcaaacttagtcattattactacatctgttatagtgatctgtgatcaatgatctttgatgtcactattgtaattattttggagtgccatgaaccacgcccacagtgaactcgataaatgtcgcgtgtgttctgactgc

SEQ ID NO: 158520 - DNA, 204 bp, Homo sapiens
tttcacccatataattactattcagtctttagagctcagttaaaaaattactttttcaagaaattatctctaaagtgaactaaatcatatcagaatgctacctattttcatagcaatcttaactttcctctcagagcacatattatagttaaaattatacatttgtatgttttatgttgctccaaaattagccttgtgttccat

SEQ ID NO: 158521 - DNA, 267 bp, Homo sapiens
tgggacagcaaataagtgccccaaataagtgcaaataagtgatccaaatatcccccaatattctgaaacatcaaccgaggtatcaataaaaagcaaaaacagaggcattttagtagatcagttattgagcaaaagaattatggaaatgtttcacttgtccactctttatcatcaaataaaatgtttctgtcacctttttctgggttcattttaaatgatttcataaggcattttaattagcaacgtctactcagaaaagcagtattg

SEQ ID NO: 158522 - DNA, 319 bp, Homo sapiens
gcatgtgccaccacacccggctaactttgtatttttagtagagacggggtttctccatgttggtctggctggtctcgaactccagacctcaggtgatctgcccaccttggcctccaagagtgctgggattacaggagtcagccactgtgcctggcctagtttctcatttcttgaacaggtgttgattctaccaaaatctggaaatgaattgagtggtctgagttagggatgactcagatgttgcaatgtccatctgtgatggaagtgtcagtagttctctcttgatcttagagccaagtccctatgccaggttttctta

SEQ ID NO: 158523 - DNA, 422 bp, Homo sapiens
atttatatgaggacttgggtatttctctaacttttgatttcttaattctggggttttggtggggtgagctggtgcatagtgttgaatagttcaagttgataatcatattgtagttttcacataatacactgttatagtggtttactagatttgattgccgtaagcaaggaaaggaaattactttaggcttgaacctcacaggcttcccatgacccagcccttctgctagtagtcccactgacctgtccagtatggtatccccatctttctttgtttaactattaacgaggacttgcctactcttaattacacttacacattaactcttgtgaatcctggtagtgttttggcagatttcatgaaggtgagactacaagtattgtcaaatctctaaaaatgtattatcatttagacttttgtga

SEQ ID NO: 158524 - DNA, 562 bp, Homo sapiens
ggtgggtcatctgaggtcaggagtttgagaccagcctgaccaatatggtgaaatcccgtctttactaaaattacaaaagttagtcgggcatgatggtgtgtgcctgtagtcccagctactagggaggctgagacaggagaattccttgagcctgggaggcagaggttgcagtgaggaaaaaacaaaacaaaaaacctggcttgggaagtcgagactgtggttagctgtgatcgccactgcactccagcctgggcaacagagtgagaccatcttaaacaaaaacaaaacaaaacaaaacaaaacaaaaaatgtgactcaacaaaaagatctccctctcccgagctgagctgccttactctttgaaattcctaccctgtatgccactccttgactgcctctagagaagtgtttgttttagacagacagagtattttgtcacctgggaagggcagtatattagccagctaccactctagtaagaattagtttctgtaattaatcgttgttaagacatggagtatggaagccttagagattgagtcctaggccaggaaggtttggt

SEQ ID NO: 158525 - DNA, 677 bp, Homo sapiens
attactaactggtctctcctgcttccctttgtctgtgaactaaatacagggggcctcaagataattggtagctccatcactgacccaccaattatagatcagcagggaaggcagcccagggatggtttgtggttggcacaggctgcccacctagaaatgtgagttattctctacctgccaccaagttgggcttgactagatcgatcctttcctaattttggactttggcatctctaattgcatcacacggctccctggtttacaggtttcagcctcatttcatccctacacgtgctgctggtgtctttcttagttcatgcctccttggcatgtctacaaagtattaatttgcagaggttttgtttgtattttcctttgaggttccctggtgcctagaatggttagatggcaggctgcagataaataattctgttgaaacagcaggtttctgtgcatttttgtctggtgtgtccaagtaaaggagggaaagaagtcttcagggttgaagtacagtcagtaacctgtataaggagaaacctctgcaaactattgttgtagctaaatatgtttgacttcggcaattgaggacatgaatctgtgtgtagagtatcaacttctgattcttagtttgtggttggaaaactgtgtaggcttcattacgggattcccaggtagtg

SEQ ID NO: 158526 - DNA, 155 bp, Homo sapiens
ccgcctcaacctcccaaaatgctgggattacaggtgtgagccaccatgcccggccttcatccatatttttaacactcaagggaagtttccagctttcaggagtgactggctttatgaattgactaaataaatgattcctgaagattatttagtga

SEQ ID NO: 158527 - DNA, 548 bp, Homo sapiens
atgtgaggccaataaccctaatcctgggacaacatggcttcctaaattgagattcagttttcagcagccccaccccaagattgtcaagcagcaaagtctgtaaggtgagggagagcagtgtggttgtagtgggaggggacacaatgtttgtttagttatcatttatcgaacatcttcactatgtgctgggcataatgctaaggactttacaggtataaccacatttaatccccaccagaaccttatgagtaactatttgtgtctacattttacagatgtggaagcagactcggagtttaggccaaattcacacagctctatccaattccaaagttcatgttctcaaccacaatgacaactttctcctcaatgagattgttccccttatacccacagcaagtctgaatggcacttttgagggggaaggagtctttgtgcagacattgctaagctgatgtggacagcacaaacccaacaccgaagaatatcttagaccagatgttgatcaacttgctagaggaatgtgccaaagattcattcacacccag

SEQ ID NO: 158528 - DNA, 1058 bp, Homo sapiens
aaatgttctctggggagtcagagtgaaatccctcatattcaccaccaaaagtgcgtcccctttccccaaaccaggctgtgggagggtcatggggctgcatgaagtctccggaagggagaggaggcaggtggtccttccctctgcctggccccagtgccaggtgccaggtgtccgtgtttggagcgggcaggcttggggctggctgggtctccggggcctgccggtctgggtgctctggccaactgcccaacggccctaggagcaggaggtctggggcacacccttctagcctttccaggactcaacaagctttaaggtcattcagatgctaatttagactgcccttgtgtcagaatactaaggtgggaggcggagcggaggtgccagtcactctgggcgaggccttactgcgcccatgcatcccgggcccatttgtcagcccttgctcttcagtgggagcccagctgcaagcccagagtctggccactccatagtcctgcacccctcttttgattggtctttcctttgcccagagaggggctccagagggagataggtggtgaagctcatgcagggattctgaggacctgatgggggagggcctgcgaggggtccaagcctacatcaagaggaattcagtaccagggggagctccccaccaccccggaaaagggagaggcccagagatggaggtggcttgtccagggccccacagtaagttgggatttggagccagatgctctaagcccagcccttccgtttcctagctgggtgtcccttggcagatgccacctttggagcctgccccacctcgggacacagcgagcttcgagtgcagtcagcccctgtggagtgtgtccacagttacacagacaagtggggaaaatttcacaaaactaaaaaatggcttctcagccctcctttttcagtgaatgatgtggagccccacgcctagaaagcctggtccatgggcgagagactttgctgagatgagaagccagctggggctgctgcccacccaccctgcccaggctcctgaaggtggcctcaccttccag

SEQ ID NO: 158529 - DNA, 455 bp, Homo sapiens
ctaaggcttttctttttttgatacgggcattctttaagctctgacttctcttttcctctttcctctgccatctcccgtcaatctcttccagctgctggctgtactctgcaggggagttcagagtgagcgtgaagtacaaatcaacacctgcacccactccagctctgtctccaccttccaaccatttcccgtcctgacttttctatttctgtacctaacccaccccaacccattctgccattgtttttggcctcaaaacttggagtccgcctcacattcccactttcttctgtaagttctcaagtcctatagattctgcttttaaaatgtatagttcataaacgatgagctttgcctcccagatagattaaattggactgtggattggcacacggtaagtattcaattaatttttgttgaatgaaggaatgagtgagtggctcctccttaaacca

SEQ ID NO: 158530 - DNA, 394 bp, Homo sapiens
cttgttctcttcccagatttgtctcaaagtagcagccatgcccactgcttttccaattccagctaccacgcactggcatgtggggggcctgccaccagccaggccagcactctggacaggaacagccccaccaagctcagtaacaagtcccttgacagagacacagcaggctggaccccctacagctatgtgaacgtgttagactcccatttccagatcagtgccctggaggccaggtacccgcccgaggacttctacattgaacttagacacctcagccgccccgctgagccacactcaccagataagccttggatccaggagaggacagacaggaccagagctgagaggtgcttgtggaatggatagacgtcagaacacatacattatggac

SEQ ID NO: 158531 - DNA, 545 bp, Homo sapiens
tagtcacatagggactcaggaatcgggccaaagccagaaccagatctcctaacattagaggggttacacgcatctgaacccaggcccaggagacctgaagcgcaagaaggccagccccaggctcaggccctccctctgcccgcagctgccctcatgatggaggagctgaatccctacaccaagatcagcccagcactgggtgcagagcggcactcggtgggtgctgtcacaggcatcatgctcctgttattcctcattgtggtgctgctgggcctatttgcctggcatcggcggcggcagaaagagaagggccgagacctggctccccgtgtctcctacacacctgccatgaggatgaccagcaccgactactccctctcagcatcaaccacaccatggtggcctgtcatggaacacctagctcgccctttctctcaacggcctaggacccagctcagtaacaagtcccttgacagagacacagcaggctggaccccctacagctatgtgaacgtgttaggtcagtagtggtgtgagtctggtcc

SEQ ID NO: 158532 - DNA, 115 bp, Homo sapiens
gaataaacggaagataaaatgaaaacagcagacctgataatttgttttagaaagtttggataggcatatttaattttctttcccagaaaggatggcataaaaaggtacatgtgct

SEQ ID NO: 158533 - DNA, 239 bp, Homo sapiens
ccttgaacaacatgcctgcgctgaacagcaaaacctgctaccctggaatcgagagcaacagctcctgccaagcctggggcccctgtgaggtcacacacggccagctccttgtgaggggccaggaggccggcatgtggggtccggatccgctagaccctcaccacgaggctgtggtgatgctctggagggcacaggcctggcacccaggcacctcccacagatctccaggtcgcaagctc

SEQ ID NO: 158534 - DNA, 421 bp, Homo sapiens
ttctcctgtctcagcctcctgagtagctggaattactagctgggattacaggctcgtgccaccacatccgactgatttttgtatttttagtagagacagggtttcatcatcttggtcaggctggtctcaaactcctgacctcaggtgatccgcccacctcagcctcctaaagtgctgggattataggcatgagccactgagcccagcccttctttcttttttattttgtcctatctcattgtacattactactactagtagtactgctatgactagtactaataactactactagtcatcatcatcgtagtagtagtagtagtgataataatagtttggttttttggtaaagcacttcagattattttgtaattagataagtttataaaggaaagtatggattatttatatatgtctgtaa

SEQ ID NO: 158535 - DNA, 265 bp, Homo sapiens
ctttgaaaactgcacaagaaagagcttttcttctcccagaaaatgcacacaggtacatacaggcaaacaatctcaagggatatagattcctgcactaacatcacctcagtcttttctgctattgaaacttctaaaactaggcctagttttagaagtttcaatagcagaagcagcaatctgtacagtaaaatgcagtcatggaaaaaaaatctctctaaagcatctgaaatacttaaaaatgtttaactttaaaatgcatagtgat

SEQ ID NO: 158536 - DNA, 168 bp, Homo sapiens
tctccctcctatcccagataagaagaattgccttctttcctcccagctgatttgcttttctcgtcattatatggcaaaccaggctgcactcccctcctaaggcaggcggtggttctctttgggctctgagtcctcagtgttctgcctcttcgggtgccaaccaggaaa

SEQ ID NO: 158537 - DNA, 132 bp, Homo sapiens
ctgccttccatctccgggcccagtgctcccctgccccgcgctgagctgtctcccactcgctaccggcgatggggaagggacatctggggagaggacaggggacgcccttagtttttgaaggctgtggaagga

SEQ ID NO: 158538 - DNA, 739 bp, Homo sapiens
actcattgtttcttgtcttgtggatgattacagtttatgtccactctttgtctaatcaccttctttcttatgcattaaagttattatttcagaagaacatagaaacttttccctgttcagagaaggaaaactgatagagaatttagcctgttcaactaacaaatacagctgttgcaaatattgaatactgatatgttattcacagtaaaaataatcttagttgtaagaagtctatttgaattataaaataaatatatttcatacctgtcatggattaaaaaaattttttttaattgaacccgggaagcggaggttgcggtgagccaagatcgcgccactgcactctagcctgggtgacagagcgagaatccgtttcaaaaaataaaataaaaataaaaataaataaacaaatagaagaagttttcctttttcaaccttttggtcaaggctttatatggtgttattttcctgcaaaagagttcataatagcactttctaaaacataatctttcataagcatcggtatccaagaagcaaaatgtatgctcactgatcaaacagatgatcagctaaacgaagcaacagagagatgttcctcaagtaagcaacaaccagcaaaacctgaaggggtgtttatttctttaaaaattttggacatttttctttaaatcccatctgttgggcagcataaaatcgtactacttggtgaatcactagagaacgagaagactttggaaag

SEQ ID NO: 158539 - DNA, 239 bp, Homo sapiens
aaggccaaagaaggctggaggagggagagagcagagtagcactggtgtcgggagagaaggaatggagttggtttggaccatgaagaatgggtgggattgagtaggcagagggtaattggaacagcatcaccaagtatatttgggtgatggtgagaatgcccacctgatgagtagaagaggcagaaaaggcaggaagccctgataagcctgatgcactagaatggatgtgaggtgctata

SEQ ID NO: 158540 - DNA, 354 bp, Homo sapiens
ctgaaactttgcatgactgttctatgcacttcatttattaaaatcattcagttcataattttcattcagctagcagtgcgttctttgcagcctagcgggtttctatattgacaattccaaccacccttctaagaataccacagagcagtttcccgttatgctggtttatatattctcagcagtcgtttttactctcctttcataaaattattataccgggtcctcaattctggtaatcttgctaacttatttttatactgttctcatagctactgcagttccatcactaggaaatctcacaggatgttagcgtcaaatatactgacttctaatttgttcattccccattaactc

SEQ ID NO: 158541 - DNA, 686 bp, Homo sapiens
aagcagtggatgccgatggctgagttctccaggtgcttctggatggagtagttgttggtcatcaccatctccatgagcatcttcagggtcgggtactcctcccacgcagccaggccgatgttctctgggttgaatgcggcgacgaccagcaggaggggccaggccttccagtagagggtagagatggcgaggttcggaggctggtaccccggtgggagctggatgttttcagggtgatggtaggtgcacagattcagaacggcgtcgatcagctgggtcctccccaccttcagcacctccacatcatccgcctgcacggcagccaaccgcatcacccgttgaacgggtgatgcggttggaacgggtgatgcggttgtcagatgcacacacttagaaatgttctgagcataggcacctgccacggaatcaccttcgcaaattcttcatttaaatttatgcctctggtagcataagggagaagagatctgcctttggttctaactgtcagtcatcctcacgcccaggccggggttagaggtggcgtcccttttctctggctcaggcacccctggcctagtggggttactggtggcgttcccctatctcaggccacacctggcctagctggtgttagtggtggcatccccttgtctctggcccacagaacccctccggtccacacacac

SEQ ID NO: 158542 - DNA, 432 bp, Homo sapiens
tgggggaaggtggggagtgaagtggtcagaacgtgcccacaccccttcctacatacagcccttccagagcccagctgggctgctgccaaactaggacggggccattctctgtcgtgcggttgtcagatgcacacacttagaaatgttctgagcataggcacctgccacggaatcaccttcgcaaattcttcatttaaatttatgcctctggtagcataagggagaagagatctgcctttggttctaactgtcagtcatcctcacgcccaggccggggttagaggtggcgtcccttttctctggctcaggcacccctggcctagtggggttactggtggcgttcccctatctcaggccacacctggcctagctggtgttagtggtggcatccccttgtctctggcccacagaacccctccggtccacacacac

SEQ ID NO: 158543 - DNA, 668 bp, Homo sapiens
tcgtgccgctcgtgccgctcgtgctgtttggtctttgaccccggttcccaacaaacagctcctactcccttggaatttattgggtgatgggagtgtcttgttctaatgaagcaactctaatgggctcctggacggggctggtcaccagaaagaccaggttatgctgagaagcttgaaaccgtcagtcccccgccaccccatcctctgggaagggaagaggagctggagatcatgcccatgtgatgaggcctccgtcaaagtccttgcactccgggatgtggctgccggacatgcggaggcgctgggagagcggcacacctggagagggcgtggaagctccaacaccccacctccacaccgcgtgctatgcatctctcccgtccagctgctcctgggtttcagtctttcctaatgaacaggcttctgcacttctgatgactccatccagatctccagcttgtcctgtggacccatccatgcagaagcagactcggcaggcacaaggaccattttccacacccctatgattgcacctcatccaatcagcagcacccactccctagtccccagctccctccagattatccttgaaaaaccctagcctctgaattttgggggagattgacttaagtaataaaattccagtctcccacttagccaaaaaaaaa

SEQ ID NO: 158544 - DNA, 430 bp, Homo sapiens
acacagaaaggagtgacctctccaaccttccataaatcatcagaacactgcagagtgacagtgggaactccagagattaaacacggaggtgaggctggccagggatcacaagaggcccaacacccagacagtacggaacctgggtgggcacctcgtccgttttgtcatccacagaccagaggcttctgcacttctgatgactccatccagatctccagcttgtcctgtggacccatccatgcagaagcagactcggcaggcacaaggaccattttccacacccctatgattgcacctcatccaatcagcagcacccactccctagtccccagctccctccagattatccttgaaaaaccctagcctctgaattttgggggagattgacttaagtaataaaattccagtctcccacttagccaaaaaaaaa

SEQ ID NO: 158545 - DNA, 590 bp, Homo sapiens
tcgtgccgctcgtgccgctcgtgctgtttggtctttgaccccggttcccaacaaacagctcctactcccttggaatttattgggtgatgggagtgtcttgttctaatgaagcaactctaatgggctcctggacggggctggtcaccagaaagaccaggttatgctgagaagcttgaaaccgtcagtcccccgccaccccatcctctgggaagggaagaggagctggagatcatgcccatgtgatgaggcctccgtcaaagtccttgcactccgggatgtggctgccggacatgcggaggcgctgggagagcggcacacctggagagggcgtggaagctccaacaccccacctccacaccgcgtgctatgcatctctcccgtccagctgctcctgggtttcagtctttcctaatgaacagatgagtcaactgaggtaaagagcaacctggctgaaggtcaacagcagggctttttaatcagatccatgctgccccaaaataatgaaaccctggatcagcttcttttccaaatcttgagaatacaggctcctgggctgtgaaatacaatttgaaaatgtttctcttctaaca

SEQ ID NO: 158546 - DNA, 419 bp, Homo sapiens
ctgagccacaggggttttaggagcatctttcattctagtgtttggtctttgaccccggttcccaacaaacagctcctactcccttggaatttattgggtgatgggagtgtcttgttctaatgaagcaactctaatgggctcctggacggggctggtcaccagaaagaccaggttatgctgagaagcttgaaaccgtcagtcccccgccaccccatcctctgggaagggaagaggagctggagatcatgcccatgtgatgaggcctccgtcaaagtccttgcactccgggatgtggctgccggacatgcggaggcgctgggagagcggcacacctggagagggcgtggaagctccaacaccccacctccacaccgcgtgctatgcatctctcccgtccagctgctcctgggtttcagtct

SEQ ID NO: 158547 - DNA, 458 bp, Homo sapiens
cttactaagaaacttggaatggagtctgatcaggcctgtgtcagtcacctgaggtcatgaactccaacagcctgaaacatccaggtctctctgcggggctttcaagaagttggactaaacctcagctagctgaggcttaggcatgtccttgaggctgtcttggggtaggcttacatgaaaatgctctaaaatgcagaaacacatagacggagggtatgaatggtaactggggtaatgaacagagagatgatttgccaagatgcagaggcagatggtggataaaaaccaaagctgagagtcaagaaccagattacacctgatccaacggaagcagaaagggccaatgaagagagcctgggtatactgctgtgaaccctgtggagggttacggctcacttctatgggctgctaggctgtctgactggcccggagacaaaggttgtaaggaagcatgaacc

SEQ ID NO: 158548 - DNA, 199 bp, Homo sapiens
agtgtttctagtgtattgtgagtttaaacatttctttttcatttattcaactgtgttgtgtatgtactgtatgcatatataatataaaggagaggaatttccaaggatatttctgaggctattaatgtgacaagtacattaaagacaaagcaggtaaagctcttttactctagtttataaggaaattgttgctctgttc

SEQ ID NO: 158549 - DNA, 394 bp, Homo sapiens
gcaagagaagagctggagcttaaacctgaaatgtgtgcctctctgaagcccataattattccactacacaccgtctctcttaaggactgtgagtgacgaatgaagcagagtcactggtatcttttgagcaggtggtgacaagttcataggagttttaggagggcaaatgttgcactaaggtggattgccctggggagaaaatggagccaggattagaccactttgcctagtctacatcctgccacctgctgttacaacgtccttctgttgtcagggtcactcatgaaatgcagtaaaagagctgtattagttggtgcaaaagtaatcgtggtttgtaatggcaagaaccgcaaatacttttgcaccaatctaatacatccataaatggatatat

SEQ ID NO: 158550 - DNA, 507 bp, Homo sapiens
ttcacagtttgacaggaagaatgtattcatgcaatccttgcaatttggttgtttgcaaaaatagctctaattcttcccatgcctgcattccaagccatatgtgatgtgactctgcagttcctcatagcaaatggtggagcctattctcccatctcttgagcctgggctggccacctgacttgatttggataaagaatgctgtgtcagccaggtgcggtggctcacacctttaatcccagtactttgggaggccgaggcggctgtatcacctgaggtcaggagttcaagaccagcctggccaacatggcaaaaccccgtctctactaaaaatacaaaaattagccagacacagtggtgcgcgcctataatcccagctacttgggaggctgaggccccagaattgcttgaaccgcgaaggcagaggttgcagtgagccaagatggtgccactgtactccaacctaggcaacagagtcaggctctgtctcaaaaaaaaaaaaaaaaaatg

SEQ ID NO: 158551 - DNA, 226 bp, Homo sapiens
cattctctcacctgattatcacttttgtttgtttgtttgttgtttgctttaattttttaatttttttatcttttaagttctggggtataagtgcaggatgtgcaggtttgttgcataagtaaatgtgtatcacagtggtttgtggtacctatcaacccttcacctaggtgttaaccctagcatgcattagctcttttctctaatgctttccccactcccctccccc

SEQ ID NO: 158552 - DNA, 269 bp, Homo sapiens
cctcactcgctggctcctggccggggacccctgatcctgagcacacagtgggttcatttgcatcacaactatgttactacccccctgaaatgtcgactgtctggcaggaccctctctttttgatacctgccttctctccgcttacatcacaagcatgtgcagttgtctctctgagcagccagtgacctcaagaaacctctttcttcccacttcctgaattactatgaatgagatacagcaggttcccaactccctccacaggctccgct

SEQ ID NO: 158553 - DNA, 216 bp, Homo sapiens
acaggcatgcactaccatacccagctatttttttgtgtttttgtagtggagacgggattttaccatgctagcatgaggccatgctggtctcaaactcctgtgatccacctaccttggcctcccaaagtgttgggattaaagacatgagcctctaatttgatttgtaatgaaaccaaacagaaacacttatgaaatgatgtcagcctgtctcagctg

SEQ ID NO: 158554 - DNA, 246 bp, Homo sapiens
cactacacctggctaatttttgtatttttagtagagatggggtttcaccatgttggccaggctggtcttgaactcctgacctcaggtgatccgtcctcctcggcctcccaaagtgctgggattacaggcatgagctactgtgctcggcctcttcaaaagcctttgaaacctctttggtttttgttttgtttcgcttttgtttttaaagagatggagcctatgttgcccaagctggcctcaaactcc

SEQ ID NO: 158555 - DNA, 497 bp, Homo sapiens
ataacggcggacatctccatcagcccagaagacatcaattttcagaagacaatctttcctaggactgtaaaacaaaaggtacaaaatatattagtttactaactctactttgtcatacactggcaacctctttaacatccagaaagactagatgttgtcaattaggactcgtctgtcctttatgtacactatatacacagataagtaaaacaaaatgcacagacataatgattcatcttgcctcgctgtaaacaggatggcatagagctctctgcacctccccctcctctctcctcccctgaaccactgcacaaacacaatgagtattactcaacaggtgattttgcagtggttcaggggagtacagagtcctgggagagtgtatactggtggccacagcttattctaagtggtctgataaagtccttgaagtgatttcaaagtgagacccaaagaaggagttagcagaagatcttgttcagggccaaaggataaaa

SEQ ID NO: 158556 - DNA, 187 bp, Homo sapiens
cattccttcatttttaaatttctctgtacattgggatactctagaaagttaattttttggcatcaagtttagaactttaaaattctactcacagctttgagcttaagctgtttattagcactatttgaaacagtgaaactttgtgaactctctcctcctcaaacaatgacatatataactgtattta

SEQ ID NO: 158557 - DNA, 374 bp, Homo sapiens
gcaatacctcttgagaaaggcaggggaggggctaggagaataagaaaacctccacacctggggaactggcttccacatctgttctcagtgatgcctgagacagcagccagggcaatgtcctccccgcttggcagaccctgcccatatacccatctgcagcaaaggcatcatctctggacatgcggagaaacaccatgggaggtcaagccacactacacagagagaagagtgggaagcagggcagggaccaaccgtgcagtgggaacagagccgtcatcaaccctggtatccctccagctctggccttgagtggggcccctgcagctgccaccaccccctcatggacccctcctgccacagctggagggtctccc

SEQ ID NO: 158558 - DNA, 363 bp, Homo sapiens
gtctcactctgtcacctaggctggagtgcagtggtgtgatactgggtcaatgcagcctcaaccctctgggctgaagtgatcctctcacctcagcctcctaagtagctgggactacaggcatgcgccactacacctggctaatttttgcaatttttgtagagacgaagtttcaccatgttgcccagttctcatgcctccttgaactcctgaactcaagtgatctgcctaccttggcttcccaaaatgcagggatcccaggtgtgaggcaccgtgtcctgccctctccacatctttcttaagcacactgactaaattggtctaagtagagcctaacatcaactgaagggagagggtaatttccag

SEQ ID NO: 158559 - DNA, 460 bp, Homo sapiens
gcccgactctctctctgtgggggcttttcgcgtgtcccccgagatgtcgaggaagccaggtgagttcctcgcgacaggcgatgcctattgcaggaggggacaggtagctgaggcgtggacagagtgacaggccaggctcaggggacacaggtgagaccccctcactgggctgccagttcccgggcttggggcatcccagtacgtcagcgtctgcgaccttacctcctgacacctaaggccagagacagagcaggcccgcgccctgggaggtcctgatgtccagcctgaagattgaggacaaagccaccacctttcacaaaatgaggccagaccacctgcctccctccagtccctgcggcctggagacggagtcaacattcttatctgtgttggatctgaatgttcctccttgcaaaggaaacaaggagtggacgttcaggctgatggccagcttcaaaga

SEQ ID NO: 158560 - DNA, 398 bp, Homo sapiens
aacgatggtctcagctcatgatccacccgcctcggcctcccaaagtgctgggattacaggcgtgagccaccgcgcccggccaggaaactttttaaagggcttttggactgctgtggccctctcaaagggtggtccagaggtgtgggttatcctctctcatggtgggcggggccgatagtgggctcagtcctggtagaggaaggcagaatagagcagaggctgcctctcctccccgctgcctctgagattccaccccagctgcctgcaggtaccagcacatccatccatagctacttcgcaggcagcccagccagtgctcgactcctggctcgaggtttgtgctaatccaaccaagaatattgatggtgtgatgagagacttgaaaagctgtaaacaat

SEQ ID NO: 158561 - DNA, 407 bp, Homo sapiens
cctgtgtgtccttctgtcttttcctattctttatctacttgtctttcttactttccttgtcgtctctttatttctattttgccattaatttatgttccatgttttcattgtaggctacctgaaatccttttgggaataaggtggggtatacaaaccaaacaatatgtaaatgactgcctgaatatatgcatgtgtgaatgattatcaatattttgacttgtgaacaatcaaaaagtgcataggtggaataaggaacgaataaagagtaatgttgaatcttgatacagtacagtgcatggtggggctttggaaatcagtgaaggagttataaatgtgtaaataaaataactgaacaggaaaaagtaaggcatataagatgctaattcatcagctaaagggggaataca

SEQ ID NO: 158562 - DNA, 219 bp, Homo sapiens
cccagactctacctgggataccctgctggccccaacccatcgcataatgtcgccacaacctagatcctcttccgtgaccacctgtcctaagctgcctcctcctcccataagattttttgatcccttagtctccttctctccatttagtctttccagtattaactccagagctccagtattaactcttagtatcctgattgtctgctggcatagagagag

SEQ ID NO: 158563 - DNA, 300 bp, Homo sapiens
catggccaccctaaaaatctcctcatcataagcaaagcccaccagatcaggtctttgtctatttagttcactagccatgtccctagagcctggcttgctgctgttgctcaaaaaacatctgctgtgggaaggcaaagggacttgttgcagccctgcccaacagttacagcctgtgtgcctcaagacagcacacgtcaggggaagccatctgaggcatctctgctgagggtgagcctccctccagacatcagatcaccaaccaagagatacctagcaagggagtggatggaataaagcaga

SEQ ID NO: 158564 - DNA, 250 bp, Homo sapiens
ctgtgtactccagttgcggtggacactgaggaagagaccacccaagtgtgggaacagggccaaggctgagctgatgaggtgttttaaggggagaagggactcggagtcccaggttccagacaaggggctggtacttgctagatctgtattggaagtttcatagctgaagtgaggagttgatactgggcaggctgaagatgtggagcccaaggtcaggagccagaagtaactagagcaaagaccccaaaag

SEQ ID NO: 158565 - DNA, 381 bp, Homo sapiens
ctcatgtcagtgtcctcggcagaaactgcctggttatcctcagaaatctcttcaacacatgccactctgaagatgtacctgccatctctcgatagtttaacctaacaggtgattttgttggatgttggagataagacagctctttctctgttatagcaccagatgaagtgggtggcctggctttaggggccacactaggaaaactacatgttgttaatagccagattggcaatcagacctattattattattattattttgagatggagtctcactctgtcgcaaggctggagtgcagtggcacaatcttggcttactgcaacctctgcttcctggttcaagtgattctcctgcctcagtttcctgagtagctggaattac

SEQ ID NO: 158566 - DNA, 311 bp, Homo sapiens
tgtcttaattctctcgatgaacatgtctaatcatccatcagagtcagagtgactgttttatcactgagtagattgtacagagtttcttataatttccatatacattgatgaaaaatgggttgtgcatattggtcttcctctgaagtgtctttatgtggtacagggaataaaaccacctggattgtatatcaagagtcaacacatataaatgcagatctcttaaagtaagatatttcatactcttcttagtttattttatttggtggtctgaaatttaaataatctgtaaagaattaagataatgcctttta

SEQ ID NO: 158567 - DNA, 673 bp, Homo sapiens
catccacatcctattctattctatcaattgtgcgtatgtactttcacatgtatataaagagataactgcatgttggagtcccagaatgttcacaatcgttttctctgggcactgagatttggggtgaattttttcttttaactttctttttacttttttgtactacttgggttccttttttaaaaaatattaacatgaatcatcttaatgcacacagaaaaacccatctattttaatttcaaaaaataagaagaatggttgcatctgtatgtgggtgacagaattatttatgggggtatgatgtaactgtcagagagggatgcttccccatacagtgttcattgctatttggagcaggggaatgaatgctttcagaatgaggaagataaataagaacatggtgggaggtgagaaaagatagagaagttaggaaatctgagatggtcatcattatgggatatagaagcttcccaatatgtacatctcggttcgttattagtatttggaacgctgggggtgtagctatttcctgatctttcccccgcctcctccgtgttctgtcttgaaaaactatgaagccacttagaagccggatgtactgttaaaaacagtaggttggcgccacctagtgcccacgttctgtcactccgccctcatgtctccgtggaagcct

SEQ ID NO: 158568 - DNA, 155 bp, Homo sapiens
gaatgtgatcagataccaaggataggagattttggctaaactgactcagcagaattctgctaaaactggactaagagtccaagagtcagaaagaggactcaggcagggtgcaatagctcatgcccataatcccaacactttgaaaactgaggtgg

SEQ ID NO: 158569 - DNA, 166 bp, Homo sapiens
cacggggggctagggagatgagatacgggggcataggcagatgctggtgagatgactcagcagaattctgctaaaactggactaagagtccaagagtcagaaagaggactcaggcagggtgcaatagctcatgcccataatcccaacactttgaaaactgaggtgg

SEQ ID NO: 158570 - DNA, 407 bp, Homo sapiens
gggttctctttgtctcacatttgtgtgaaaaggtacgagtgttccaaaagatgtaatatattccggggattcagtattgtatgtacaaatttaagtacacagcaatgattgaagaatcatctcactttctaggatgacttgctgtcagaaagaatatttgttgttctgttactttactctcataatagattaattactttatctttcagagttgtctttttttttggagacagagtctcactctgtcacccaggctggagtgcagcggcgcggtctcggctcacttcaacctccgcctcccaggttcaagcaattctcctgcctcagcctcccgagaggctgggattacaggctcctgctaccacacctggctaattttctgtatttttagtagacacagggtttca

SEQ ID NO: 158571 - DNA, 537 bp, Homo sapiens
ctgtcttacagacagaccttacagagaggtcatttggctagatagggttgaagctggaaagaaatatgcttcaaaggaggtttctcttgaaagagagggggcgtgattatgtgatagaatgatctagtagaaatacaattttcaatttttttggtataaaaaatgatcttttatccctcaccacatcccacctcaatctaagtcttaactttctcgtctgtacaatggttatacaaattaaaactaacattaatcaatattcaccgtgtctcagggtgtgttgagtgcttacacatattaacacatcccatccacagagcctatgagaggagttgtgagggttaagggagaagctcttggtgtgtggataatgttcataagtagaagctactattgctataagcatcgttcttgtcctgaccctgagcttcatagtgcagggttcgggattgtaccccacaacacaacacacagcctggtgagggctaagagttctaatttgttacagatttaccgacctatcctagatgatttcca

SEQ ID NO: 158572 - DNA, 217 bp, Homo sapiens
cctgggttaaactcggtgagcactttaagcacctagaggatcagctgtgtctcaccggctgagaggggcaaaggctctgactcaaaaggaaatttcctgatccctcagtgtgaatacagagcatgggactaatacggggatggtaaatggttaagagcaagaacagaaactcaaagggagggagggagcaatctgtatgaatcccgttttccaggtg

SEQ ID NO: 158573 - DNA, 273 bp, Homo sapiens
gtgctcagaatacagaaaaatgggcagtgatgccctaattttagatggagaaaattagaacttcagcaataatccaaacctcagataatgcttcattaatcaatactacatccaaatgaggaaatacaaacttttagaaagccaccttaagataaaacagttttttctactgcttcttcttccttctccttatgcagttttacactcttcagaactctgccatttcttcctggaatatgcaatgtcgcctttaattctttttttttttttttt

SEQ ID NO: 158574 - DNA, 243 bp, Homo sapiens
agtcccattcatattccattgcaacactttataatacccctagataattgctaaatagtcaagaaaacagaaatataggcttaatgaaaacatgagagaaaagttcaaagacatggaggagaatggatgaaagcgggtgagactggaggaaggaaaattggctagacctattaccatggtagtaattggaggcaagaggtgatgagagcctcaactcaaacaatgggatgggggcggagtgga

SEQ ID NO: 158575 - DNA, 146 bp, Homo sapiens
atctgaagatatctttatttcacctttacttgaatgatagttaaatgtggttagagtgtaaaggttgacagttattttccattagcacttgggagtggtgatttcttttcttgtgttttgtttgtttgtttggtttgtttggtttt

SEQ ID NO: 158576 - DNA, 614 bp, Homo sapiens
ggggtttcttaagatggaatcctgtccttcgtttcctattttctttaggattatgtaataaaagaccacgtggctctttatctattctacagatctttaccagcagcctgctatccgcttgttgccgtggggaatcagaaccactcctggtccgtactccaggaaatttacaggccattacaggtaataggcaagactccaagtggtccattaagacagaacttgtgaggaccccagcaggagggatcttgatggattggagaccacgtctcagtgtcatgatgaacaagcattggagaagggccctgaagggacagggtgtcttgtgctgcagtgcatgaggatctgaggtcagcatcccctgttgcgtgggggtgaggaagtggaaatgggacgatgctgagaaggggacgcgggcaagagctcaagagcacagctggttcaccaggaagtggaaaactaggagcgcatttgggcaaagaagccacctgagtggggcttccagatgtgcacatggtggtggggcctgtcatgtgcggacgcaacagaaagagttagcagaaatgcagtgacaagcggggctggtgtggcagcccttcagtgggggtaggggc

SEQ ID NO: 158577 - DNA, 406 bp, Homo sapiens
tatcttttgcagtttccagctaggatcagcacagaccgggtcagttcctgctacacctacttccaagctccagggctgcaggtagaagcagcagaccattagccccagaaacaggcactgtgctgcctcctctgaagattcctcctcatacccactgccactttggagcaggactgtgccaagttgaaaaccaaatgagggccaggcacaatggctcacacctgtaatcctagcactttgggaggccgaggtgggtggatcacctgaggtcaggagttcgaatccagcctggccaacatggtgaaacccgtctctactaaaaatataaaaaaaaaaaaatagctaggtgtggtggcaggcacctgtaatcccagctacttgggaaggtgaggcaggagaatcactt

SEQ ID NO: 158578 - DNA, 557 bp, Homo sapiens
aataataaaaagcattctctctttccttttaaatcattctgctatacaaattctgtgtaaccacagtctaatatatccaatgcctcaatcttctgctaaacgttcacattttaatatattgcttctcatatagagccacttatcaaatttagaaattttcttatgatgatgttaactcaaatatacctttttaaactaatattcttggccagctcctaatcacattgtacctaggatatgaaaattgcctcctcagccgggtgcggtggctcacgcctgtaatcccagcactttgggaggccgaggtgggcggatcatgaggtcaggagattgagaccatcctggctaacacggtgaaaccccatctctattaaaaatacaaaaacaaaattagctgggcgtggtggcgggcgcctgtagtcccagctacttgggaggctgaggcaggagaatggcgtgaacctggaggcggagcttgtagtgagccgagatcgcgccactgcactcctgcctgggtgacagagcaagactccatctcaaaaaaaaaaaaaaaaaaa

SEQ ID NO: 158579 - DNA, 400 bp, Homo sapiens
ctcattctcttttgcgttgcaagcatttggttaaaggtatgtacatagtcttcagtaccagagaaaatctgggagccaggtttatctaatcttctttactcctactctgtgcaactaaaggcttgtcaaggtctggtaattttactttctcaacatctcttaaatttgtcccatcttcctagccccaagacacttaattactgcaggactcttgtattgctttgctgggtgattttttttttttttctttttactttctgtcttttcttttttttgaggtggagtcttgctctgtctctcaggctggagtacagtggcatgatctcggctcactgcaacctctgcctcccgggttcaagtgattctcctgcctcagcctcccaagtagctgaggttatgg

SEQ ID NO: 158580 - DNA, 345 bp, Homo sapiens
ttatctataacagagtaggctcccctactcttctgtgctctggcttagtgagctgatttccttccatcacagatgcaaggctagatattaattacaaaaatactgtctaattgaggactgctaaatatatgttgctagactaactagaaactacagttcttgatggttaggtctacctccaggtagacctaacccaaaaatgcctttcctcctgttttccgactggggagccccattccctgagttccctgacacctcagcctttcactccagcctctcatacccacaagagccatctgtatgtacctctattacagcacctctgaaaccgtcttgtagttaagt

SEQ ID NO: 158581 - DNA, 698 bp, Homo sapiens
ctaatagtagtgtaaagtggtggactgctctacagagcagcacagtggttcctcaaaaagttgaacatagaattactatatgacccagtaattccactttgaggtatatagccccaataattaaatgcagggacccaaaaagatatttgcatagcaatgtttacagcagcagtactcacagtagccagaaggtggaagcaacatcatgcccactggtggatgaatggataaacaaatgtgatatatgcacgcaatggaatattattggaatattattcctttttaaaggaaggagattctgacacatttcacaatgtggatgaacaatgaaaccttgaatacattatgctaatggaaataagccaaacacaaaaagacaaatactgtatgattccacttatatgaggtacctaagataggcaaagtcatagaggcagaaagtagaatggtggttaatagggactggaagatgacaggagttaggaattactgttttacaggtacagagcttcacatgaaaaagttctagagaggaatggtgggaatcattacaaaacattatgaatatagttaaagcaactgaactgtacacttaaaatagttaatgtgatacattttatgttacatgtattttgcccactgaaaaaataaaaatatataaacatacagcaaatgatgaccaggcctttgaagaaagc

SEQ ID NO: 158582 - DNA, 366 bp, Homo sapiens
gcccctcagctctaagaattcttcttttagcctttttccaactctgcccctttgcccaagggtctggctctttcattaattcctgcagggctgtgttaagacttctatttttcttaaccaaactctatagttacagtaaggataaaagaccttgttttcatcccagtaaccccttctcattaattcaaaccaccacctccctttgccagaccagtaactggaagaatctaggaaacatagggtccatcagagcatttttagtacatcccctgctttcactttctgggagaggctgatcagtttccttgatctcccactccattttctccgagttctacagcaatgtctttagcctgaacacaaacg

SEQ ID NO: 158583 - DNA, 335 bp, Homo sapiens
aggccactgccactcaccatcagggcaactgagttgctgtttaacttcttcttttcatttttttttttgagacagggtcttgctctgttttccaagctggagtgcagtggtgcaaacatggctcactgcaaactcaacttcctcggctcaagcactcctctcttctcagcctcccaagtagctgggactacaggggcgtaccaccatgcctggctaatttaaaaaaatttttttttgtagaggtatagtcccactctgttgcctaggctgttcttgaactcctgggctcaaatgatcctcccccgctggccccccaaagtgctgggattacaggt

SEQ ID NO: 158584 - DNA, 130 bp, Homo sapiens
gtttgcatgttgtatacttaaaaataacaccataataaagtcttcctttgagtgccggcctgtggttattgactagtgggttaaataataactgcggtaggaaagacaaggcagggaagacaagaaatgg

SEQ ID NO: 158585 - DNA, 420 bp, Homo sapiens
gtgtaaatcaaactgttctcagctaccttatacctgaattactgagtagagcactaatggagaaaatgacatagccacgtggactggaggaagtacaaattccaaatcttcagcctcatggggctgcaggactgatgcaggatctgctcctaggcaactcattcctcaattacccattagaaaccattaagatgtacagttgctgtccttgctgtcctccccagcacttaggagcctcttagccacacttatccaggttttctttcttcctcttacactggaggttcaaggttaatcctttcacgtattctccaaattcctcttgctgctaacttctcagaaacttgcttcagcatctcctctctttcttatactgtctgtctctcacctttgtatggctttaaacttgctcatgactct

SEQ ID NO: 158586 - DNA, 313 bp, Homo sapiens
tggcccatgccctcaaggaattcagggtttagaagggaagacaaatgggtataaaaataattgcaataggataggacgagtgctgtgcaaccctgggggtgaggtcacctgagggaggaatggggcctgtgaggtgactgaagaaacaatacctgctccgtgtcttgaaggatttggtaggaattttctaggtggatagtggaaaggtgggaaagtcctttgcagggcagcaaaccctgtaagtgcaagggtttggaacctcaaacaacatggcttcttcagaaaatttcaaggttgaggatggtccgcagca

SEQ ID NO: 158587 - DNA, 392 bp, Homo sapiens
gccactgtgtgtggtggaaacgtctcttactctcagatattgaaagtcattatgcaaaacgcagggccagtcaccctgctgtcccctccttctcagcaacataaaaattgcttggattgtgataaccctccagtggagtttttaaaccttttgaattagctgtggggcccttttttccccagaataaaactttatatagtaagtcagggtattactagtttgtgtgtattcttcagtcaagtagatggcatctgtttattctgagaccagcattgtgcactggcatgggaggtatagccagaagggacagtgcccgggagggtcctgttcaccaggggcagcacccaggccagctgccacaagtccaaggtccacacagaaggagttactgg

SEQ ID NO: 158588 - DNA, 961 bp, Homo sapiens
acatacacacaaacacattcacacacagacacacacattcacacatgcacacacacactcacacacattcacacatacacacacagactcacacacattcacacacacattcacacacacagactcacacacattcacacatactcacacacacacacatacacacgctggaggaagtgctcctctcctgaagcttctgtctttccaacaagactgggaaacccttaaccccccaatacctcttgggcatctctgggtgcctggtatgtggcatgctctcagcaggaggctcttctaataaggtttaacatttacggagctttactgtgggtcaagctcagttcaaaacatcttcacaactctgtggggtgggtatactttattcatccattctactaatatttattgattacttccctctggctaggccctggtccaggcactggggatatggcagggtaaagatgatggacagtgctagaggtggggggaagagtccctgttttatctcagaagatcaggaaaggtgaaaatggagcagagactgagggaagtgaggaaaggagctatgtggagatctagggaaagagtggtccaggcagagggaacagccagctcaaaggggactatttgatggtttcttcctccatttgatggagtccaggtaagttatccagagtcacagactaagtggcagagctaggtttcaaacccaggttctgtaactcttgactcatacctcttgaaccatgcttctttaccatgttttgtgggacacagtagctgccttagcaagtggttccacgttcaccacctccccctctgattggagtttggcctcctgtgtcaaggacagcatggctgattgcctgccttggtatccagcttcacttgttgcctctgcttttctgctttgtgtattcatttctgtggtctgtattagagacagtgagattgtgtg

SEQ ID NO: 158589 - DNA, 476 bp, Homo sapiens
atagtagtttaagaacaatgaaattggatggctactgatggagtaaacctgtgctttggagaaagacaatgaaaggttgaggatgatgaatcaccaattaaaggctaaggaagaaagccagtgtgcctccttagcagcatataaaggaagtaggagctgcataaggcagaaaaagcggaagatgaagctcaggatttaattataagagcagaagaacgccaaaaaggttttcagcctagtgagtgtactataccaaggtcaggggcatagttgagaagtgggaccctgacactttagatggggcatctgggtcaatgcacttgagaaccttaaaaccccacgtcaccttgagtgctctgggtttgtagaagtgtcccactcctccctcaagaaactagcaccccacccccttgcttgaagatcaagaagtattatctgccttgcaaggcaacacacgctctcctcagatctacctg

SEQ ID NO: 158590 - DNA, 419 bp, Homo sapiens
gtgaaactgaagtggaggacagaaagaagaatggggatttcaccacagagagaaaaggaggaaaagaggaaggcccacccaggcagaagcgcaagtggaccaagcctaccgctgacccagcattaaacaaaaattatgggaggctattgttttggactgagatcctgcactaggccccaacagaccagatcaaaccaaaccaaaatggagtcagtcatgctaagagccatataatcaacccaaaactttaataaggaagcaggtatgtccccaaacagattagtttttcctgaaaacaggagcttctggtctacctgagtcagcgtgattaggaggtcctgaagtaacctgatgttaacccatcagcttcttttctattgttctgtttccttgtccccaccttacaaagcccactgttc

SEQ ID NO: 158591 - DNA, 223 bp, Homo sapiens
cgaggagtttaatgatggggagatttgggtaggagataggaaaaccgtaagggatagtgcagagccctgggcattagcaccttgaggtttaaaatgtcaagtggcagagccaaaactagggacagcctgacagggactgtggcctctgttggagggggcgggcagtgtgtagcctgcagagagggagctgggagaatcctcaacctagacctcactccttcct

SEQ ID NO: 158592 - DNA, 282 bp, Homo sapiens
gggacacagtcactgacaaaactgcagcagagaagcaggcagagagaagagatatggcgactggcagctctctcccctcccactcttagctctccttaagttcccccttggccaatccagttagaagccagagggcaaggaagcctggaggatccatctgtcagtcagcaccactgcccactcccaaaaggagggcagacaataggtgacagggggtgttatggtttgaatgtgtcccttccaaaatttaggtgttgccaaagtgatggtatttacaagtgg

SEQ ID NO: 158593 - DNA, 492 bp, Homo sapiens
ccaggcatggtggcaggtgcctggtactcgtcccaggcacgagtcccaggtactcatgagactgaggcagaagaattgcttgaacccgggaggcggaggtggcagtgaaccaagatcgtgccactgcactccagcccgggtgacagagagagactctgcctcgaaaaaagaaaaaaaaaaagtgcagctcactgcccgcacagtattcttggggcatatgggaaatgggttaaaggaaaggttcttaatctgaactcctgaaggttaaaaacagatggaatcaactgtgtagtagaattccatctcttctgtctctacaaggaaggatctagagcagacaatttcttcaaaagctttctcaacttttaattcttacttgaggtcacattataagttaatcactgatcattacaagcagattcaaagaaagcaaaaccgttgcatacaaaagtaaggtgcaggctgagcatggtggctcatgcctgtaatccc

SEQ ID NO: 158594 - DNA, 315 bp, Homo sapiens
gtttagagaaggctctgatcttttgctatgagatgggctgacctgggaagccagtaaatgctggaaagctggtggcaagctttggacatagcacaagcaggctgtccctgcttgccagggcttggggtgtgcatggcgtgggtgtcaggccccacggggaccaggagagacgggagcagaggagggagctgccggctcagcacgttgtggggcggggaatgatggtgccagcgacgtattgatgaccagacaacagtcctaatgtagagcagccctgggtttctcagatgccttgggagacagaccaggtggttg

SEQ ID NO: 158595 - DNA, 372 bp, Homo sapiens
ccaccagaaggggacttccacggggccctggccatttgccagccaaggcagcaggtcctccatttgtcttccctcctctcccccaggatcaactgtcttgtcccctcactgagcccgtcccttcccactcagggaagctctcccacctggaaaaaaggaacacaaagcccccggccccaccccgccccaattctgggctccctagggaagtatctggagtccctccacttcctcttctctacccttgaacccactccagcctcagtcccacctctgccactccaccggcactgttctttccactgccacctggggcccaccgtgaagcattctcctgatcacgtctccccaggatgcttccttctcctgcac

SEQ ID NO: 158596 - DNA, 339 bp, Homo sapiens
cctgcagctaccttcctccctccatacccactgtctccaccacccgtatgtatgcctcccctcactgtgcccaccaaggccatcacttagtgccttatcgttaaagccaatgaatatctctcaccttgtcttccttgacctctcagctgcatgtgacactgcagactctgctcttctccctggcacttgctcggtccttggcgttcctctgtcttctcttagtttcccccatctctctaagtgttccttcgttctcagtgtcaatgtctctcccttctctatccaccccttccctgttggtcttccatggggttctagtctgatctagtttctcacccc

SEQ ID NO: 158597 - DNA, 684 bp, Homo sapiens
ggagaaatttttgttttacaaaaaatcttacctgcaattgaaaaattactcacattttgaaaataattaagaaaaaaatgttcagactgtttatcctttatatgttttaatatagttagaaatttattttttcttcaaatcttatgcaccactatagtatgtgttctactgaatttagttcaaagtttcaaataattgttcattaaaattgaggtgacattgtataatccttcatttcataaggccaaaatgaatttaataattcttatctattattgggatatgtgttctttaagattttgaataaaaatgtattatttacacaaagcacatttcagataatataattcttatcccttagtgccatcagtaaggtttttaaaatgtttcaaatagaagaattccagaaacataggtatttctaaagggggaaaaagattttaatgtgtttgaatatgtatacttgagaataaatgctccttcctatatatgaaaactggtaatatctttattaaaatatgcttaatcacttaatctttaaattgattttaagccctttctaggaattttaaacacagacatgcttatagaagttagtgtgctctagataaatctattaagtaggcgatattaaaaaatccttattttggaattgtatattttaagggaggtttctgaaagatg

SEQ ID NO: 158598 - DNA, 293 bp, Homo sapiens
acctccacaccaccctgtcacagtataaccagagcatgggttaccctcctgacctccacaccaccctgtcacggtataaccagagcatgggttaccctcctcacctccacaccaccctgtcacggtataaccagaacatgggttaccctcctcacctccataccaccccgtcatggtataaccagaacatgggttaccctcctcacctccacaccaccccgtcatggtttaaccagagcatgggttaccctccacacctccacaccaccctgtcacagtataaccagagcatg

SEQ ID NO: 158599 - DNA, 225 bp, Homo sapiens
ggagtcacaccataaaacatgaactgctaggtaatcatgcaggaaaaaacatgagtcgacccctacatgaatgttgctggagttctaaaggcagtggattgcagatgagggagaggacctccaaacaggggaataggaaacctttcgggcctaggaaggagttttagagactgaggcagggcaggacataatggattgagaaacaggctatgccataaaaaaaaa

SEQ ID NO: 158600 - DNA, 333 bp, Homo sapiens
ccgtcactcagggaaaactgtatatggtgcactaatatggtgccactgtatagggtgccactgtatatggtcttctaagctatgcaaagtttgtaaaattaaagaacaaaacaaccgggcatggtggctcatgcctgtaatcccagcactttgggaggtcaaggcaggtggatcacttgaggtcaggagttcgacctgacctcctggccaacatggtgaaactccgattctactaaaaatacaaaaattagccaggtgtgatggcgcgtgcctgtcatcccagctactagggaggctgaggcaggagaatcgcttgaatctgggaggcagaga

SEQ ID NO: 158601 - DNA, 513 bp, Homo sapiens
gagctcaggccttgcacgggctcttccttcttcagggattctcttccctcaggtatacacggtgagtgtctcttatctccttcaggtttctctttctctctctctgtcttttttcggagaagggggtcgtgctctgggacccagtcgggcaggcacccctatgctggctggagcctggggtcgccccacttctctcaacactgatgggcatgagcattcctcaccccagggctctgagcacctcacagatggggggttgtgccaccctagcagtccctgccccctgggaggctggggaaccctctcctcggtgggcagatagggagacccaagcctagggaaggaaagtaactaactcagggtcacacagcaggggcaggaatagcaacctgggctgctggactcacaccccaatcattcggaaggtgggcgagcccagagtccctttggcttggggcatgtaggtcattttcaggtaacaaagcacttcccctaagcctctaaataaggaac

SEQ ID NO: 158602 - DNA, 279 bp, Homo sapiens
tcgcctctcagtccaggaaggatgtctgtcctctctctggtcctttaaatttctcctggctatgattggatcacaccagcccacaagctaacgagacaatttttagctcctcttcctctcctgtcttttcctttttgttattgtttacagccactatatatagtaatataaattaccagggaagatttcttgccttctttgcgtggctcagagacagctgcatggttcctacatcaatcaggtttttttctcatattccacttttctttttttgttttt

SEQ ID NO: 158603 - DNA, 149 bp, Homo sapiens
ttgatcttctgtatttttaaatttctattgcatttatttctgctctgatcttctttatttcttctactgattttgaatgtggtttgttcctcaacgctttatacttcatgtttaaacatgaagtagaaatggggttgtgcgttctcccc

SEQ ID NO: 158604 - DNA, 162 bp, Homo sapiens
tataagttcctatcttttcaattatcctcttatatagacattttagtccgacagattgtcgtttgaaactaaacttggagtgttgacttctttagtgattattcgtattaggtaatcttttctgaccttgaatttttcataaaataattattttatgtggct

SEQ ID NO: 158605 - DNA, 788 bp, Homo sapiens
gttgtgtactgggaaaacctggcggtattaaattacaaaacccattagtaatactgtaaacaaacgattagaaattaaaatagtttttgctaatagatttaaccagtagagacgatacagaggttttagtaaattagaaaccagtactgagttcttcctcctagtgagacaaagagggaaatatgaaagaatataaagacaaagaggatgaattaagagccttcaacacacatctgaaaagagttccaggggaagagaatggaaggaatagtaaagaatatttgaagagataataacttagatttttactaataaaaaatgtgagtccttaacataaatactgagtaccaaacaggaaaaataatagtaaattcaggccgggcatggtggctcacgcctgtaatcccaacattttgggaggctgaggcgggtggatcacttgaggtcaggagtttgagaccagcctggtcaacatgatgaaaccccatctctactaaaaatacaaaaaactagccgagcatggtggtgcacatctgtaatccctgctacttgggaggctgaggcaggagaattgcttgaacctaggaggcggaggttgcagtgagctgaaattgcagcactgcactccagcctgggccacagagtgagactccatctcaaaaaacaaaacaaaacaaaaagtagtaaattcataccttgacacatcttttgtaagatagaacatcaagaatcaaaagaaaatgtgaaaagctaccagagaaaagaaacaattacaatgacaggagata

SEQ ID NO: 158606 - DNA, 437 bp, Homo sapiens
actgcaactctctgccgcctagattcaagcgattctcctgcctcagcctcccaagcagctgggattacaggcacacgccaccatgtccagctaatttttgtatttttagtagaaacagggcttcaccttgttgggcacggtggtctcgaactcctgacctcaagtgatccaccctcctcaacccccaaaataccaaagtactgggattacaggtgtgagccaccgcacccaggctcttctgacttttgagcaaagacctgaaggaggtggaggaggaggccatgccgatatctgggtgaagagtgttccagatagaagcactgtgcaaaggccaaggtatgattagagttgatgggctccagaaactgggaggaaaccagcaagactgaagcagagggaacaggaagaattgtggtgggcaatgagggtgacgcctt

SEQ ID NO: 158607 - DNA, 337 bp, Homo sapiens
ttttcacaacgctgctgatcaaaacaggatgtagcaaagaaaccaatccaaaccagcaaggaccaggaatcataatacatttgcattagacattcctaccagcaccatgacggtttacaaatgcaatggcaatgacttggaagttaaccttacatggtttcaggaactccccaccccttttccaggaagttcatgaataacctgtttaattatatttagcattaagagtgggggcccaggcatggtggcttatgcctgcaatcccagcattttgggaggccaaggcaggaagatcactggaacccagaagctcaagaccagcctgggcaacatgaca

SEQ ID NO: 158608 - DNA, 701 bp, Homo sapiens
caaaatgttctgctgtgtccagtgagacattcatcttgcagtcttttcattttcctgtttccatcagggactggctattttctctgtacatgcatcatccttctccagcatcctcagaatttcctttgcttttctctcaggctgattcattagtcactgggttcttaatctttctctgccttggtgtattccctcattttctttaagcacatcctccaggggctttatttaaaaacacgtggccggagacggtggctcacacctgtaatcctagcactttgggaggccgaggtgtgtggattacctgaggtcaggagttcaagaccagcctgaccaacatgtagaaaccctatctctactaagaatacaaaaattactttgggaggctgagccaatctcagtggccatacttcaatcgctcatagactgctaagtgttcaaactgttgaaataaggcaaacaccaacctgcaaccaatccagctgttctgtacctcactgccaatttctgcacatcatttcacttgttatgtctgtaaatcttccaccgtgtggctgtgctggagtctctgtgaatctgctgtgattctgggggctgcccgatttgcgaatcgttcattgctcaattcaactcctttacatttaattcggctgcagttctcttttacaggaggagggactgtgcattttcatctcctaccc

SEQ ID NO: 158609 - DNA, 118 bp, Homo sapiens
ggggatgaagagaaacaccgggatcatgcaagactcataggctgtgttgaggagcttgaattttactctaactgcagtggtcctcagccagagggattgggatactggcaagaggatt

SEQ ID NO: 158610 - DNA, 480 bp, Homo sapiens
ttgtgactatctctctctttatctcagtcttccttcttattttccttcctttctctctccctctcccgctccccgccttgtctcagtatctctcctgcatgactgcctctttctatcttgtctctgcctgtctctgtctctccctcccataactgcatttcaacctttccatgattgagtcttctctctgccattctatgagcaagtggccaaacacagccagtccagcccagctttatgcctcctttcaaataaccagccaggaaggcaacccagtatccctgattctcaaagccaaagtcacaggagaaagaagctgattggctcagctcaaatcagcctgcacctctggtctaatcagctgtcgctaggggagcagagaggtacaaatatggcccctgaggttccacctaggggagaggaggatacaagagaagggagctggagggctggccaggagcacagatgcccaccacacct

SEQ ID NO: 158611 - DNA, 312 bp, Homo sapiens
tgtgatagctagaaatgggcagccttcgcagagcgagtaaagcctttaatccgtaactctttgctgggtacctgtagctctttcagagcaaagctaattaattgtcaacgctgggtgacatgctctgtggtttgggggcgtcttggttaattaaatttgaatttaagagtctcatttgctagaggaagtaatttcttttcccccctttcattctaatatttttatttaacaaattatttactgtagttgaaacctgaagaaatcattaaggttatttcaaaggaaaacaatttgcatgggacctctgcattg

SEQ ID NO: 158612 - DNA, 333 bp, Homo sapiens
tggaaggactgcatctgtgtgttgccaaagagtaacagagactggtataggacttgagttcaattcagtcatatccttaagtatgtgccatcgtgtctggattactttgtagtataagtaaatttccaagcatggggaggaaaggagaagctcctttattgagaattcaactgaatatagagaaaactaattttacacaactgtaatcactgtagtcatttggacaaattagcaaacccaagttttgctttaacttggattgccttaataaagatgtttgggggcttaatggcacagttgctcaactcccccacttcattccgtactccccag

SEQ ID NO: 158613 - DNA, 359 bp, Homo sapiens
gtagccactgagaggtgagagggagttagcttgaaactatagggtcgcgagaaggctgagggctaagggacgcctcagaggggacaatcagcaatgctgtgagaataaccttgagagtctatgacttcttagcttaaaaacttttctctggctaaatgagctcaggacatgaagactttgctgctgtcatttactgggctctgctagtggataggggcattaatgtaactcacagcaaagactctccgagtgtagtgtttcctcagactaactccagcatagaacaggcctcctttttgtgttggattatattccagcgagggactcaaaggtaggagaactggtgctatcttggtcat

SEQ ID NO: 158614 - DNA, 306 bp, Homo sapiens
aactcgggctccagtgccggtcaggtcccaagtccccaggagagcacaggccagggcacggcaataggaggcccgggccaggccaactgggcatgctcaccctgcaccaggctccgcactgggcatcccacggtgccagctccttggtgcctcccagctctgagctgctggtgccgttgtctgtatttggcagagggaggaagctggaggctttgagaggtagagccggcattggtgtccacagccagcttccgggtctgcagccagcccagtatcccccgcttccccatcccttgttcttttatc

SEQ ID NO: 158615 - DNA, 286 bp, Homo sapiens
ccccttccacacaattgaggaactatctttttactacctttgcagaagactggggatttgttctctggagagggttaaacagaaggtttctacgatagagggcacagcttacaaatgagagtggggatgctactgaagtaaagggtagttgagtaaatatttacatgctgttttagagatgttagggtgtggtggtgggcgcttgtaataccagctactcgggaggctgaagcaggagaactctcttgaacctgggaggcagaggttgcggtgagccgaggtcacg

SEQ ID NO: 158616 - DNA, 160 bp, Homo sapiens
tccagagaaaaggcaatgggtgaagggaagtgagagctgatatccaaaggaaaggctggggccaggtattatcagtagggccttgcaggtcatgctaaggagcttgatctcctgaacatgatgcggggatgatttcatcaagcaatcctatacaaattgg

SEQ ID NO: 158617 - DNA, 533 bp, Homo sapiens
tgctgggattacaggcgtgagccatctcccctggccaaagtttgcctttttttacagatgtttcgtaactattgagtccctactatgtgtaggacgccattctaggttctggggacacagcagtgaacaactgggacacaaatttctgccttttgggcagcggagacagacaaatattgtgttgggcaggggtcactgctatgaaatgtgcagcaggggatgaaaaggagagaagcgtttccagctaagggagtgagggacggcttcttggaaggggtgacatctaaggagagacctgaaagtggggagaggctaggcctgaggaagaagcagcacacaggcccgaggcaggaatgtgtctggcctgcgggaagagcagcatgggggtaggaggtctagggtctggaacagagtccccaagggacagtggagcgggaagaaatgagatctgaggacacacagatcacggaggccctggagagaacttggcattgattccgtaggagcctggagccttcaagaagaagaagaga

SEQ ID NO: 158618 - DNA, 552 bp, Homo sapiens
agatgcatgatgttgtgctacttgctattgcccagaacttactgtaacaataatataatatgctgggggtctgcgaagtgctgagtgctctcatactgcattttacatttttaacacaacttcatggagcaggtattattatcatttctgtcttacagagtaagaaatgggggctctgcaaacttaagtaactggcccagagtgacaaggtggcaaactgacctgtgtctgctgtctaagaccaagtgcttaaccaccatgtagattgacactttgatgtggtacagcagtaaagtttagtattagtgaggagagggcatctcttttactatagtttattgtgaatattctttcctcttaatatcagtatttctacagggtaattttaacacctgcctggaattgcattgtctcaaaggacccgtttcattcaatggtcccattgaatgaaagtcaagaaggcttgctataagatctaaactcttaggggggttacctttctattatcaaataacctttattgttattggaaaaagtcagcttaacagcatt

SEQ ID NO: 158619 - DNA, 712 bp, Homo sapiens
tcataatccccagggcagggttcaggaatgtgtgttttttaacaaatgctagaacttgaaccactgcagtagctctctgtagttgctagaaaaaaatcttggtatcaattgttgtaaataaaccattggaaacaagataactcctatagtgttttgaaggctatttatgaattggctgacttgtttattcgtcatcccctgctgaaaggtaggctctaagaggagggccattatctagcttgttcaccagttgttcctagaatagtgcctgacacgtagaagtgcacagtgaatattttttgaataaataaatgaataatgaaacgctttttcactgtgcttgggtaatacatgtccctttttccctcaataccagagaaagaattggtttcagctgtgccgttgtaaatttgaatgatctgataaaaatccttggttactccactgaaccgactgcaatttttttaatgtctaaaacatacttattctcatattttgttacattttaataccatttaagagtagtagaatttggaaggtgacatagagatccacttttatttcattttcatttcaagcccctgtgtctttaaggaaagggctaagctacaacttggtcattctccagatccaagaggaaatggattggagcagttgtgcctttgtagagcagatgttttggttggaaaggctatcagccatctgactcata

SEQ ID NO: 158620 - DNA, 352 bp, Homo sapiens
gatgattgcctgataaagatgattgtctggcgtagcttggagtaccaatacaggagacatgttcttcccccacttcctattccttccactgccatgctagacaatgcttatcaaaggtgacattctttcctacccagcttggacatgcctcataatcctgcccaagcagcattctaatagccacagctagtaaacaagggatctaactagtttgtcagtgtaggtagtagaatctttaaatttttttttaaaggccattgttagtatttttaagagatcaatttacatcatttatttcagatggaatattgtttatttctctgtcgcagtggctcccaatcttttagaatgt

SEQ ID NO: 158621 - DNA, 189 bp, Homo sapiens
ggtcacagcatctctggtccactctacatatttgctctgctatcttggcaaattctttacacattttttagaataagcatacattcttaaaagcgcttattctattgaggtagcaaattattatccttgccacagttagtaaagcattcatgggtaccctcactgatgggtgacctcatggtcactcat

SEQ ID NO: 158622 - DNA, 521 bp, Homo sapiens
cttaaatatgtaatcttaatcaaaatcattagatctaagtcattagatcaagactacacattttgatgtctaaagcaatgtgaaaagttatagaaactctcacctttctctaaaaagttacagaaactcccatctgaaccatgccctgggatcaactatagattcagaaaaggatttttggaaagtggtgagaaagaggaatccttgttagagagtgaaaattttcaaaggctttggactcaaaatttgaaatgattctttcatctgaaagaatgaccttggtagagaaagaaaaatggccatttaaaaatgagtctactagctattattgacagagccaatcatttatttagtatccaaacagaagaggtgttgaagataaagttttcttataattttttggttgttaaatatatggaatttaatatctaaggaaatgagatattggagatagataactgtggttattagagaaaaacaaaataaatgtatataattttttaaagtagaacaaagtctta

SEQ ID NO: 158623 - DNA, 383 bp, Homo sapiens
tgcctgagttgtagttacttttgccaggaagcccagagctggattatgtaaagctcctgggtttctgtgtatgcctgagtggctgctctgccaagactccacatagttctgtgtgtcggactgaaggccctagtggagtggtttcatgaagggttctcctgacccgggagttgcaaagattggtggggcaagtgtggtttccttgggtcacacattcactccctgcttccctgggcaggggagattcccttgactccgtgtggctccctggtgggccatcattttgccttgcttttctctgttctctgtgggtcaggttgtttccttgattagtcccaatgcaggtacctggatgtttcaattgaaagtgctgtatttactcg

SEQ ID NO: 158624 - DNA, 288 bp, Homo sapiens
ctttttaatgttacccctcatagtgagtgtatagtggtatctcattgtagttttcagtttccctaatggctgatgttgagcatcttttttcgtacttacttgccactggtgtaccttttttctgtgaagtctctgtatatatcttttgtgttttttttttttttttttttagtgagacagagtctcactctgttgccacgttcgagtgcagtggcgctatgtcggcacactgcaaccttcgcctgccgggttcaagcaattctcctgcctcaacctcccgagtagctg

SEQ ID NO: 158625 - DNA, 392 bp, Homo sapiens
cccagaggcagccactgtgtggaggaacattggcaaggacagagtcagaaccccacaaagcctggccacgtgtggggccactccaccgccacagcacctccaaccacgttctcccacagcactgtgaaaaatgatagctgaagattttcattgccgcaatctcttaaaaaactggaaacaacctaagtacccataaataagagaatgtttaaaaaaatgacggcagagttcacgtgctggaagagttggtggcatttttaaagaggcagggcaacacgtactacagtgagggattttacaggcctatttttgagggaaaatggcaagtgagctacagcaagcgcacgtgtgtagatcccagttacaggtccgtcaagatgtctagagaatac

SEQ ID NO: 158626 - DNA, 475 bp, Homo sapiens
gtattttgattccttcaagaggtttagtaggaatactctttcatccagcctcttttcttcagaggcttgtaacttctgctaagccaggccccagtggctggacccatacacatgattctagaaatgagctgtgtgggaactggattgctggttggcctggccatcctcattccccacttcctcccattgccaccacgcccctcgtctacccaataaagctggcattttctcttcagcttctctcaagaacagccagagcttggaaaattattgtgagttgccgtacatcgtgcagctactcactgagtcttccttcatcaaatatgaagcaagaatctctgtgaaacaggaatataatattaggacaatggagatagatatgcacagatgcgtcatccaagccgaaaatattctgttaaatacaaatgcgtgaaataaagagacactgtggtgcccaaataataatttaaaagtt

SEQ ID NO: 158627 - DNA, 511 bp, Homo sapiens
ctcccagaccactgtctcccctcaggggacaccatgcctgctgctccctgcctgccagcgccctgcacatactttgcacatggctgggggccagctgcgggtccctggggactcggatggcacagagggccccttcctgccaccatcacggctcagacctcacgttcctggagagtaggggtggggtgctgaggggcagagggaagtgccgcaaaccccctggtgggcgcggtgccagccccccaggccgattcccatccagttgaccgagcttgtgctggtcaccgcggtttccgcaggacagagtccccacagccgctgggcaccccggtcccattcgcggccactttcctgtctgaagaccgcatgttgccgggctgtgcttacggctcgcgggcgcactctactgacaagcggtgggcggcctcacagactctcccaggcccgcgtggggcaccacggttgggagtggagtggagactggcgagtttcgactcccccagccaccccg

SEQ ID NO: 158628 - DNA, 340 bp, Homo sapiens
tattcgcattctctattattcccaggtgttggcagcgcgtcctggcatctcaagtgctgagccacatggaggccacatccgtggctttatcccagcctcctggagcacatttgcctgacataaacactcagatatctacatcagctgagtggattatatgcactggccaactagatgaccagattctccttcccttcatgaatgaaagagaacaatatttttatataattcataaaataataaagtcttgactaactaaattgtacttattcatgggaaagttcaaaatatttactttaactattaatatatgaatcaaaaccaagttattttaactaga

SEQ ID NO: 158629 - DNA, 646 bp, Homo sapiens
cgtctcaaaaaatcagtttacacaaaataaaaatacaaatacaaaattaggcgggcatggtggcacatgcctgtgtaatcccagcgactcaggaggctgaggcaggagaactgcttgaacttgggaggcggaggttgctgtgagccaagatcacgccaatgcacaccagcctgggcaacaagagcaaaactccatctgaaaaaataaaaaacaatatcagtgtgtcaaagcattatgtctgtcacaatacttgtgaaaggaaaatcaaaattactaaccaaagagaaaagtcaagctgggaactgtgttagacaaacctgcctcccattttattcctaaacaatatagctacaaggactaaaccaaaaatctacatactccactcacaaactgtgggcctcaagatctccaccccaaaatagttctgttgaatttcaccctggcaatgtaaactgagagcttatcttcacaggtgtaggaaagaacccatccctctgcacacctgagtcaaatgtctatctgactacttcccctgacctattttttatgtaaaaattcagggtcactgagccagcctaaggcataagtgactattcctccaccctctctcacatataaattgtgtaaactgatgaaaggttgatca

SEQ ID NO: 158630 - DNA, 156 bp, Homo sapiens
tggctcccaccgtggctatgagctctttaaagacacaactattctgttgtcactctgaccctggtgcttcagcttaggcagggccttgcattcatgggggctcaagtaggcatgcactcactgaatgtccgcttcaggcttgacagtggggataca

SEQ ID NO: 158631 - DNA, 211 bp, Homo sapiens
agcactgagcaataccattattgcaatggttccatattgttgggtatttggatttctgttttaaatgtctttgtataataatatttgtgcacattccttgatgctttttgtagaatggatacttacaagtggagttccacggtcaaaaattgtaaacactttgaaagcttttaaaacataattctcagattgccctccttagctgtaacaa

SEQ ID NO: 158632 - DNA, 282 bp, Homo sapiens
agcgagaaccgagacaagaaagtaaagaagtagatggtattcagaaccataaaactagatggaaattagaaaaaggtggtattatttgtgtgttgtaaacaaaagatcaccaagatatttgttaatggaaaaatacagacaagatagccttacagtgtgtatatgctatcatttgtgcaaaagaatgtattatttatttttacttgccagtcactcttccaagccgtataaacatacttattcatttacaactcacaaatctacgaaggaagtactattatt

SEQ ID NO: 158633 - DNA, 157 bp, Homo sapiens
gcatcaaaactggcaatgctgatgaagctgttaccatccatcctgtcactggtagcatatctgtgctgaatcctgctttcctgggactctctcggaagctcaccatcagggcttctgatggcttgtatcaagacactgcgctggcctacagcacatg

SEQ ID NO: 158634 - DNA, 492 bp, Homo sapiens
ccaacacctctgtcatatctgagtctggctgtgatgcttgctatgtctcttcaaactgcttttggccttttagcattctttgcaagttttgttgttgttgttgttgttgttttgtttttgatagccagacacaatgaattgtgtacaaggcactgaaatcaataggcctttattgtgaggttttgtgtttatcttgctagaaatcaggttgtgtttactgtttgatgtagctttggtgtggtggctgaaatatcctatagtatcttcgtttttgtctctcctgttgctttgaggtttccttagagactctttcttaaataaggcttgaggcttgcagttctttcaggtgtaatttcctgttattacacagaagccagattgactgggtctcactcagtcttttaatgtgcctgtactcctgagctgtgccttcacaagtgcttctcagcctttcttttcccccttaggtgagacagaaatgctagggggtac

SEQ ID NO: 158635 - DNA, 532 bp, Homo sapiens
cgtgcgggtggagggtcttcccttgatgtcgatggctgtgactgatcaggatagtggttactgaaggttgggctggctgtgacaatttcttaaaataagacgacaattaaattgactacatcatttaaattcttttcatgaaagatttctctagcatgtgatgctatttgatagtattttatggacggagcgagaccaatctcaaaataataaatagataaaaattaaaaataaaataaaataataaagaaagatgatttttgcatcaccaaatctttacactgatttctctctagtttttcctttgcaatgaaatgtcactcagacttggactaagattaagtcataactgacagctgttgactctctcaagctcttctctgaccgtatcaagcctgagtatccttattttgcacattcttccttatgtaagatgcttctgagggatggtggcagtggctggcatgtactaatacaaaatacttcaaattatatttttgagctggaaattcaagagaaacaaataccaggc

SEQ ID NO: 158636 - DNA, 197 bp, Homo sapiens
agctccttcagtaggttaaaactgatgaatagtataatcccagtctgaatagattcttgagttcttgttttcagattttaggaacagacgtgcaatcccaaagatagagaacagagaccagtgccaaaaatggaactattttgcttgaacttgctaagttatgaacaaaaacagtttaaaggacttaacatgtatta

SEQ ID NO: 158637 - DNA, 998 bp, Homo sapiens
cagggggtcctccccatacatgctgcatttccatcacagaccccatgtcgcctctggacagtaaagcaatgtgtgcagggtcttaacttgtgcatccgcaagcgctgagtttgttgaatgaatgggggatggaggagcaaggaaggattttaggaaacattggaaagaaggcaaagcctgcatgaggaccccgcagccaggggctgcctgatttcactgagcatccagcaggctgctttataggatgtcatactataaagaagggcgtgccttacatacagtgttacatagataacgtagggtaggagagcagtctccctaaatcacactttcttcctgtgacttagtgtaaaagtacatatgctttccagtttgaaatagtgatcggaatgactgagaaaaacatgctaaagcatactgtagccatttaaaatggacaggtataaaacggaaatggtgattttgcctgatccagccttgtaacattacttgaaatagggccattgaaattgctacccagatctggattcctggtgaagaatctgtactttctgtgtgtcctggcattcagggactcaggctatatccctattctaaaacaaatgtgcctcttaaaatcccgggcttttatggattctgaattgatggtttttcatttgttcggggtcttgaattcattggaggaccttgagacctgtgaacacacaatttcacatgtgctttcacatgagactcccctctagtctccctgaaacccattcagggatccatggagatccacagacttcagattggaagactgtattctaaaaggattgatctcatgatagctgatgactatttaagaaatcaagttagactcagagattatgaaagtgttgggttagcatttgaattttttctttgttggaaaaggacactcattttaatcatatcctttaaaaaactcaatttttcactctaaatgaaaatttttatgagttagattttcttgaact

SEQ ID NO: 158638 - DNA, 625 bp, Homo sapiens
ccatgttgcccaggctggccttgaactcctgagctcaagtcatctgcctgcctctcaaagtgctaggactacaggcatgagccactgtgtccggcctcaataaataaatacatgaatgaataaataaataaataaagatgcttcacaaatttgtatatcatccttgcacagaggccatgctaatctctgtatctttccaattttagtatatgtgctgccatagcgagcacagcttcaatttttaatagcaagttggatcaggattgtgggagaaaattctagcttgggcatagagatttacagactaacagtatggcccaggagagaatatagaatgaaaagagcaagaggtgaagcttgaaaactttggttatattaacatttaagatgctagcagggaaaaatgtgcttatgaaggatgctgaaggagagagatgagagaataaagaggaaaactaggagacactagtattggagaaagctaagagatgagagttttaagaaagaatatgtgtttagtgatattgaaagtccagaaaagacagatgagataagaatagaaaaattctattgggtttggtagttagaggtcattagtgacttttgtgatgaacaatttcaataa

SEQ ID NO: 158639 - DNA, 671 bp, Homo sapiens
gaattttctactcttatctcatcggtcttttctggacttccaatatcactaaacacatattctttcttaagactctaatctctgtatctttccaattttagtatatgtgctgccatagcgagcacagcttcaatttttaatagcaagttggatcaggattgtgggagaaaattctagcttgggcatagagatttacagactaacagtatggcccaggagagaatatagaatgaaaagagcaagaggtgaagcttgaaaactttggttatattaacatttaagatgctagcagggaaaaatgtgcttatgaaggatgctgaaggaggggtgagattgcggtgtttgcaaacaccgcaatctcaaacaccgcaatctccacctcctgggttcaagcgattctcctgcctcaggctcccgagtagccgggattacaagcatgcaccaccacgtccagctaatttttgtatttttagtagagactgggtttcgccatgttgaccaggctggtcttgaactcctggcctcaagtgatccacccgcttcagcctcccaaagtgccaggattacagatgtgagccagtgggctcagcctgaactattgatttttgttgatagcttattaatggtttactagatttagtagattgcggtgtttgggtatcctctaggtc

SEQ ID NO: 158640 - DNA, 355 bp, Homo sapiens
ccttgccctccgcaatgcccagaacacccctctaggtgctgtgagctcccagtgtgtggtaacaacagtgctgggggaggcgtggcaccaaagacctgtacccccttcttctttggggccccaagtgccttctgtgaaaccaaatactccccctagtcgcccacccggacacctgactccctcctgaggcccactcagggtgaaagccgtttcctgtctgggtcttggtaaccccctgaaatcccggcctccctcccccgatcccttccaaatgcttattaagccgtttgcaaatccagggctgaaccgcggcgtgagtttaataaagcagaagacagatgccatccatcacggg

SEQ ID NO: 158641 - DNA, 423 bp, Homo sapiens
tgctggctctgagcgcagacccctctcctggttcccaggggacccgcggaggagaaaggcagagaggcaggtgtgtgggacccactggcccctggccacgtcttgctcaccgtcccagttggaagactgttaggatggaaaaacctcactgcggttctatgaaggggcatattcctgcacggcataactggtccgggagccacataaagtcaccaagtgtgggacgtcatcctaccgcgaatctgagggtcttctggggtaaccccagctctgcctcagtttccccatctggaaaacagggacgcacctctcggggagggtcgctgaggaggtttcctccaacgcttaggtctgaaagtcccccactgtcccagctgagaggatggcagcagagtcgtacccgtgacgggcagggcccagagg

SEQ ID NO: 158642 - DNA, 389 bp, Homo sapiens
ctgtggtgaactatggacacaccattgtatcccagcctgggtgacagagtgaaaccctgtctcaggaaaacaaaccaaaagaaaaacagcaactcatgctggttattttatggttaagagcaagaatccttttctgatgcatttcttggcacaagggaggagttcagttttaacaacttatattctttctcactgtagaggaatattgacataaattgcacataaattaagcatgatcaactaacaagtatttgttgatttattgggcatgaaaaagaccttagagaggttctattctagttctgtcttctccacagtctggaaagacagacttaacagaatttataatctcaggttttgcctggcatggtggctcacgcctgtaattc

SEQ ID NO: 158643 - DNA, 455 bp, Homo sapiens
aattcagtcctaaagtcatcagatgggacagaggaaaatgacatcacagtgttggaggagccatcaaagcccagaggaggatatggggtgaggagggcatcatcatagtggggtgtcagtgcccatgagggtgctagagtgcattagcgtgatcgtggctcactgcaacctccaacacctgggctcaaggtgagctaattttttttttttttttagatggagttttgctcttgttgcccaggctggagtgcagtggcaccatctcggctcaccacaaactctgcctcccgggttcaagcaattctcccgcctcagcctcctgagtagctgggattacaggcatgtgccaccatgtccatctaatttttttgtatttttagtagagacggggtttctccatgttggtcaggctggtctcgaactccagacctcaggtgatctgcctgctttggctt

SEQ ID NO: 158644 - DNA, 315 bp, Homo sapiens
aaaatggcatgagccaggccaccacacatggtcatgaagacacggtgacagtaaagtgcagaaatgcttagtgacagcaagggagatggaaccaggggaaacctacatggcgtaagatttcagttatgtttaaaacattcacaggaaaaaaggatcaaaagaaaatatgggctgggcgcagtggctcatgtctgtaatcccagcagtttgggaggctgaggtgggaggattggttgagcctgggagaccaaggttgcagtgatctgagattgcaccactgcactccagcctgggcaacagagctgtctcaaaaaa

SEQ ID NO: 158645 - DNA, 493 bp, Homo sapiens
cgtcagaaaagcgcagtattagggtgggagtgacccaatttcccaggtgctgtttgttaccccttcccttggctaggaaagggaattccctgaccccttgcgcttgtcgggtgaggcaacgcctctccctgcttcgggtcacgcttggtgcgctgcacccactgtccgacaatccccagtgagatgaacccagtatctcagtttgaaatgcagaaatcacccgttttctgagttgctcacgctgggagctgtagactggagctgttcctatttggccatcttggaacctggaccccaaatattttcttaattaaactgctacacaaccagttgataaaatcctactcaacaaagctgttacccaacggaatttgtataatcttgaggtttccaggaaaaaatttaaaagtaaatcttggaaactgtttgttccttacatatctggcaattcttttttgttttctagttttatcgagatataattgcttaccca

SEQ ID NO: 158646 - DNA, 426 bp, Homo sapiens
  misc_feature (60)..(60): n is a, c, g, or t
  misc_feature (67)..(67): n is a, c, g, or t
  misc_feature (103)..(103): n is a, c, g, or t
ttcttttgttctttttgagacggagtctcactgtcccccaggctggagtgcagtacaccntctcggntcactgcaacctccaacccgggctcaagcgattctngtgcctcagcctcctcacagcctcctcaatagctgggactacaggcacttgccaccacacctggctaatttttgcatttttggtagaggcggggtttcgccatgttgcccaggctggtctcgaactcctggcctcaagcaatccgcccgcctaggcctcccaaagtgctaggattataggcatgagccaccactcctggcccatactaacacatttggaaagagagattgaactgtggatgaaaatggcttgaactgtaacagtatcagatatccagtcaaacattagaaaaggaactattgcagaggagaggagaaagtgat

SEQ ID NO: 158647 - DNA, 461 bp, Homo sapiens
caatttcccatctgtgtcttcattctgaaggctcctatgtcaggtaaaactatgatcaaataaatttgtatgtcttttctcctattaatctgccttttgctagttaattttcagtgaatcttaagagggcaaaggggaacttttctgttggcccctacaatgttaaaaaatctggtggaaaacatggagccaggtgccatggctcacacttgtaatcccagcactttgggaggccaaggctggagaatcacttgagcccaggagttccgagaccagcttgggcaacatggtgagaccctgtctctacaaaaaagttaaaaattagctgggcaccgtggcctgcttctatagtcacagctacttgggaggctagggctggaggatcccttgaacccaagaattccaggtaacagtgagctatgatcatgcctgggtgacaaagtgagacccccatctcgaaa

SEQ ID NO: 158648 - DNA, 332 bp, Homo sapiens
tcagtaatgtgtgccaaatgtttgtgtattttagtagtgtttggtcatgttgcccaggctggtcttgaactcctgacctcaagtgatccacccacctcggcctcccaaagttctgggattacaagcatgagccaccacgcccgacccttgtgttataattcctaaatacaatctcccattgtttgggatttgctgttataagcagcactaggatttgtgttcttgtggaaaaatctttacacacttctgcagtaatacctctaggataaattcctggaagtgcagctgtcgggtctggagcatgctgtacccatgctgagcacatcatatag

SEQ ID NO: 158649 - DNA, 330 bp, Homo sapiens
agagaatataacatttaatgaaattaacaagtgaggaaatacttatttaaagggtatgctaatgccattacttcatattttaggttttcatggaaatttccaaagaaattcatcctgatagatttactagacagcttatcatactatgtaatcatagactcctgagaattatcttattttccaaaacattgtttgatcatatatccttaatttctagaatcacaagtggagggaggtgtaagggcagatgttcccttgaaaagcaaattgaaaaagaaaagagtaattgcaaaaggattccttggcatttgtcttgagaattttctttag

SEQ ID NO: 158650 - DNA, 401 bp, Homo sapiens
tttcaagcaacatcattttataattcccattcgacattattcaaggattataaaaacggccgggtacagtggctcatgcctgtaatcccagcactgcaggaggctgaggtgagcagatagcttgagcccacgaattcaagatcagcctgggaaacatggcaaaacccagtctgtattaaaaatacaaaatttatccaagcatgatggtgtgcacctgtaatcccagctactggggaggctgaggcaggagaatggcctgaacctgggaggcagaagttgcagtgagttgagatcgcaccactgcactccagccggggcaaaagaccgaggctctgtctcaaacaaacaaacaaaacactctcagttggaaaggtagtgaatagggctgagataagtgtctc

SEQ ID NO: 158651 - DNA, 293 bp, Homo sapiens
ttaccagactgagaattttaaacaaccatgattaatatgttgtgggctctaatggataaatggacattatgcaagaacagatgggcaatgtaagcaaaaagatggaaattctaagaaagaacaaaaaaaagttagaaatcaaaagcactgtgtaaaaatgaatgccttttatcagtgtattagtggactggacatgactgaggaaagaatctctgagcttgtggatatatcaattgaaacccccaaaactaaaaagcgaaaagaacaaattctgaaaaataaaagaacagcat

SEQ ID NO: 158652 - DNA, 392 bp, Homo sapiens
  misc_feature (22)..(22): n is a, c, g, or t
  misc_feature (67)..(67): n is a, c, g, or t
  misc_feature (77)..(77): n is a, c, g, or t
cagagagacggggacaaagacnagagagagaggagacagaaacccagagagagggaaagagacccantccacagcancgcccccagatgtcatccttctgattggctgttctgattgtagccagaatatctgggcatttttcaggcagttgagataaagaaactcgtattttcttcttcattactcttaaattcatagttcaaaatatttatgttagttttaaacataatagtttcctgaattaggtaatttataaatgtcacattgtttttgtttttttttttttttttttggagagggagtctcgctctgttggcccaggcgggacgggggacggcaggggcgcaatctcggctcactgcaagctccgcttcctgggttcacgccattct

SEQ ID NO: 158653 - DNA, 525 bp, Homo sapiens
gctgggctcaagtgatccttttacctcaaatttttgagctgggactacagaaatgcactactacccctggttaattttttgatttattagtagcgacagggtctcactatgttgtgtaagctggtcccaaactttttgccccatgtgattttcccaaagtgttgagattatagatatgagcctctgcactcagccagtattcataaatttaataagacttggtatgtgtcgtaacagaacacactaggagcaagtaagaatattgtgtgtattctcttgcttttgcctggtaagttttgtacatatctgttaagcctagttggtgatatgatatggttggcctaaggttagaggatgtccattttctctaaacctcatgctgcaatataatcctcctgtttgatgtgggacctggtgggtggtgtttgggtcgtgggggagcaaattcctcataaatggtttggcaccatccttttgataatcaaaaaggttacgctctattgattcaaatgagagctggttggt

SEQ ID NO: 158654 - DNA, 790 bp, Homo sapiens
tccaagattggctaagttacctatgttcctttgtatttctgcatatttatatacatcttgacatcacattgtttatttttattttgcagtaaaatctgatgtgattttcatcagagttgaaatacatttgtagatcaatataaggtggatggatatcttaatataaataacatatcaataagaacatgtatagatctacgttttctattttttcttaaaatttctcaataatattttttagcttctagataaaagaactacgcatattttgttgcctttattcctaagaattatatgcttgtgattattctattgtgaatagaatttattattatgttttagtgattcattattagtatgcaacaacacattttaccggttaagaactgcttatccaaaatgcttgtcgaattaatgcaaaaacagcaaactaaataccacgttttcacttataagtaggaggtaaacatttggtaccccaaaacacaaagatgggaaccataaacactggagattccaaaagggaagagagagggagctggccaactgttgaaaaactatctattgggtcttatgtccaccacatgggtgatgagatcattagaagtccaatattcagcatcacacagtatacccatgtgacaaacgttcagatgtacccctagaatctaaaataaaataaaacaatcagttgccaatatacaaattgaagttgaattcaactcatgctgcactcttttccctgttgcaatcattattactgattaaaatctgtccttaccactttaac

SEQ ID NO: 158655 - DNA, 692 bp, Homo sapiens
cctaactggtctttctacttccatctccatcccccctacccaaacctttctctattcagcagtcagaattgtcactttcaaacacaaattggatcatgtcactttcctgcttaaaatccttcaatggtttcccatcatctttggaatataattcaaactccttaccagggtttaaaggctctgcacaatctcaccatggccagcttctcggacctcacctcaacagactgaagtccagtggcacaatcatagttcactgtaacctcaaactcctaggctcaagtgatcctcctgcctcagcttcctgagtagctaggactataggcatgcaccatcatgcccagctgattttgttttttagtagagatggggtttcaccatatgggtgaggctggtctcgaactcctgatctcaggtgatctgcctgcctcagccacctaaaattctgggattacaggtgtgagccaccacgcctggctggaagtggtttatatcttgattctagttggtatcacatcggtttatacctatgtgaaaattcattaagcttgagctcatcaaataatttgagattcatgcaagttgtaccatacgtatgttatatctcaataaaaaggttttcaaaatgcctagcgagctggtgaaggatactgggttgagaatgtagtatgctgctcaaatagggctgtgat

SEQ ID NO: 158656 - DNA, 717 bp, Homo sapiens
agactgggaatgataactggggatagtgaataggatggcctaggtgtacaatgaggtcagcatttagcacatcaggtggccaggactaggacctaaccaagaagctggaaatagaaggaaactccttcattcattatttgaccttacatttttttattgaataatagtagtagactgatctatagacctaaaccagtggatcaacagacctagactagaccatgcttaacagaatttacagtttggagggaaaatagacatgaaagacttaagtaataagatgagagcagccagagacaatgagtaggtaataggagtgaggcccaccaaagaagtgatcatatatcagctacttgaaaccagtggtaaaagtaaactcagtaccaagctcacttcatccaaagcatggattccttatatgttctctgcttgggataatattaagatcaatctgtatgtaaagcttacacagctaggacaagcaaggattcctaggtcgggggagtgtgttcacatatgatggtgtctgtgcatgtaggttttttttcctaacaagtattaaccatgatcctatagcataagagtgagtgatgatgaggaggatgataatggtaatgatgataacgcagctgtttattgagtgcttattatatactaggtattggtttaaatattttacatttattagattacttactccccacagtaattttataa

SEQ ID NO: 158657 - DNA, 427 bp, Homo sapiens
gcagggatggagggcagggggtgggcattattgaaaatattggcctggccaggcgcggtggctcacgcctgtaatcccagcactttgggaggccgaggctggtggatcacctgaggttgggagttccaaaccagcctgaccaacgtggtgaagccctgtctctactaaaaatacaaaaaattagccaggcgtggtggtgcatgcctgtaatcccagctactcaggaggctgaggcaggagaattgcctgaacctgggaggtggaggttgcggtgagctgagattgagccattgcactccagcctgggcaacaagagtggaaccctgtctcaaaaaaaagaaaagaaaagaaaagaaaatagcgccaagtccattttcaaagtggttgtaccagtgtaccttcccaccaccatgtatgagtgttacag

SEQ ID NO: 158658 - DNA, 541 bp, Homo sapiens
caaatgtaatatccaagttgtgccatgtggcagatcaatgagcactgaaacattcagagttgagtttgcactgcttaaacaaaaataaaaataagaaagcaggcaagcaaagacataaataaacaacaaaatgtttgcgtggaaagcaatgttggtttagtaaggatagccaagacagattcactcagattaaatcaattggcaaataaatgcctttctttctgttttccccccgaactaaggacattttttatgagcagcacaaactagcatgcaaatatgcttctgatttttcactttcataatttaaagatagccaaacagatttctgtaggatgtatttttcgcccttaattgctccaatatggaagatgctctgttgggagatcaaaatggcagatgtcttttaatgccctgccattttcacttgtgtaaataatcatgtttcttttctgcctaaaattcattgctgcagtttgtctcacacagaacagagtttatctttgaacccgctctctcctcaatccaacaacaacaaaaa

SEQ ID NO: 158659 - DNA, 212 bp, Homo sapiens
caactttaaatactcaacacctgtgggtagactatcttgttagcatgaaatgtaaaattatattttgaagaattacaatttttgagctcttaggagaggaaatgctcaacataggtgtgtagactatctcattagcatgaaatgtaaaatgatattttgaagaattatgatttttgagctcttaggagagaaaaatattttgaacctggccc

SEQ ID NO: 158660 - DNA, 455 bp, Homo sapiens
agggctcctgctaagccggtccaggcagtgctgggtaatcattacccagtgggaaggcggccccttcccctctgggcttgcctttgtcagcgccccccaacccggcagagaaaggcccggtctcctaggaaacgcagtcaccgccaaagggcagaggcctcgctgcccagcctggaatcgctggtgactcactctccctccttcccaggaaccacgtcctaagtcccactggtgaatggtccctctccacatggagttgccactgcgcgcggtgaggggctgctgagctggctggaagaccgcacctcctcggcgctgggtggacccggctgccacccgctctgcctcccccgacctcttctaagctgctcccggtaaggattccgcgacccccggagaacaggacggaagcctcgattctctcaagtcttagccaagttccctcttaagaggcc

SEQ ID NO: 158661 - DNA, 153 bp, Homo sapiens
atgctggatggttggagtgggctcaaggcaagggtccttctaagtggaagagggaggcagaagagagagagccagagagatgggcaacgtgagaagaactctgcccaatgttgctagctttgaagatgaagaagccatgggccaaagagtgta

SEQ ID NO: 158662 - DNA, 377 bp, Homo sapiens
atagaatcgccgcctactgtgtacttagtgttattgtctaaagacaagaaaaatgtccaagacttgcgttacaggggctcttggcaggaatcaatagaccctaagggggctctaaatgggctttagaggacaagtgaaagcctaaaatgacattaaaattgtatatatgtgcatttttctgacaggattcatagctttcatctcaaagatccaaaaaacctaaatcatcactttccctgctgatcatatgacaactatgcatgtatatacatacaagcacaaatgcatagatgggtagggagaagattctgccagattttacaaaagctcagatagatactagtaataagcctaaacaccaatttttagaaagctaa

SEQ ID NO: 158663 - DNA, 428 bp, Homo sapiens
tcaggtaaactaggggagatactgaccgagttaagccaatcagactacctcttcaggaaatctgtagaaagaaaaaatcagtcacacagaagtgagcatcagagattcaaaatcatattttaggaccggtagacattttctgtcatgttcttactgataaaaaaaaaaactaataaaagccagaatggagtaggcacagaaaaacagaggtgagaaatcatgaaggaaaatagtttctgtgatgcccaactatgtcttgtgattggatccgagagtctccagtaccattagtatgagtcccaccccctctttttacttgaatttatctgattgagtttccattccctaaatacctagccaatcctggagagggccctgaaatgctactaaaggaagtaatgcctgagttgagttttctcaaagcaaga

SEQ ID NO: 158664 - DNA, 577 bp, Homo sapiens
tatggcaactaacatttattaagcccttccagcctgagatgctgatctaaatattaattcatacaatgctcataaaaactctacttattccattatttatgtgaggcaactgaggcatagagaggttcagtagcttgtccaaggtataagcaggtataatatatggtagcgctgggatcggaaaccaggctgcatgactccagagcccatggtcaaatttagatacatccagaattccaaaaataaagagaaaattctaaaaaatttcaaaacaagaagaacagaaagaacttaaaacaagacaaaaatcagactgccatacttattagcaaacttggatgacagacgatattgaggtaatgacttcatttaaagtcctgaagaaaaatgattttgcaactagaattctatacacccaaactactgaattatgatggaaaaatacttttcacaaagacacaaatttaactacatttgttcttcatgtgaaaaagttacacaatgaggcaatacaaaaaaaaaggaaacaagaaagataataactaacaggaaagaagcagtggtagctgaccatgac

SEQ ID NO: 158665 - DNA, 113 bp, Homo sapiens
gattttgagaatagcacccataaatatgcttccaatgcttgtcacttgatccctttttggcaattaacttgcctttaattgatttgtggattacccactggaagttgctatgg

SEQ ID NO: 158666 - DNA, 268 bp, Homo sapiens
acttcatctggggggcacacaacaacaaaggtaacaaagttcaattattctattgaaggccttgaagggtcatgctgagaagttttcaaatttgaccccattagtagcattttcagaatgtgtcatgttaaagagtaatttctgaaagaagttttgggtaaaaaggtttggggtgtgtgttatagctattttttctcttttgaaaaaataattcacagaacacattttatgaaatccttcaggaaagaaacctatttagctttgttta

SEQ ID NO: 158667 - DNA, 144 bp, Homo sapiens
ataaatgctgataggtgacaaacacatttctccttcctgctccagagccggggagtaagaaagagccactctgagaggcgccaacttagtctccaagggtggaggttgaagtccttccaagaaaggggggactcttcactttag

SEQ ID NO: 158668 - DNA, 304 bp, Homo sapiens
gaaccagattcccattgaccacctcctctctctagtttattttaatctgtttccagtcagactgaggatgaatttcacagataaaagatgacacattattggagtttagaaatggtggtattagttttgcaggctctcaccctgagagatttatattaattccagaattggccggaaaactttagtttagcatgggaagaagagtgagatgtgagtcacaaccacaaaatgctttatttcatgtgaaactggtgtaagtgagaactttaaatggtattgacaggagtgtgaattttcttttttg

SEQ ID NO: 158669 - DNA, 626 bp, Homo sapiens
ccccatcagcctagtccctaggactctgcactcttagcctctaggtctaagcctccatcctatcgctctgctgtctcaacatgacccttagctgtcctaaaccctcaaaggctgctgagggcaggtcagggacaccaggctgtgaacccagagtccccagggtatgggtcaaaggttgattcttctcaaggcccagctggacatccagctgaaggtgcccaaggctggcggagtttgtattcatgggctctcccccaggtcacccatttaaagatggaagtagctgcgttggcgcaggaggaggagtctggggacactcttaatagggcaattcatctcagctctctgctcctgattccagtccacagccagctccccacccttgaagcctagatgcaggaacagttttcaacagtggcctaagagtgggagcacactctggaaagcagggttgagcatggagggactcaatggggttctgtgcccggggtccctgctctccctgtgcctcagacctgtggctccctagtctttctgccctgtttacctgtcctccccatccctatggggtttgaatcccggatcagcactcagtggctgagtgacctcagcaggtgacttctctc

SEQ ID NO: 158670 - DNA, 488 bp, Homo sapiens
ggtgggaaaagctcagctaaggaggccacgcagacagggcaagagcaagacgactaagggagaaggctgtggggtgttcctgcaacctttgatgccttccaagtcttaacctggaagggaaaatgaagggcctggccactgggctataacgagctccaaactgggcccacatccaagtcggaagtcctttaatgtgtgcttgggctggaggtggggcaggtgaatgaggaggaagagtcagcatagcaggccctgccctgggttgcaggtaccttggggggatgaggcggtagagcacagcttctgaccacagtgcctccaccacagaaagcctgtgccacacaggtcctcccctggcccctggggaatatgcttcagaagcagtgacagcagcaggctcagcgtttccattcaagaggtctgctgaaaatgaccctgtttcaggaccaaagtgatgaggagggaggacctctcttgccttatctgcg

SEQ ID NO: 158671 - DNA, 273 bp, Homo sapiens
caattcttataaaaatcgcaatcatcaaaggcttaataacttttctgaggctacgtgcatttttaaaaattagtcattgaagccttgggcctatgaaattaataaatacttaatggagaaatttcaggctttagagagcagtgaaagatgcttatttttggtgtcaggaggttcagggttccagaaatcctggtagtcacctcattgtaagcaatattcaccctaataatttaattttttcttgagtaacatagcaaaaaaccttgtctctgg

SEQ ID NO: 158672 - DNA, 504 bp, Homo sapiens
tgatctacagttggttggattcgtggatgtgcagcccacggatatggtgggaagactgtatatggccaaagaaaattctacgaacagtaataatacacttcctttcttctgtctcctctttatcagccatttttttgtttgatttcaccatcctaggaggtagacagggcagaaaccaaagagtgtcaggagtcacatagcaagtcagtggcagagttgggcggatccagtgctattagtacagtcatacataactagatgcatacccataattagatttttttaaataactactttcccaatacatgcaaaggctcaggaaagcaagggctggttttccattctctagtaactcttaagacctttttaagtgggaaatttttgtaccattggtttggacatgggatacatttattaggatgaaaccattaaagtttctgagaactagaaattattcagaaaccaccaatctgaaggccactctgaaaaaagtcaaggaaggat

SEQ ID NO: 158673 - DNA, 177 bp, Homo sapiens
aaaaatccacagttttttaacaacataaatgaaaatacaccttagttctccccctcactgacatctgaatcaaacactgtgtcaaagcactaatgtcttcctaccatttcaaccaatagtccctgacctatactgcacatgacactggtaaccactccctctctgggatctgccttc

SEQ ID NO: 158674 - DNA, 400 bp, Homo sapiens
aactacttcagtaattactttgaggtatgaagagcataatattctagaagagttatatgagaactcaatctgtggatacttgttgcataagtaataacatttgtggctatgacgttctatagcaaaaatatatttcaacttgcaatggtaggctggagctagctggctgagcagatagttaaatatagaagacttctgtgagccagttattaaactactgatggctcaaaaggggctatggtaggtattttcacaccaaagaaattggcaaacatacaaaccagggtttttttccttctctgttactttttggccaggccagtttatcagcgtaccactgacttcagtcagtacataattattatgtataaaatgcagctatacagaacagactattcac

SEQ ID NO: 158675 - DNA, 281 bp, Homo sapiens
agctgtcagtagatctaccattctggggtctgaaggatggtggccctattctcacaggtccatgaggcagtgccccagtagggactctgtgtgtgggctccaactccacatttcctttatccagttcagcactgatgagtgtctaccttgattccacatctttgctattgtgctttaataaacatatgcattaatgtgtctttctggcagaacagttatattcttttttcttttttttttttttttgagacagagtctcgctctgtcgcccatgctggagt

SEQ ID NO: 158676 - DNA, 358 bp, Homo sapiens
cactctgtggttgcatttgctggtcttcttctcttccttaacttctttttgttgctgttagaacaactcagcaaaataaaatttgggtttattgttgcacaatattgtttcacacatacatcaaataggcctaaataaataagcagccatttcatagacaaaaaaggcaaataaatgaaacattttatctttggcctttttaaccatctcacacaaaccaactacttatggtacaactaactacatacactaaagaagctactggaatgctcagaacgagactttttgttgttgttgttgtttttgagatgtagtctcgctctgttgcccaggctggagtgcagtggcacaatcttgg

SEQ ID NO: 158677 - DNA, 221 bp, Homo sapiens
tgccttccctgtctctggatggacccctctttcccattgactcccgtttcactgctctgctactgcttttccttcctccatagccattccccatcattgcttggtggcctcaaggaaagtctggagaacaccagatagaaacaccccaacttctcacctgcaaacctggaaattcatcgtaaccggcatttcatttttctggttaaaatggaacttgtctc

SEQ ID NO: 158678 - DNA, 338 bp, Homo sapiens
gacagatcctaagctctggaaaaggggagaaggagtcaaagaagatctttgaccttgcaattggaaatggcagagttgctaccatgaagataaaaggactgcagatggcacaactgtgtgaagttcaaatcagacacattaacttgagatttcaagttggcatcccagtggaggtgttgagtgggcagctgacagatcattcttgagtactgggagaggttggatagagagggcagtttgggagccattcagggtaaagcattctgatgtcacaagatagccaggacaccagggaactgactatacaggtccaaagacagggtgaagccttgaggttc

SEQ ID NO: 158679 - DNA, 568 bp, Homo sapiens
gggaaacccacatcacatgagccggacaatgcatgtaagaaaaagagcactgcctccctttcatcctctcctcctctggccacagttcaacacagatgcacgtgcccaagatttcagagcagactgccttggaaggcactgatgctactgcttccacggagcaggagctcatcctattttcctgatgaccgtggtctttaacctagcacttctgatatccagatccattatgacctattttccagccagaaattaatttatggattttaattatcttttagatagactgaacacagtttctacacaatgtgcaccgggccttcaaacaaatttcaggaatacatgcactctggtcatgatatctctaagacactgatttttcactgacatatgaagaatttaatttgaccatgatgagtctctttctggcagtagatggagtcagcagtgggttcacctacacatatgatgtggcctgtgaagttgtgaaaaataaactctgaagcgtaccctacagttcgaaaggcaggcggtgccccatcccccaatgtggcctggatctcatata

SEQ ID NO: 158680 - DNA, 544 bp, Homo sapiens
gaggaagcacatgtggaacagggtgattgaatatttggtggtaggataaggagatggtagctgcagatcttggtgaaatacatggatgcttgagagagttgtggatggaaggacagtaccttaatgctttgggttcagcttgccttgcaacttgcaaatagatgataagacagaagtaagtgctgactgaaatagaggactgaaacactgctcaaaagagttacagtagatgctgtctgaatagttggcacagaaacctcattgatactgggcagcttgtgttcagtgataggtgtgtatggggagagggagatttcatattgcagaaggtttatgaacagggtctaggtggtgcaggttctgtttcctgaaaagtagaaaatactggtaaagaaatcaaaaagagaaaatcagagtaaccaaccaaacagagacttgggtttatggattaccattcttgaacgttgagaagactgaatctcataaaggtgacagttattctcaaagtagaagatacgggacagtgactagaaagaggcagaaa

SEQ ID NO: 158681 - DNA, 311 bp, Homo sapiens
caggaattcgagtcttatatcattcttgaaaaaatttaagctttgtctctttggatattgctttccactattctctcttttatctcattctcttatactatgttgaacttgtccattctagggtctgtacgtcttagcctttcttccaaattttccgttttttaagtcttcatattagatgctagtaatttcttcagctcttcttcaggtttattattctcgtcaactgtatctaatccactgtttacctatttattacgtttattttatttcagtgactattttcatttctaggacttccgtttgatttt

SEQ ID NO: 158682 - DNA, 541 bp, Homo sapiens
cttgagctggccccacaccacctgagtcgttggcagttattcttcattattttcatcatataggttgtcatcttattgcatttatttcagcattcctaaatatattattctaccccactccctccttctaccctccagtcaatatttattgagtacctattatcagccagattttctactagatgttgtatataataaaacaaataagaatttcccctgttcacaaaacgtttgtggtatagttttggaagaggacaagtaagaataataacaaacaaacagaaaggacattctcatctcataacaaatcattctgcacacatctagaggagaatttttttccttaaggcagtaatttcctcatttcactcatctgttcaataacttacaatggctccatctcaccaacataataatattcaggttgcccatgatggttctctggatcaatttaacagggccacagttctttctaactttcttctaaatgtgtcacctaattatggctgccagatttaggatcacaaattattttatgtga

SEQ ID NO: 158683 - DNA, 322 bp, Homo sapiens
cattcatgctgtcttgcacatgataagcacccagcaaattttaactttattccacctttcctcctcttctccttgttgtagtggctcattccttcctagagataaagtccaagcttcattgtttgacttagcaccctacctgatctagccctgccagtccaagtgacttgccctctaggtatgcagaaactgctcacggtttcccaaatattccagattgttttgagactttatgcatgagattcctgctgattggtgtaccattttgtttctccataaacacatacttatcggaagcatccttgaatcaagtgtcccatct

SEQ ID NO: 158684 - DNA, 427 bp, Homo sapiens
ctgctgacctatagttccattgtctaaacatgctctgacagcactaatacccttttatactcacactactgccacctccagttactgtcacatgcttcaatatctcttctaacaaattcagattccagacttaatttataattgatcttccccaaacctcaaattgaattgttttacttttgtgagcagccactgactagagatatggctatcagaagaagaagcagattacagctttggcagttataatgaaagtctctaagaacagctttctctgttctcattcacttctctactctcctcccagtctctggtacagctatcagggcttcattcacctttccttactgtaaatatatgctcttggggaaagatccaaaaacaaacacacacatgaacagacaaagggaaagcatctgttaacatt

SEQ ID NO: 158685 - DNA, 554 bp, Homo sapiens
taaacctgctttctttcccacagggtaaaataaagctgctgtcttcatatttccaatgagaagggacatgtgtctccttgcattgaattgtcttagatcatatcatgtagcacaaagtgacccaatataggaagacaggaaaacaaagtgacagttttgtttgctctaatgtaaacgccaacatcaaaacatggggcaaatcctagaggcccactgccagaacacacaaattaaatagcaagagctgatattctgtacttaaaaaaatgtattcaagggatattctgtaatcagcagtgaaaggttaatgaacaaataagcttagctcaggttagacaaactgagtgtaactaccactgtttttaaagccatgagaaagtgaatctggctgatacttgataatacatcacacactgtggtcttacctattgattacaggctgacaatgggtaacctttcatggcaacttcctcttttaccatgaattattgacagtattaatgccaataacacatcatcaaataggaaagaaatttacattcctggatgtacta

SEQ ID NO: 158686 - DNA, 205 bp, Homo sapiens
aagaacaatgcttcaaaatcaaattcccactgttgagagttactggctgataaaaatagcaggatggagggccaggcgcagtggctcatgcctgtaatcccagcagtttgggagactcaggtaggaggattgcttgaggccaggagtttgagaccagcctgggcaacatgatgaaaccctgtctctacaaaaaaaaaaaaaaaaa

SEQ ID NO: 158687 - DNA, 476 bp, Homo sapiens
tccaagaaggtttgcttctcttttctataatatcctcttacaatttttcccaccaccctgactgaactcccacatctctcctctaggggagataaggcagtggctcttgggccatcctatttacacaacaaggtcctttagagagcacaaaagcttcagattcatacggagagaggctacaaagatagccagagccagcctgattaaaagaatagatggacaactacccctttaaaaatatttctcctccttgtcatgagaacttgaaagtccctcaggagaaatttattcctttggttttgcctttgttctttcctgaaatgcaactctccccaggtggggaaagtttcagatacaataagttactcagattctagaatgaaccaaattattattttttcttgtctggctggtttccagttgagcacccttttgatccaggaaggaataattacagctatgacgctgacggatat

SEQ ID NO: 158688 - DNA, 602 bp, Homo sapiens
ttacgcttaattatgggtggagatgtagctagtcttggaatcatgattttggtagttagtcaccatttattgaatgtctgctgtacaaatcttaaattagacatttggagaagggtgaggaaagggagggatagaaaagaaatgaaagatgtcatctctgtccttgtgaaggttagagagaaaaacatattcccccatgatggatataaccaattatgttgaatagtttatggaaagaaatgtactgattaaataattttttaaaaagtgaattcttaaaacttttatgtcacctgtctgctctttcatgatgcagctgatggcgttagggaaagaatgttaactcaagtcacatgacattttgtaggaaatcccctcttttatattcagatgtggttttgaaatgtctaaggattccgagaaatgcttccatgggaggggctccataacaccttcatctctagaggaaatactggcataggatttccagaattttttgctgcaaaaacaaccaaagctagaaacgctcatccctgaaagtctgtgcctgtggctcatttaacaatggggtgcacgtagtcactctgaaacccattcgctca

SEQ ID NO: 158689 - DNA, 261 bp, Homo sapiens
tgctgttttctgaactgaactcttgacttgtagaggattccattcagaaaatctaaagacacattatccattaaaaaaaggctgtattatttgtgatagaaagcctatatcttctctatcattaaatggaaagttaattgtaaggcaattacagcaccttaattaccagacatctgcatctacaaattcatgcacataatttttctgagaatttgaatgcttatattcatttcaggggcagagttatacatatgcctttca

SEQ ID NO: 158690 - DNA, 285 bp, Homo sapiens
tgaaaacaatatcatcatgaccacttaacgtagaagagtgtgcttaaaaaattatacacaagtggcataaaattttcccctttcatcaacctttcctcaagactaagattgaacaaagtaatttagccttcattttttccctgtttattctctggtggagtaaaggggtgagtgccctgggtaggagaatccatgtagaaccagaattagccataagtgagattttgcaccctaaccaacaaaccacagcattctttttttttttttttttttttttttttgagg

SEQ ID NO: 158691 - DNA, 925 bp, Homo sapiens
gaggagcaatggtcacccgggatcgagctgagaatagggacggccccaagggccgccaggtctgagcccggcaccgtgcggcgcacgtgcgtgcgcgcagagagtccccaaagttctccactgagacaaagagaaactgcaccagacggagacgtagagagaaaagaggaggagagacacagagaggggaggagggaggacgagactgagagaggagaatgcgaagatccggggagatgctcaagccgcttgtggagaagcggcgccgggaccgcatcaaccgcagcctggaagagctgaggctgctgctgctggagcggacccgggaccagaacctccggaacccgaagctggagaaagcggagatattggagttcgccgtgggctacttgagggagcgaagccgggtggagcccccggccgccgcggctccagggttccccggtccccagtccaggacgccaaggcgctcgccagctgctacttgtccggtttccgcgagtgcctgcttcgcttggcggccatcgcgcacgacgccagcccgaccgcccgcgcccagctcttctccgcgctgcacggctatctgcgccccaaaccgccccggcccaagccggtagatccgaggcctccagcgccgcgcccatccctggaccccgccgcaccggcccttggccctgcgctgcaccagcgccccccagtgcaccagggccaccctagcccgcgctgcgcatggtccccatccctctgctccccgcgcgccggggattctggcgcgccggcgcccctcaccggactgctgccgccgccaccgccgcctcacagacaagacggggcgcccaaggccccgctgcccccgccgcccgctttctggagaccttggccctgagccttggggggtggtgggggcgggtactcaagagtgggg

SEQ ID NO: 158692 - DNA, 572 bp, Homo sapiens
cagagccaagggaggagggtgggaacgaaaagagaagaggataggcacttgctccactctggctgtgagccgggcggggctggcccaaggcggtcttgtacagaaggtcccggggcgttggttccagaggccccagactggtggaagattttaggagaaccgtggagaaggtgaaggcctggagggttttgagggaaaagaggcggcgcggtcgcgctaggtatctccctttctatactcagggccgccaggtctgagcccggcaccgtgcggcgcacgtgcgtgcgcgcagagagtccccaaagttctccactgagacaaagagaaactgcaccagacggagacgtagagagaaaagaggaggagagacacagagaggggaggagggaggacgagactgagagaggagaatgcgaagatccggggaggcgagctacagaaactgatctaggggcattgggagggggagcggagagggatcgaatggggccggccctaggcaatctggggtcttgtggccggggtggaagccgggctctcccagcggcgggatccgacgccggggcggccgc

SEQ ID NO: 158693 - DNA, 739 bp, Homo sapiens
gaggagcaatggtcacccgggatcgagctgagaatagggacggccccaagatgctcaagccgcttgtggagaagcggcgccgggaccgcatcaaccgcagcctggaagagctgaggctgctgctgctggagcggacccgggaccagaacctccggaacccgaagctggagaaagcggagatattggagttcgccgtgggctacttgagggagcgaagccgggtggagcccccggccgccgcggctccagggttccccggtccccagtccaggacgccaaggcgctcgccagctgctacttgtccggtttccgcgagtgcctgcttcgcttggcggccatcgcgcacgacgccagcccgaccgcccgcgcccagctcttctccgcgctgcacggctatctgcgccccaaaccgccccggcccaagccggtagatccgaggcctccagcgccgcgcccatccctggaccccgccgcaccggcccttggccctgcgctgcaccagcgccccccagtgcaccagggccaccctagcccgcgctgcgcatggtccccatccctctgctccccgcgcgccggggattctggcgcgccggcgcccctcaccggactgctgccgccgccaccgccgcctcacagacaagacggggcgcccaaggccccgctgcccccgccgcccgctttctggagaccttggccctgagccttggggggtggtgggggcgggtactcaagagtgggg

SEQ ID NO: 158694 - DNA, 295 bp, Homo sapiens
cccgccctgggcgtttcagcactctcctgccctcaatctcttgccacatcaccaccctggacatcgccctctcctgatgaagaacctatgatggctcctatactcgtagaagcctggaccttcagcctggcattgaggccttgcacagctggcctgatcctgctttcccaacacaccccactgctctgggctgcaccctggggtgcccagaccaccgcctgtgtccggaaggcctctgcccggactgctccctctgcagggatgccattcctccaccctcactccgtgagcccgt

SEQ ID NO: 158695 - DNA, 612 bp, Homo sapiens
tcaccacccagataatccaccatatccactccatatccacaacgcactctcttgactttcaaaaatcaaacccaccagcagaatttgatgatgatctacttttaacgacatttaaaagaacaaaccacgggccccgaaagtcattttcaagaggcatccatgtttgaatcactcacaataacctgggaatcaggctggggctgatttccagcagaaaagaaaggtctgttttgaagaatactagttcttatttgacccattaacaattcagtctctttgcacatgagtgagaatgcacaacacaacgtaccttgttggtgcacacacatgacaccaagtgtgcctgtcctccatagagcagggaccaccccaaagcaagggtcatgtctcctttctcatgcccaagagattagaaaatgcacaataggctgggcgaggtggctcacgcttgtaatcccagcactttgggagaccaaggtgggcggatcacctgaggtcaggagttcgagaccagcctgaccaacgtggtaaaaccccatttctactaaaaatacaaaattagctgggcatggtggtacatgcctgtaatcccagctactcaggagactgagg

SEQ ID NO: 158696 - DNA, 309 bp, Homo sapiens
ccaggtagacctaacccaggtagactaacccagctagacctaacccaggtgagggaagtgtttacaatagcaacaacaggtaccaagaccggaaggagaagataggatattgggttcaacctggaagagtgggacctcccgctacctgtctgtggtggaggcagccctctttccataagtgtgcagtcatttttgccctcactcacttcactctgtcacctagaatgaagtaacaataacaggccacaaatgtccatccttaagattatgatgtttctggagagtctctatttttcagagttaggttta

SEQ ID NO: 158697 - DNA, 203 bp, Homo sapiens
ttcttggtataatagtttttttccttttaacaatagtctcactgattggtggtgtatatatgtatttttttaagctacttgttatccattcaataatcaggaccacctaataaacttttgatgttttgtgattattagatgctaaattttgggggctatttcttatatcactattctgcctcattgatctatatgtttctctt

SEQ ID NO: 158698 - DNA, 499 bp, Homo sapiens
tacactctcagcactttgggatgccgaggcgggtggatcacaaggtcaggagatcgagaccatcctggctaacacggtgaaaccccgtctctactaaaaatacaaaaaaattagctgggcgtagtggcaggtgcctgtagtcccagctactcaggaggctgaggcaggagaatcgcttgaacccgggaggcagaggttgaagtgagccaagattgcgccactgcactccagcctgggcgacagagtgagactccgtctcaaaaataaaataaaataaagagggggtaaaaaaccataattgtctaagaattgctctgaggattacatcagtgtaaggtaatgaactttactgaaatgtatgcaaaaaatatcactttcattatcattatcatcatcatcatcatcttcacctgatactttaaaaacttcaaatgaaagagggtaagaaagaacccactggatcccctactctgtacctggcattgtgctacaggttgtg

SEQ ID NO: 158699 - DNA, 465 bp, Homo sapiens
agaagcagcatgcatcattccagctcacattcaattgtctagagctcagtcacatagtcacctgtgtggcacgggggtgtaagcatgtagccaaccgtgtatcaaaggggagaagatggttctggtgaacagacccagctggctgcccacacatccccactgaagcactactttgtacaagatcctcctacatggttccatgataggaaatccacttctgctcaacctctcccaaactctcctggtgatagaatgctggcagtgtgactccatctcttgacactgagattgttcaccttgcagctggttctctctggtacaccagccacaaagctcaaacccagtttctctttggtatccctttagccttcaggaaactcaggtcctcacctagccacaaaaagcgagagcaaagcagagaatgaagctttctctctcctccattcctttttatctccacctgca

SEQ ID NO: 158700 - DNA, 333 bp, Homo sapiens
acaatttacacaatttcacagaatccataaacatcgaaggaatctattggtattataactcatcatgcggattaccatgctgcccaggtgggcattgtctttgcctttcctatcatctccttttgacttcatgcttcatgtaaatcttccgggacaaaagtagaaagtagcatgtctctctgtttcggtttccctgcctctctctctttattctgtctttattaaatgcctcattctaattcccaaatcattattttttgacattttcattcctatcatttggttataattttatagcttttaatcctttcattgcacctgtgtaaactaaag

SEQ ID NO: 158701 - DNA, 329 bp, Homo sapiens
gtaccacacttggggttggggaagctgtgtactctggctgttattgtgacagttatttttggtctgggcactgacaaaaccagtacaggccagaggcatatcaatctgctctgcaaggcagagaccccagatttcataaccctgtgttttttggtaacataatgaagttattccttaccttataaattaggatgtcaaatttctcatgttgcattttattttaagaagacctggatgtcttcagagataaacaatttgtctatacccaaaataccatgaacttaaattatgtttgtcttcattcaaggatttttttttttttttcccaa

SEQ ID NO: 158702 - DNA, 776 bp, Homo sapiens
ttgagattacagagcgagagccgacatgcctgaactgaatcgccttttatacatctatcaaataacccgacttagaatttctaaggtcccttttatctgtctgctccagatactcccaaggctgaagcaggagggtggattgagccctgaaggtccagactgcagtgaacgaaccatgatcgtgtactgcactccggtctgggtgacagagtctcaaataaaggggggaagatgaaactaggagagggaaagagagagaagtggggagagggaaagagacaagacccgaagaaaggggacagggaccctgagacaggcaaagggagggagccctggagagtagaggcgggaggttctggagcccacgccatgagggctggaagacacccccacccactgctgcaccgagaccccaggaccgtcctcttctcttcccaggcccctccccacggtctccaacacacaaagcagggtgctgcagctggcctcccagggcctggggggccacagcgacctcaggagcctgctgtgcaccttaacttgctgtctgtccccaatccgcggcattcagtggcacccgcttttctggggaggggatccccaactttttcatattctcagcagtgtccaaaccccctcaaaagttccaaagctgctgactgggagccacgctatgtccagcccccgggaccccagccccattggaaacaggaaaaggagggaaccccaggctctgacggacgagtgaagcctcatggggctcaagggcctggaat

SEQ ID NO: 158703 - DNA, 673 bp, Homo sapiens
gatggacaggagatgagactgagaggtgagactggagtgagagagatgagaaagagaggatcagagagagagagaggcagtcacagagagacaagatccaaaggaaggggacagagactcagaggaagatgaaactaggagagggaaagagagagaagtggggagagggaaagagacaagacccgaagaaaggggacagggaccctgagacaggcaaagggagggagccctggagagtagaggcgggaggttctggagcccacgccatgagggctggaagacacccccacccactgctgcaccgagaccccaggaccgtcctcttctcttcccaggcccctccccacggtctccaacacacaaagcagggtgctgcagctggcctcccagggcctggggggccacagcgacctcaggagcctgctgtgcaccttaacttgctgtctgtccccaatccgcggcattcagtggcacccgcttttctggggaggggatccccaactttttcatattctcagcagtgtccaaaccccctcaaaagttccaaagctgctgactgggagccacgctatgtccagcccccgggaccccagccccattggaaacaggaaaaggagggaaccccaggctctgacggacgagtgaagcctcatggggctcaagggcctggaat

SEQ ID NO: 158704 - DNA, 270 bp, Homo sapiens
ctctcatgtgggtttccagtgaaattgtctttgtaaacatttaaatataggtgtagatcctttttaaaagtcaggagacctttggagagtaccaacagtgaagtatatcacgtgggcaggggtgagtggagaaagattttctttcataagacaagagattatccttaaaggagtctggcggagcactgaggacattgcttaggacagactcccagggtctttccgtggtttcccattaattatttttccctctcaatgctatcatatttt

SEQ ID NO: 158705 - DNA, 214 bp, Homo sapiens
acctttgcctttcagacatagtctttgatgatgtacttttagtacttcataggtgtttttgaacttttttctttatagttctttccccaccccctccaaccttatggattacatgtgcttactttttggtaattaaaactgttacgttggacgtgatgcctcacgcctgtaatcccagcaccgttgggaggccaaggtgggaggatctctagag

SEQ ID NO: 158706 - DNA, 186 bp, Homo sapiens
tacccttcgtgcttgacatacagtaaagactccataaataattgtttgataactactgaatgagtaaccagccatcttcactcattgatctgctgggagcaacagaagcaggcaagagtagcaccacatgacacaggaataagaggcacggtttccaagagcaggccggacgcagtgactcacgcc

SEQ ID NO: 158707 - DNA, 412 bp, Homo sapiens
atcagtggtttcccaacgattattccggtaaggtttagagagaacagggggtcttatgctccaccaatggccaggcatggtggcttatgcctgcaatcccagctctttgggaggccgaggcgggcagatcacctgaggtcaggagaccagcctggccaacatagcaaaaccctatctctactaaaaatacaaaaaattagccaggcgtgatggtgggggcctgtaatccgagctactcaggaggctgaggtgggagaatcacttgaacctgggagacagaggttgcagtgagccgaaatcgtgccactgcaatccagcctgggcaacagaataagactccatctcagaaaaaaacaaaacaaaacaaatgaaacaaaataaaaaccacccaatgagctgatatctaaggtct

SEQ ID NO: 158708 - DNA, 244 bp, Homo sapiens
ctccattttctgtaggtcacctcctgccacctcttctccagggtgatgctgtttgcaacacacagttccttgtcttggtttcctaagcatcttatttctgaaggtgagatattggctgtaacaattaaactattattacaagcttggggataacactaggtccttaagaaaagaataaaatcaaacctgagcttcagataaggatcacaggattaatgcctgccttgtaccggacaatagggat

SEQ ID NO: 158709 - DNA, 242 bp, Homo sapiens
catacaactgtggagatgaaacataaatacgtttataaaaagtacaagctttctcaggcaggggatttatcgtctatctcctttatgtaccccatgatgcttatttaacatggtgctaaatgtggtgagcgctctctgggtgttttgtgaattcatgtaagattaaaacataatattttggaagttatgcaaccctttagacgagtacacccatacaaattagtctataaaaagatttagga

SEQ ID NO: 158710 - DNA, 206 bp, Homo sapiens
ttctgatccatgatttacgaggttgctgagatcattccaggcctgcggggtgcggccggggggcggctcggtcctcctcttcccctcctgctctcgctgacactcagtgaagctctttcctctcttttcctactccgaatcccccaaccccacccctggctcaaattcctcattcttctgtagcaaccgtctccacctccgagcca

SEQ ID NO: 158711 - DNA, 452 bp, Homo sapiens
tactccacaaacacagtgtattacacaatcaggttttttcaataagggtttggttgggaaaaaaaattaacgtaaatgatccttcgaagctcaagcccatgttgttcagggtcagccgcacttactacttgtgtcataatctgaggcctgacagccatcgttcttgataaagggatggttaacaaactaactgttctgattagaaagcggaggaaaaagcttatttttaagccgacaaagagtggacactgctatggtgaatggaaaacagacgtaaataagcaccaaggctggggtgactgcctgtgctcagacccactaaggcctgttcctccgcctccctctgctcaaatggataactccttccccacggctaaaggaccttttttaaagattcacgcgagaagtgctatgaaaagctgaaaggtcacagataacgttttaaaaaataa

SEQ ID NO: 158712 - DNA, 594 bp, Homo sapiens
cagtgctatccataacaacgtaatgcaagccacttaggaaaatttaaaatgtagtagtagatgaaattaattaataatatatcctgatatatctacaatgtagtttcaataattgataataaaaattattaataagattttatctttcgtactaagtctttgaaatctggtatgtatattacagatagtacatttcaatttggactagctgcatttcaagtctttgatacccacatatggccagtcactgccctattggacaaaacaggtccaaagagtagacagaaaggttttggtatttccccccttttcaagcccatcagtggcttgttaagatatgattaagatctcaaatcccaaaagcaaaacatgttctgcttccccctaatctcaaattgctcttggccttatgcattttttgccacattgactttctttcattcctggaatgtttctaagatttttccaagggttttacgtgcagaccctttacctggtttgctgttaatatcctttagaatttggctgaaaatcactaaagataagtctctcctgatcttaacccctgcattaaatctgtataattttgatata

SEQ ID NO: 158713 - DNA, 230 bp, Homo sapiens
ctcttcttcaatctggaatttagatcaatctggcaaacactgactgtttccctcttgcttgtcagtcacctttcgttaaaagagggggcaggaaaaaccacttttcaacaaaagacttttagatttaaaacctttattttcctccacttttaactaaaattttaagatattctgctggtcaacataaaacccaaaaatagatgaactgcaaaattcaagaattatgtatt

SEQ ID NO: 158714 - DNA, 120 bp, Homo sapiens
ctgctaggtgctttacaattctcatcaaatgtttacaaaagtcccatgaagtaaatacgattattagcctccttttacatatgaggaaaactgaaaacacagagactccccgggatacag

SEQ ID NO: 158715 - DNA, 650 bp, Homo sapiens
  misc_feature (628)..(628): n is a, c, g, or t
  misc_feature (634)..(634): n is a, c, g, or t
tttacatacaaagtcccatgataagtcatttgggatcccccagaggaggaaggctgcttgcggttagactgggtgagtcaacgaaacaaacaaatgggcccgatgaggtcagctttttggaaaaggaacaaagaaaactgcacccaaatgagaggcagcttacaatggtgaagcagtggtcacagaaaatccatttccaaagcctctaatccagcagtttgggggatgattttgtcacccaggggacatttggcaatatctaaagacatttttggggccgggtgtggtggctcatgcctgtaatcccagcactttgggaggccgaggcgggcagatcacttgaggtcaggagttcgagaccagcctggccaacatgacaagaccctatctccactaaaaatgcaaaacttaactgggcatggtggcacacacctgtaatcccaactacttgggaggctgaagcaggagaatcacttgagactgggaggtggaggttgcagtgagccaagatcgcatcactgcactccagcctgggtgacagagcaagactctgtctcaaaaaaaaaaagaaaagaacatgtattccatattcaaatgcagaatccactgaagatgagtctcctgcggnaccaanccattccacatcaggg

SEQ ID NO: 158716 - DNA, 591 bp, Homo sapiens
aaaagatgtcaagaaagctctcactggagaaaaccagtctgattgtctccagctctgacacagctgccaggaaggatagtggctggctggtggacatccaggccaaagacccagagaaccacaggttgaatcccaaatcctcagaagtgtactctaaagacagtaaacaggccaccttcacctcaggggcatcaggatctcaaaatcgagggggaggtcaggcccagctaaactgtcatagtagggtctgagtgtagtcatctccacagaagcagaaagggacagacagatgccctgctctggccctcaagctgcagcagcaccatacagcaaccccaccagcacaagcagagcacaaccaaggctggagtgcagtggcgcaatcatggatcatggtagcctcgaactcccagactcaagtgatccttccacctcagcctccccagtaactgagactataagcgcgtgacaccatgcccagctaaaaccacaactggagctgagttaagcattgtcctcctctgcattctctcttggaataacccctcccatccatgaaaggaataaaacacttgtcatgagcactgaatt

SEQ ID NO: 158717 - DNA, 553 bp, Homo sapiens
aataatggaacatggatattaaactaagccacatgctatagaaggattacattttgactcttttcaactgtatcattttggtaaatattagaatcaagtttgttcaaataataatacattctcgagtttcatctatcactatgtctcaggtcttttcttgtcattcttgtgtctggccagtctttcacgatgaatgtcataaatattactcagttctacataccaggcactgaataaagaaaagttattagtatgaggagcttacattttagcagaatagagagcaaaaacggaaatagagaattgcagcatagagggtttccatgtatttacagtgctgttagtgcaattaatagagatatcaagcaatgttatttggagtacagggaggagcatttggtctggcatagtgaggaaggtcaggaataacatttaacacagttgtttgctgaatttgaatctgaaaggaagcagtcactgccttagagattataggtctagttgggttgatagacatataggaattaaatagtaacagaatgattttcatgtt

SEQ ID NO: 158718 - DNA, 653 bp, Homo sapiens
  misc_feature (634)..(634): n is a, c, g, or t
  misc_feature (653)..(653): n is a, c, g, or t
ttggaaagataaaggtttttcccctaagatcagaaacaagacaaggatgtccactcttgacactctgctcaacatagtaccaaaagtccttttcattccttttaggcaataaaaaggaataaaaggcatccaaattcaaaaaaaccctaggggatctaccataaaactgttagaagtaataaatgttatttatttgcaactcagtgtgctcccacctgtaattcccgcactttgggaatacaggtgtgagccaccatacccagcctaaagttaagttattattaacttaaaatagactgttataactatgagatgttttaaatatgtaagccttatggtaaccacagagaaaaactctctagtagatacactgaagacaaagagaaagacatcaaatcataccaccataaaaaaatcaaatcaaaaagagagagcgagagagaaagaagagaaggaggcttgcaaaggactacagaaagaatgctgggagagggtaataggcccagagtagaggagcttatggagagaatgaagtggtcattcgtgtcctgggcagccaacagttgaagcagatgaggggaaaaaagtctggtgggtttgacaattttcatgggctggggcaggtgaatcatangccaccaggcttggacacn

SEQ ID NO: 158719 - DNA, 210 bp, Homo sapiens
gggaaattcagagaagtagctcctcaacagtgtcacccgtcagtagaatacttccttccagaatcagtgtcaggaaatgtccaggaagccaggaactgagcctacacatcccgatgtcccaagtgcatgcgcatgtgtggctagccaatcccttgccttcctgcctctgggaagattattaggtcttccatttgttttcaagtaagaagc

SEQ ID NO: 158720 - DNA, 433 bp, Homo sapiens
agggtttcaccatgttggccaggctggtctcaaactcctgacctgcccgccttggcctcccaaagtgctgggattacaggcatgagccactgcacctggctgatttttttttttttatccctactctgtatcaagcgttggagacacaaccatatagtctagctgtgcaaacagacattaaacaaatgattcctcaaaaggcacaaagtgtttgaacgtctgcagagtgctgtgtgagggtgaaggcaggggagcttggtttggtctggggcatagccaggcttctctgagggagggatggtggaggtgaagcctgagaatgagcaagttgttaaaaagcttaaggggctgagggcagaggaccagctgcggagaaaagcacatgtaaagtcctgagggtcacagggaaaacttgagagttgtgtgtggctgg

SEQ ID NO: 158721 - DNA, 789 bp, Homo sapiens
caagactttgcaaacctccaccagactgaaccctgttctgtactggcatcttcacccaggcaggcagtaggcactggaagctggatctctggctcattagggcctggagggtactatggcagaaccctcatctcaaatatgggaatcccttgtctcagaaattaactttgtaaaactttgtatttagggcatctctaaattggcctatccatcattctttgccccccttgctcaggtaatttgaggataatatatgacctcattctcgtcattacccactgtcatacaagctgtaatgtcagtcctgcactgtgcctcatccaacaccgtccatcttccccctatctgtgcagccctccttctctcctggctgcttaagagaagagaagctgcctgcagatcccaagccatttctcatcaccttcctcccttctggcaggagcctgtgtttggcagaccaccacatcagggctgcagcccaggcctctgccagttgagcacccagggctacatagcagcactagggggaggcccagtgagactctaggtcccagcaaatgggcagtcgggtgcagttgcagaccttctggaggacttcagagccaagagtgcaactgcattcaaggcagtgccttagtatttgcaaagctcaatacatttaaatgataatacctggctcagtgacacatacacatcctcccaactactcagcaggctgaagtgggaggattgcttgagcccaagagtccaacctaggtaacacagcagtgaaaccctgtctcaaaaaaa

SEQ ID NO: 158722 - DNA, 110 bp, Homo sapiens
ttcttagtgtctgatgatcctgggctatcattcatatttataaatgaaggtctaagttgatgagtacacagggctctgtttcctccatctggtctctttcctagagagaa

SEQ ID NO: 158723 - DNA, 379 bp, Homo sapiens
atctataaataaagcacaaacaaatgctatctattctcagtatgcacaagaaaacagccccatacttctgacagatatcttttttcctaacacaattaactttggccatttctacctgactcactttactcatgctgtaatatttatattggctttgtctctttaacataaaccatatgttatcaagagtgagatagcatctagtataacacttaaaaccttggggatgaagctgaagataaggaaaagagtaatagctagagttcactttagtcaagtctctttattaagcactattgcatgtaaagtaactacatcctaatatcctctaaaagagctaagtagtaaattgtagttcctgcccacctagacgcctgta

SEQ ID NO: 158724 - DNA, 176 bp, Homo sapiens
gaggacctggaatccctctctgtgtctccttttattgctgagggtgggagactgggggaaagggacagggcggcacgtcgtgcggtggcggcagagccgggaggaaggcaggaggctgccttgcggctggcagaaggcctgagcggggacggaggcggccggggccctgcaggctg

SEQ ID NO: 158725 - DNA, 492 bp, Homo sapiens
catgtggcatccacgcagctgcagctgcctgggatcacggcacacgcgactctcatgtgtcgttgctgaggagcaattccctattacctctgtcttctcctcaacttctgactctgctgttgccttcttgcggcatctacatcatttcctccagcagaactcacttgccccaggcagcgactccaggcgcctgtctcaggctgcaggcacggggacccgtggctgccacacacagcttgagggcaggaggcccctgccccgaccgtctacagtggcacatccagctgcagcagtgagaagcctgtgaggccgcagctcacccctgtgctggtaccgccacacgcgctcacgtacacacgtgctcatgtacacacatgcatgttacaggcctgcgtgggtggactcaggtgtgtgggcgtccatcctgaatcgggacagaaaagtcatttgtagaccatgcatgacctcaaaatctttccaaattaaatcttc

SEQ ID NO: 158726 - DNA, 159 bp, Homo sapiens
gcccaagaaaccaatattactactcacatatgtgagtagtgatatacgacaaaatcaaaaaatttatgtgaacactttttagcttagaatgtgccatttttcttcaaaaggattgtctagcagcagcccagaataaacctgagtaacactaatttctgc

SEQ ID NO: 158727 - DNA, 405 bp, Homo sapiens
cggatcacttgagtccaggagttggagaccagcctgggcaacatggcaaaaccctgtctccacaaaaaatacaaaaagtagccgggtgtggtggcacacacctgtagtcccagctactctagagactgaagtgggaggatcacctgagccctggaggttgaggctacagtgagcgtgactgtgccactgcactctagcctgggcgacagagtgagatcctgttaccaaaaaaaaaaaagtaattagagattatttggatatggaagagatagctttttctatgctctatctgaattttaaggagtatctcctagaaacagaattagtttcacctaagaataaactacaaatatagagtaaatattaatataaataagacacattgaagtgggggctatagttagt

SEQ ID NO: 158728 - DNA, 260 bp, Homo sapiens
gttctggacagactgaatattcttataagaataagttaacattatttattgactactcattgtgctgaatgaacaccatttgccattactcttgagagaaaatcaatgacataaacttgtcaatacattttaatccttttgcagccctcattaaactatgatgggagattgtagcagttccccatttcttgatggatcagaattgtcttgtatatttacttaaaccaggtatttgtagacaaggcctccagaaacctatg

SEQ ID NO: 158729 - DNA, 153 bp, Homo sapiens
agttgcttagcaataccaggaaattaatttccgagtcctaacgttgaaattaatacccatttcttctctttctaactacagtggccttggagaatggtgtattgtattgtgccagtgttccctcaaatctgtgtggttttatttggttgttat

SEQ ID NO: 158730 - DNA, 111 bp, Homo sapiens
cgagagcagcctaagcaacatggtgagactccatctctacaaaaaatacaaacattagcagggagtggtggcacagccctgtagtccctgctactcaggagggtgaggtgg

SEQ ID NO: 158731 - DNA, 290 bp, Homo sapiens
actgacctcgggtgcagctggcctcccaggccaagcgcccggccctgcccaggcggcccagggcagcttctccaaatcctgggagaggacgggtcccggaaattagtcatgaccctgggccttccttccaagatcactcaaagataagactctgagtgtctatttggggcttcctgtgcaaatggaggtggacctcactcacaggagagaggagagattctctcagcaccagtggtccctgcctagtaacccacacgctacattccgtgggccccagcatcgacgacata

SEQ ID NO: 158732 - DNA, 182 bp, Homo sapiens
atttaatggtgtaggcttctgccaagggggtactagaggttactccagtgcacaataaaataaagggaatatcttttgagtcttcagtttttagccactttcaactcattgggttttctcagccttaaactaaggtcattagctttcacaagttctccctacaaacaaaacaaatgctgggt

SEQ ID NO: 158733 - DNA, 458 bp, Homo sapiens
gcgattctcctgcctcagcctcctgaatagctgggattacaggcacgcgccaccatgcccggctaatttttggattcttagtagagacggggtttcaccatgttggccaggctggtctcgaactcttgacctcgtgatccatccgcctcgggcctcccagagtgctgtgattacagtcgtgagccaccacacccggcctgtctttaagttttatactagttaggaggctagtctatcagaatgtccctaatttagctgaggaacctagacaagtcttccttgatttcagcttcatcccaaggcctctgaatattttctttaaaaagctgcaggcgaatgaggtaaaatggacagagacatgagatagaaatcaacagaagggcaaagagtacggctcccacagcactaataggcagtaggccttccaagaccgaaaaggcaaaaagcagtgtgaccac

SEQ ID NO: 158734 - DNA, 562 bp, Homo sapiens
cgggcgatctagaggatccctcgctatcatcggcacagcatcatcacaattaattgccataaacagcagcacagcaggatctaccactctgttcctcttcaccctgcatcacacacctagtttctattccacagcctcacatgtaacgtggtgggaccatgtaactgggttctatagctaacagaaatgtgaactcaagtgacatgagaccatttcaggctgggcttataaaaaacttcatgacagtccatgttctctcctcttccaccagctcatcacaagtgtgcatagtggcatggaaaccacatgctgcagatggcagagccacaaaatgcagagcctagagccctgaatcaccacttagaagagagtcacctgctaattagaaacacctctttgggaaatttggtgaagaaagtatagatttctcacagattaagtcacagaggttctggagtttctctgttatggcagctaacattacctttctccattcttaaacattgggtatgttcccactatctacagaatgaaacctgacctccctagcatggcattcaag

SEQ ID NO: 158735 - DNA, 305 bp, Homo sapiens
tacaaagaaaatgtgcactttgtggatacaatgacagcaaatcgttttccctttttgtccctcttcttcgtccctgttcatagacaaatgatggagagaaataagcatgattctgtgcagacaagacgaaaataagtttaacaacaaaaggaacatcttttagggaagctttcgagctgatgcagccccgtcggggtggggagcaacttcccccgaggcacagcctgctggggtctgcctggcccctgagtccacgaagtccctggatgacagaggcttgggtcgtggagcatctgccctgatgt

SEQ ID NO: 158736 - DNA, 334 bp, Homo sapiens
ctaaaatttttgattacattgaatattagccaactgctaaatctcaaaaaaaataaagaaaaaaaaacaagtaggactcagctatatgtttaaactgggaaaagatgtgttagcccagtggtttttaacaaggagtgattatgacaatgatccataatccttttaaaaatacagaggactgcatggaccttataaaatttaaatactgttattctgatgtgaaccgacagttaacaatcactgttctaggcagagataatggcaaatgctaaaatagagagtttgaaataaatgaatgaagaaggggaatatgaatatataaaaatattcagaa

SEQ ID NO: 158737 - DNA, 212 bp, Homo sapiens
cctaatatgggaaatcgggcagaaggattcactgtccgtgactggatattttggcagagtccttttctcaagcttggcttccctatcatcaagggaggcaggttctttgagcagattcagacctggggaatgggtcagaggtcaggaacctccattgtgccagctatggtggtagttcaggtctacacgtctaggggaccacgatgggctcc

SEQ ID NO: 158738 - DNA, 499 bp, Homo sapiens
aaagaaagcagctaataaccatctcactaccataaaagcagaaatatacaatgtcacgctatcctggataatgaggagtcatagaaatcccctacatacccttcactgcttttgtgtttttctgaagttaatgcaaacagagaagcaaaacaacattaccagcagtttcagaggatgtgggattcacttcttgatcatttctaaataattttccacctcctccatgcctctatgattgcaactgaaactaaattgcaacaataattagagacaatcaagtagtgtggcaacggagcaaatggacaggttcaggcaaagttcttttctttagaagcccactctgaagactttcatcttggagaggagagcaggaaaggtgtggaacaataacaggaaagcagactcgaccagactcgacacggctctcaagttgaagtcttccaccggtccagcacaatacacagagatgtttcatccctttcatctctcctgttccaaa

SEQ ID NO: 158739 - DNA, 3527 bp, Homo sapiens
gggggatttggggctgggtcggccggggtcggggaggggggtggtgaaaaggtgacagggagctgccctcgctcaagagccggtggttgggggtctgagaagaagtcaccaatatgaagttattcggcttcgggagccgcaggggccagacggcccagggctccatagaccacgtctacacgggttccggataccgaatccgggactccgaactgcagaagatccacagggcagctgtcaaaggcgacgccgcggaggtggagcgctgcttggcgcgcaggagcggagacctggacgccctggacaagcagcacagaactgctctacacttggcctgtgccagtggccatgtgcaagtggtcactctcctggttaacagaaaatgccagattgatgtctgtgacaaagaaaacagaacgcctttgatacaggctgtccattgccaggaagaggcttgtgccgttattctgctggaacatggcgccaatccaaactttaaggatatctacggcaacactgctctccattatgccgtgtatagtgagagcacctcactggcagaaaaactgctttcccatggtgcacatattgaagcactggacaaggacaataataccccacttttatttgctataatttgcaagaaagagaaaatggtggaatttttattgaaaaagaaagcaagttcacatgccgttgataggctgagacggtcagctctcatgcttgctgtatactatgactcaccaggtattgtcaatatccttcttaagcaaaatattgatgtcttcgctcaagacatgtgtggacgagatgcagaagattatgctatttctcatcatttgacaaaaattcaacaacaaattttggaacataaaaagaagatacttaaaaaggagaaatcagatgttggaagttctgatgaatctgcagtcagcattttccatgaactgcgtgtggattcattgcctgcatcggatgacaaagacttgaatgttgctactaagcagtgtgtccccgagaaagtgtcagagcctttacctggatcttcgcatgaaaaaggaaacagaatagtcaatggacaaggagaagggcctcctgcaaaacatccttccttgaagcctagcactgaagtggaagatcctgctgtgaaaggagcagtacaaagaaagaatgtacagacattgagagcagaacaagccttaccagtggcttcagaggaagagcaagaaaggcatgaaagaagtgaaaagaagcaaccacaggtcaaagaaggaaataatacaaacaaaagtgaaaaaatacaactttcagaaaatatatgtgatagtacatcttctgctgctgctggcagattaacccaacaaagaaagattgggaaaacgtatcctcagcaatttcccaagaagctgaaggaagagcatgatagatgcaccttaaaacaagaaaatgaagaaaaaacaaatgttaatatgctgtacaaaaaaaatagagaagaattagaaaggaaagagaaacaatataagaaagaagttgaagcaaaacaacttgaaccaactgttcagtcactagagatgaaatcaaagactgcaagaaatactccaaatcgggattttcataatcatgaagaaatgaaaggtctgatggatgaaaattgcattttgaaggcagatattgctatactcagacaggaaatatgtacaatgaaaaatgacaacttggaaaaagaaaataaatatcttaaggacattaaaattgttaaagaaacaaatgctgcccttgaaaagtatataaaactcaatgaggaaatgataacagaaacagcattccggtatcaacaagagcttaatgatctcaaggctgagaatacaaggctcaatgccgaactgttgaaggaaaaagaaagcaagaaaagactggaagctgacattgaatcttatcagtctagactggctgctgctataagcaaacacagtgaaagtgtgaaaacagaaagaaacctaaaacttgctttagagagaacacgagatgtttctgtacaagtagaaatgagttctgctatttccaaagtaaaagctgagaatgagtttcttactgaacaactttctgaaacacaaattaaattcaatgccttaaaagataagttctgtaagacaagagatagtctcagaaaaaagtcattggctttagaaactgtacaaaacgacctaagccaaacacagcagcaaacacaggaaatgaaagagatgtatcaaaatgcagaagctaaagtgaataattccactggaaagtggaactgtgtagaagagaggatatgtcacctccaacgtgaaaatgcgtggcttgtacagcaactagatgacgttcatcagaaagaggatcataaagagatagtaactaatatccaaagaggctttattgagagtgaaaagaaagacctcgtgctagaagagaaaagtaagaagctaatgaatgaatgtgatcatttaaaagaaagtctctttcagtatgagagagagaaaacaggaggagtagtaagtatcaaggaagataaatattttcaaacttctagaaagacaatttaaacatttggttctggatacatgttgaacttagttgaatataaaaatctagattaaaagtgtgtttaccatactgtataattccatttacatgaagcatccagaaaagataaatgtatagggacaaaaagtagattcatgtttgcaaggggctggggctggaagctggtagtgactgctaatgggcatgaggaatcttacagtgatggaaatgctctaaagttggattgtagagatggctgcacaactcagtaaatgtactaaaaatcttttaactttaagttaaaacagatacattctatagtatgtaaattatatttcaacaaagctgttttaataaaaaaaggaaaaatgtgtttactatatcggcttagaaacatgcctcatttctaggaaataaaagatagaggtgagagatgatttactttgagaaaagacattgtgtcacctatgaaattttattaggcacagagtcatattttaaggtagatagttctgtattgctgaaatagtaattttaatgtctttatgttgccacatgttaagaccataatgtagttataaatggaaatgtttacacctgaagtgagtattttcaaattaaaatttaattaagtgattttcttcgacacttaattctagattccccagatgaattgaagtgtattgctgtgtcttgtaataccttgctttaactagctttttatgtattttagttggtatagctttgttattattcatattaacaaatctgaaaatatgtcaaattacatgtttttatgaccatgtaatgttttaaaggcacctacttgttataaaatcataatttaggataaatgtggtaaaacttagcaaaactatatttggtttagttttcccattggtatttatagtttactttgaatatttatattaataattagctcataatttttaaaaaaaaaa

SEQ ID NO: 158740 - DNA, 987 bp, Homo sapiens
gggggatttggggctgggtcggccggggtcggggaggggggtggtgaaaaggtgacagggagctgccctcgctcaagagccggtggttgggggtctgagaagaagtcaccaatatgaagttattcggcttcgggagccgcaggggccagacggcccagggctccatagaccacgtctacacgggttccggataccgaatccgggactccgaactgcagaagatccacagggcagctgtcaaaggcgacgccgcggaggtggagcgctgcttggcgcgcaggagcggagacctggacgccctggacaagcagcacagaactgctctacacttggcctgtgccagtggccatgtgcaagtggtcactctcctggttaacagaaaatgccagattgatgtctgtgacaaagaaaacagaacgcctttgatacaggctgtccattgccaggaagaggcttgtgccgttattctgctggaacatggcgccaatccaaactttaaggatatctacggcaacactgctctccattatgccgtgtatagtgagagcacctcactggcagaaaaactgctttcccatggtgcacatattgaagcactggacaaggacaataataccccacttttatttgctataatttgcaagaaagagaaaatggtggaatttttattgaaaaagaaagcaagttcacatgccgttgataggctgagacggtcagctctcatgcttgctgtatactatgactcaccaggtattgtcaatatccttcttaagcaaaatattgatgtcttcgctcaagacatgtgtggacgagatgcagaagattatgctatttctcatcatttgacaaagtaagtgtttatgttaaaaggccagttaatgctaaattgaagtttaaaataattgcaactactccatcttatacattaggtgagagttcatagtttggttcagatagtttgaaatagcgaagagttagtctaccttt

SEQ ID NO: 158741 - DNA, 549 bp, Homo sapiens
ccatctgtgcttctggtcatctaccctcctattttttttagaagggagggtgctaggtccattttctggtaaactagtggggttcgccccctgaaggaagcaccatgccttctgtgcgaaaaaatagaggattttccacactctggggttagagggaaaagccctagagaggcaggagttagagctaaggcggccagagtacgtgcagcccagcgagggcccctttggacccagccgtggagattctgaaagtgtgctggggagggtgcgaaggttggaaggttcgggtcgctgagtacctggagctcaggcctaggaagagagggcactgtcaggacagggcagaaagctctgaaaggagtaagccacggcgggactccagaagaggcaggacggcagaactccaaacatcttctcttcctatggcgccagcagctctagagcaggggtccaggtggagccccgcccccggcaacctcacaggagtgtgctcttcctacctagccccaccggccccgactttccacggtcgggaaggccagcggccgc

SEQ ID NO: 158742 - DNA, 336 bp, Homo sapiens
aatctctcttgtcttggaaatcaagttgcccacgtgtgttttcccactgcaaaacttctaccctagtttcctcctccttttggggatgatgatgatctcagcattgcttactataaagggattctatgaagatcaggtaagtaagtcagtgtttatgaaaacacattgtaagccaggcacagctatgcaagcctttagtcccagctacttgggaggctgaggtgggaggatcacttgagcccaggcatcaggcatttgaggctgtagtgtgcaatgttagcaccatgactaggcactggactccagcctggggaatgtagtgagaccctgtctctt

SEQ ID NO: 158743 - DNA, 220 bp, Homo sapiens
ctagaaaatctgaacatactgtgtttatgaatctaaagtataagattcccacaatagtgtgcaccagatgggatttagccttttctctgcagcacatgaaaagcaagaaaaattgttgaacaggttttcctttcctttgactaatatcctgattccccaatcggcacaggcacatttctggtacttgcaaccaatacaaaccctcagtgacaagtcacct

SEQ ID NO: 158744 - DNA, 262 bp, Homo sapiens
catcttctcaggtcggtgctggggatatccacagcagctcagctgcaccttgtgccatggactttctctgtcttttctgtcttgctccccaatttctttcatggctatttcccctaataaatcctggcacatttaattctgtattgcagtctgctcctcaggggatgctaaccaacacaagtggcttcaggagtggtccatagacacagacaaaaacggggattggggctgagcttgcccactgcctggcaggccgagaatg

SEQ ID NO: 158745 - DNA, 469 bp, Homo sapiens
ttcgtaactactctccctgttctagttctgttcttttccaatctgttttcttctctgtaaccaacaaaaagtttcccaaaaagtcaatcttccctcgcagtgttgaacatcttctttatttgggcttttataatatattgcattttacctttcttacaattggcataattttattcacatgtctgcctctctgtcacactagacaaatatttgttgacctttactgtgtactgggtactgatcttttgctgctgattcagtggtgaaaaaaatatattgagtccctacctttgatggacctatagtctaggggggagaacacagtaaacacatgagtgcagaattttaggtactgataaatgctcttaatagtgtaaaatcaggtatgtgaaaaagagtggggggggggaattgtcagagaaagcttctcttaagtagtagtgtttaattgataccgaggaggcaccat

SEQ ID NO: 158746 - DNA, 427 bp, Homo sapiens
ctcaataattccactcctaggtatctaacagaaatgaaaacatttgcacacaaaagttgtacatgaaagagtacagctgcattcataatagcaaaaacaaaaacaaaaaaatccccaaatgtctaccaaataataaataaaatgtggtatatccatacaagggaatgttgttcaactataaaaaggaatgaagtatacgctatactaaggataagctgtgaagacatgctaagtgaaagatgccagacaaaaggcctaagtgataattcatttatacaaactgtgcataatagggacatctagagacagaaagtagattagtggttgcccagtgctggggaagtaggtgtgagggtgaccattaatagatatagggttttttgggggtgataaaatgttctaaatttaaattgtggtgatagttcca

SEQ ID NO: 158747 - DNA, 409 bp, Homo sapiens
gacatgtgttgaattccagcaacactaccttacactaccaacactaccttactagctgaactttacctaacttagaattctgagggtgttctcacctataaatgggaataataatacctatcgtatggggtattgttaggcttcagacagtataaatgaggtgcttggtatggtgccaggttcatcacaagcactcaatatttttctttctacaatatcacttctatggctgaagagtatcccatctcatggggatgtgccatgattcacttacccagtctcatactgttattgatatcttcaattttgtcaataatataaacaacagcaaatttttttcacacatttctgtttatttctttagggtgaaaccctataagtgagatgctggatcaaaggatatgagcat

SEQ ID NO: 158748 - DNA, 419 bp, Homo sapiens
gttgagttgtaagaatgctttatataatctgaatataagtcccttatcagatatatgatttgcaattattttctcccattctgtggactgtctttttcactctctgggttctttgaagcacaaaaattttaaattgtgatgaagtctaatttatcttttttcctttgtcactggtgcttttggtgtcttttataaaaaggcttcacctaatccaaggtcataaagatttacttgttagttttcttccaagagttttatagttttagctcttacatttaggtttgagttaacaacggggttcaaattcattcttttgaatttggatattcagttattcctgtaccatttactgaaaagactttttcccttattatcttgggacccttctgaaaaatcaattaaccataaatgtaatggcg

SEQ ID NO: 158749 - DNA, 344 bp, Homo sapiens
tctcacacacagtcacactcacagtcctcagtccccctcctccatctctgcagttggtgaaggctgtgtgtcagagcagtctccaagctcatccacagcagccaaccctccagtgagcagaggccaaaagcatgtgctaggtctgggagttgaggcacagtgaacctttgactgtgactccggttgcatcggaggggtcagccacgtggtttctctcagtgcccgagagcatctttgttttggctggcttgtaacgtcagtggaaatcggaaacctcgccctggcctgatgacggctgcagtttcccttcaccttctagccctgcctaactttcctgggctctg

SEQ ID NO: 158750 - DNA, 362 bp, Homo sapiens
accaggtgtcgtccaaatgccaaaagcaggcagacatcaggcggccgcccttcagcacacaggtcagggttgcgatgtgtccaggccggtgcaaacgccagcctgcggaggaagaatgcagcattcaacagagtcccagcggctggacagggagcctgaaggctgggtcacctgtcacctgtcaccctgtggacctggcatcatgtgttttccacggacaccccgaatccggagcccccgggaggactccgcagaccatatgctgaggtgtgctttgcgtttctatcgtcaggtgggctgcaggcttccaggctagacagctccttaccaccagaagtccgtgcctaccagctgcctcacgc

SEQ ID NO: 158751 - DNA, 519 bp, Homo sapiens
gagagaagagtggaggcactagatagaggattaagggtattgcatttatgttggatatagtccatgaaatctgtggaattgtaataccaaattctttgctttttaccaatgatcttagtggacaataacacagatttgcatctatcagcagataaagattatagcaggaaaaatagttcccataatttcattgctatttttttccttcagtcatgatatggcattctctttcactaaaccttcatccacacacatacacataatacaaagaattctgcactttgggagtcccagaattacttgagcccaagaatttgcgaccaggctgggtaacattgagacctcgtctctacaaaaaaataagtgaagccaagcatggtggtgcatgcctgtattactagctactggggaggctgaggcaggaggatcacttgagccaaggagtgcaaagctgcaatgagtcaggattgcgccactgcactccagcttgggtgacagagtaagaccctgtctccaaaa

SEQ ID NO: 158752 - DNA, 282 bp, Homo sapiens
ttttccaggatcaaatgagatcacgagagtgcaaatgaaaggctaagtgtgctattgttattaggagattcgcattggtcccctagcctggatgagatgtgagtcagaaatctctggaaatagagcagcaaagaagacagcctccaacctagcagggctcatattgcagtgggaaatagacaacgaacaatacgtgcataatgtaatttcaggtagtcataagtgcagtgaagggaaggaagaaaggaggacagtgggggaacagggaaggttgtttttggt

SEQ ID NO: 158753 - DNA, 1126 bp, Homo sapiens
  misc_feature (771)..(771): n is a, c, g, or t
  misc_feature (1126)..(1126): n is a, c, g, or t
gacttctacacactccctgtggggatccgcactgtggctgtcaccaagagccagttcctcatcaatgggaaacctttctatttccacggtgtcaacaagcatgaggatgcggacgtgtgttggggctcctgggtccttgtcggggctgcttctggtcaccctccactttcgccttccctgtgtcctgcagttgagggcagctcagggcaatgaggcaaatggctccaaatggagagggggctcatggggtggctctccagggtcctggctctcagaggaagtgcagcttcgacagggacaggggtcacttggctctgctatctcctagatccgagggaagggcttcgactggccgctgctggtgaaggacttcaacctgcttcgctggcttggtgccaacgctttccgtaccagccactacccctatgcagaggaagtgatgcagatgtgtgaccgctatgggattgtggtcatcgatgagtgtcccggcgtgggcctggcgctgccgtgatggaagaagtggtgcgtagggacaagaaccaccccgcggtcgtgatgtggtctgtggccaacgagcctgcgtcccacctagaatctgctggctactacttgaagctccgtatgtggatgtgatctgtttgaacagctactactcttggtatcacgactacgggcacctggagttgattcagctgcagctggccacccagtttgagaactggtataagaagtatcagaagcccattattcagagcgagtatggagcagaancgattgcagggtttcaccaggatccacctctgatgttcactgaagagtaccagaaaagtctgctagagcagtaccatctgggtctggatcaaaaacgcagaaaatacgtggttgagagctcatttggaattggcgattctgactgaccgtaccgccgagtgggggataacaggggtctcactcgggacgaacaaaagggaggtccttgcggcagacacggacatgctgacaggtccatgttgacgtcaaggtggaaccgtctgcgaggatccggtctctccatgatcaggagtcgggtggaccatggtgttaacggcacggattagcggacaaggcgcgtttatggtttttcctn

SEQ ID NO: 158754 - DNA, 598 bp, Homo sapiens
cgggggcgtcaccgtgaccctctgtcccttccctcctggcccgcaggcagttcttcaacaacgtttctctgcatcaccacatgcaggtgatggaagaagtggtgcgtagggacaagaaccaccccgcggtcgtgatgtggtctgtggccaacgagcctgcgtcccacctagaatctgctggctactacttgaagtgagtgctccctccctgccctcggctagagtgggaaggagaccctggcaggtggctggcctcggtgggcatgtgctgttcaagatcggcctcgtgtccagcccaatgggaaggccgtccatacccagatagttcaggggaccaaatatctacccacccaaattgtggttttcttttttgttctttttttttctttttgagatggagtctcactatatggcccaggctggagtgcagtggggtgatctccgctcattacaacctctgcctcctgggttcaagtgattctcctgcctcagtctcctgagtagctaggattacaggctctggccaccatgcctggctaatttttgtacttttagtagagagggggttttctgcatcactgggttctctgcatcgtct

SEQ ID NO: 158755 - DNA, 1037 bp, Homo sapiens
  misc_feature (682)..(682): n is a, c, g, or t
  misc_feature (1037)..(1037): n is a, c, g, or t
gacttctacacactccctgtggggatccgcactgtggctgtcaccaagagccagttcctcatcaatgggaaacctttctatttccacggtgtcaacaagcatgaggatgcggacatccgagggaagggcttcgactggccgctgctggtgaaggacttcaacctgcttcgctggcttggtgccaacgctttccgtaccagccactacccctatgcagaggaagtgatgcagatgtgtgaccgctatgggattgtggtcatcgatgagtgtcccggcgtgggcctggcgctgccgcagttcttcaacaacgtttctctgcatcaccacatgcaggtgatggaagaagtggtgcgtagggacaagaaccaccccgcggtcgtgatgtggtctgtggccaacgagcctgcgtcccacctagaatctgctggctactacttgaagatggtgatcgctcacaccaaatccttggacccctcccggcctgtgacctttgtgagcaactctaactatgcagcagacaagggggctccgtatgtggatgtgatctgtttgaacagctactactcttggtatcacgactacgggcacctggagttgattcagctgcagctggccacccagtttgagaactggtataagaagtatcagaagcccattattcagagcgagtatggagcagaancgattgcagggtttcaccaggatccacctctgatgttcactgaagagtaccagaaaagtctgctagagcagtaccatctgggtctggatcaaaaacgcagaaaatacgtggttgagagctcatttggaattggcgattctgactgaccgtaccgccgagtgggggataacaggggtctcactcgggacgaacaaaagggaggtccttgcggcagacacggacatgctgacaggtccatgttgacgtcaaggtggaaccgtctgcgaggatccggtctctccatgatcaggagtcgggtggaccatggtgttaacggcacggattagcggacaaggcgcgtttatggtttttcctn

SEQ ID NO: 158756 - DNA, 1295 bp, Homo sapiens
  misc_feature (940)..(940): n is a, c, g, or t
  misc_feature (1295)..(1295): n is a, c, g, or t
gacttctacacactccctgtggggatccgcactgtggctgtcaccaagagccagttcctcatcaatgggaaacctttctatttccacggtgtcaacaagcatgaggatgcggacgtgtgttggggctcctgggtccttgtcggggctgcttctggtcaccctccactttcgccttccctgtgtcctgcagttgagggcagctcagggcaatgaggcaaatggctccaaatggagagggggctcatggggtggctctccagggtcctggctctcagaggaagtgcagcttcgacagggacaggggtcacttggctctgctatctcctagatccgagggaagggcttcgactggccgctgctggtgaaggacttcaacctgcttcgctggcttggtgccaacgctttccgtaccagccactacccctatgcagaggaagtgatgcagatgtgtgaccgctatgggattgtggtcatcgatgagtgtcccggcgtgggcctggcgctgccgcagttcttcaacaacgtttctctgcatcaccacatgcaggtgatggaagaagtggtgcgtagggacaagaaccaccccgcggtcgtgatgtggtctgtggccaacgagcctgcgtcccacctagaatctgctggctactacttgaagatggtgatcgctcacacctagaatctgctggctactacttgaagatggtgatcgctcacaccaaatccttggacccctcccggcctgtgacctttgtgagcaactctaactatgcagcagacaagggggctccgtatgtggatgtgatctgtttgaacagctactactcttggtatcacgactacgggcacctggagttgattcagctgcagctggccacccagtttgagaactggtataagaagtatcagaagcccattattcagagcgagtatggagcagaancgattgcagggtttcaccaggatccacctctgatgttcactgaagagtaccagaaaagtctgctagagcagtaccatctgggtctggatcaaaaacgcagaaaatacgtggttgagagctcatttggaattggcgattctgactgaccgtaccgccgagtgggggataacaggggtctcactcgggacgaacaaaagggaggtccttgcggcagacacggacatgctgacaggtccatgttgacgtcaaggtggaaccgtctgcgaggatccggtctctccatgatcaggagtcgggtggaccatggtgttaacggcacggattagcggacaaggcgcgtttatggtttttcctn

SEQ ID NO: 158757 - DNA, 139 bp, Homo sapiens
tgctgggattacagacgtgagccaccgtgcccagccttggctgtttgtgtatcttttttggaaacattcagatttatgatttgcagatatttccttccattccatgggctgtcttttcattttcttaatgggtatcctt

SEQ ID NO: 158758 - DNA, 206 bp, Homo sapiens
gcttgcctgtaacagcagccttcggtgtcccacccttcctgtgaggaaactgtggtgcagcagggctttctacactcaattccctggcagatctccagggatccggagtacccactctcctgcattaggagtttaggctatgagtatcaactctgtgagcttctctgcccatgcagagaacttggggctgaggaggtttcccagtt

SEQ ID NO: 158759 - DNA, 464 bp, Homo sapiens
ctcctactcttgtaatcattaggaggtcaggctgctgccctgctgcatacgccatcagagctcacaaaatggctggaagtttatccgggcacttgacaaactgcatttacttcatcaggccactaggtgatgaacaactcacaaacccagactgccagggactgtggtgtacagggcagtttctgtttatacttggaaaggccattcgaagtcatctggtccaaactcattaggaggtcaggctgaccccctaaaaatctggcaatcaccaatctatatactgataatatttggcacctattctagataattacatatcaatggaatcatatcatacatagtctgtagtgactagctttctttcacttagcacgtatactaggattacccaaatagtagcatgtattacttcatctcgtataatttaattaaatagtggcgaaatacacacaacataatcttaa

SEQ ID NO: 158760 - DNA, 565 bp, Homo sapiens
ccgcctcctgagttcaaactattctcctgccttagcctcccaagcagttgggaccacagccacacaccaccatactgggctaattttttgtatttttagtagagatggggtttcaccatgttggccaggctggtctcccaactcctgatctcaagtgatccacctgccttagcctctcaaggtgctgggactacaggtgtgacccaccgcgcccggcctggaatcactttttggctcgtctggtctggttttcagagcaggagcctcagaacctcctagccaggagtgcacttacaaagttcctggtacaagccccacccacagcaaggccgcggagatgcaagctccattcccgccgcttctctggacagtggaaaactagagacaaatctagagagggttgcccagaccaaggtaaagcaaagaagggcctccaggcagagccgcgcagtgcagttgcggggaggcggccacgggcgagcccacgccctggaaggacagagcagagaaaccgggtggggaggtcctcccaggtcagtccatgcaggggcctgtcagtgctggg

SEQ ID NO: 158761 - DNA, 534 bp, Homo sapiens
gcctttcctatctgctccagaattaggggaatagcctactgaagtttagcattgggccaggagtaggaacaggggatgtggtccttttctgttcagtcttgagggttcacagtgcctgcttatggaggctcgatgtggctcttgcctggaaacctcaaacacatggggactaacccttggaaagggcttgccactgtgcagatggggctttatgattggaacagaaggcaaactccaacgcatctgatgggaccatggtgccccatcacttcagcatgtgttttgtcccacaagacaaagttcctttcttcttccctttaacttctctttttttttgagctccatgtgtcactgaggcagctcttgggttcctgttgtggtctctcaatgagtcacatgccatttggacatggcagcttccctaagtacatcgtggacaaggcatctcacttccctaagcctcagttttctcacttggtgatcccagtgatcctttttaggtctaaagtctgtggcaatgattttcaaacccat

SEQ ID NO: 158762 - DNA, 448 bp, Homo sapiens
tgtacgcaaaaagcatgtgctcaaatagcttaacgctaagtgtgtagggcagaaactccttatactagcccactctaagtataaccccaaactcaccaaagcaaatgggctgaacttggggaaaaatatgcaaattcatggatttcctggctagtgctactattttgagaaacagacacgtacacacctctaccttccaactccacaagaattactccatgggccaggcatggtggttcatgcctataatcccagcactttgggagacccaggcgagtggatggtttgaggcccagagttcaagaccagcctgggcaaaggagtgagacctcatctcttaaaacaaaaagaaaccacttctgtatttgtactgattttttcatctgcttaatccaccagtaattgagagaaatatgttaatctcccatgatcatggtgaatttcctgt

SEQ ID NO: 158763 - DNA, 176 bp, Homo sapiens
tctctgaagcctcacccacccacactggcactgccctctagcatcgagggaccttagatacagtgtgtactgtggtggtcaaaccagcttctcccaagaacagctcatataagagtacacctcaaactttaattagactttaccttccccagaggactacttccatcctaatagag

SEQ ID NO: 158764 - DNA, 616 bp, Homo sapiens
caggcgactctagaggaccccgcgacactcttggtgcttccatatcttgttattgtgaatagtgctgcaaagaacttgggagtgcagatagctcttccgaatactgatttcctttgcacattactcggaagataaatttttttgagacagagtctcactctgtcgcccaggctggggtgaaatagtgcaatctccttgcaaccttcactttctagattcaagtgatcctcctgcctcagcctccgaaagtgctgggattacaggaatgagccaccatgctcagcctcttctcttcttaattagttgtggcaggtaaggattctcttatgtgctaacaacaacaaaaatgttctgtctgctgcaaccccagctgtaatctcccctaaccagaaaggtgtacatttttcagttgtatgagcgaatctcttctctttgaaaaaaaaggagcacctgtctttactccattggattaatcatccaccctcccacttcaggcctcacctctatcagaaaggaagatgaaaatccctacacaagctaacataaacaataataatagtcaccatttcacagaacaataaattcagggttagggaagctctagcggttaattcag

SEQ ID NO: 158765 - DNA, 385 bp, Homo sapiens
  misc_feature (320)..(320): n is a, c, g, or t
  misc_feature (363)..(363): n is a, c, g, or t
ccatgactaaaaggggccaagttacagcttgggctgttgcttcagagggtggaagcctcaagccttggcaacttccatttggtgttgagcctgtgggtgcacagaagtcaagaattgaggtttgggaacctccacctagatttcagaagatgtatggaaatacctagatacccagggagaataattgacttggggaccatcagggatgtgttggggccctgccactgtggagggtggagctgccttctatggtagtagcttagactggtgggtggggaacacacgctctgctcacatctcagctccctgtttggtgtgtncaggtacaatcagtagtgggcaagtgcggggcattccccaggncctgggcaagaataatttactt

SEQ ID NO: 158766 - DNA, 235 bp, Homo sapiens
tcagttattttcctgttgaccccagaatttgttatattttttaaaacaatttcaaaatagtttctgtttgtgtctggttcaaatcgagatgtgcatgctttctagtctttattatttattggaaacctttggtacctaatgcagaggtttgattgtttcagtgtgtacccggtaaagatgtcagtgaccttttaccgtaacatcaaagtgtagtttaaccagttagtctattttt

SEQ ID NO: 158767 - DNA, 637 bp, Homo sapiens
ctgggattccagacggggaatgatgactcagagtaaggtgcataacaggttctccagttgctcatcttctgaattcgttcattcatttattcattcattccccagacattgagcatgcagatggaaaggcagaggttcaaattcagctctgccatgtactgtgtaatctcagcaggttatttaacctctctgagtctttgtttcttcagctgtaaaatgggtacaatctctatttttaagagttgtgaggatttgatgagaagttatggagataggattgccagatttagcaaataaagacaggacagcaattaaatttgaatgtcagataaatgaggaattttattttagtatgtcccaagtattgcatgtttatctgatattcaactttaactgtgcatcctatattttaactgcaactctacccagggataaggattaatttaaaaaatgcctttcttggaggagcacaggctaatcaaacactgaagggcaatttgactgatggcagaggcacagacagagtgctgtggaaacatagacatctccatttgagctcctaagaatccagacccatgcttgctgatttctagcaggcttgtcaaataccccggtgactgtgagattgacaatgcga

SEQ ID NO: 158768 - DNA, 337 bp, Homo sapiens
tactaaattcgcggccgcgtcgaccattcaataagctgtggaccaggcactgcatctgaaaccttcacagccagcgagactgatggaattacaggcgtctgaaacctccatgcatgctaattccaagtccaaaacccagaggctcccagctggaactctaagagaacagtaagctccatgaaccaatgacaaacttactagaagggaccaagcaactcacagggaattatttggttaattggggtccaagactgagaaatgtgccttccaatgatacggcgtggctttctgacagctctgcaaaacaacaagcagaggggtccactgggtcgtggcc

SEQ ID NO: 158769 - DNA, 385 bp, Homo sapiens
atttctttttctttcccatccaacccccatttcctagtcttcagtttcttaatttctctaccttttactcttatgctcttgttttgacctttgagtttctctgaaacttatcagaaaagttaggacaagatagtctgacccaattcttgagccattttcttaggtagtaaatatgtcagaaaaatgaaagctgtttggagttgataaggaaatggaagataatgtttttctttgagggggacataaagaatggtgatagggaaagaaccaatgactaagtaaaatgactgagaatcttgcacgaggcagatgtgtgagcttcgcgaagcaagttgactgaatgaaaaacaactttgggtagggaaaacgttgccgggggcattcg

SEQ ID NO: 158770 - DNA, 732 bp, Homo sapiens
cgctttatacttctaaacgctttatacttctcaacgctgtatacttctcaacgctttatacttctcaacgctttatacttctcaatgctttatacttctcaacgctttatacttcctcaacgctttatactcctcaacgctttatacttctcaacgctttatacttctcaacgctttatacctctcaacgctttatacttctcaacgctttatacttcctagcagtgaacaaatttccacagtcagtatgtagattcacttttctccaccctcagctctcccctcaacgctttatacttccgaggaagtcagagaagggggaacacaacgctttatacttccgaggaagtcagagaagggggaaggaatcacttttgaccattagctccacgggaaaatggggaaagggcattatcttgttcactccagcatctagcatagaatccagcaaataatcagtgcccagtaaaaatgtatggaatgaataaatggatgagtgaatgaggggatgattgaacaatgtctaaggcagaagtataaagcgttgaggtgtacaaactattaggaaaaatgtggcgccattaaacccagaaaatatgtccttctgtaacagacagctgtctcctctgtagtttaagtgtgctttctgcttagctcatgctccgtgagtcatggaatcaatacaggaagcacacagagccagccacactgcagattccgaggagggtctag

SEQ ID NO: 158771 - DNA, 556 bp, Homo sapiens
cagtttatgcctccaaacacagggaaaagtggaggctacacttcattcatcctgggcttcacactaagtcccaaattcggatacaagagcatcttctagaaaacccctcaacgctttatacttccgaggaagtcagagaagggggaacacaacgctttatacttccgaggaagtcagagaagggggaaggaatcacttttgaccattagctccacgggaaaatggggaaagggcattatcttgttcactccagcatctagcatagaatccagcaaataatcagtgcccagtaaaaatgtatggaatgaataaatggatgagtgaatgaggggatgattgaacaatgtctaaggcagaagtataaagcgttgaggtgtacaaactattaggaaaaatgtggcgccattaaacccagaaaatatgtccttctgtaacagacagctgtctcctctgtagtttaagtgtgctttctgcttagctcatgctccgtgagtcatggaatcaatacaggaagcacacagagccagccacactgcagattccgaggagggtctag

SEQ ID NO: 158772 - DNA, 661 bp, Homo sapiens
cgctttatacttctaaacgctttatacttctcaacgctgtatacttctcaacgctttatacttctcaacgctttatacttctcaatgctttatacttctcaacgctttatacttcctcaacgctttatactcctcaacgctttatacttctcaacgctttatacttctcaacgctttatacctctcaacgctttatacttctcaacgctttctcaacgctttatacttccgaggaagtcagagaagggggaacacaacgctttatacttccgaggaagtcagagaagggggaaggaatcacttttgaccattagctccacgggaaaatggggaaagggcattatcttgttcactccagcatctagcatagaatccagcaaataatcagtgcccagtaaaaatgtatggaatgaataaatggatgagtgaatgaggggatgattgaacaatgtctaaggcagaagtataaagcgttgaggtgtacaaactattaggaaaaatgtggcgccattaaacccagaaaatatgtccttctgtaacagacagctgtctcctctgtagtttaagtgtgctttctgcttagctcatgctccgtgagtcatggaatcaatacaggaagcacacagagccagccacactgcagattccgaggagggtctag

SEQ ID NO: 158773 - DNA, 291 bp, Homo sapiens
agctataaggtaaagtgagctactggagtggaagaagatatagcagataaaaacacattgtgttcctaaggtgtgaataaattttttttcttttccttcactaataagcatcattcagtgatttcattcagaaaagtatattgaacaaaggcagcatgttagctttggggaggggaagagaggatgcaaagatgactaacacacagtccttgcaaccaagctatctaaaatcctctggagaatatgaaagaacagaccaagctgggcaacagagtgggactctgtctctta

SEQ ID NO: 158774 - DNA, 442 bp, Homo sapiens
ctggcggagttaaagtcggggagttaccatcacacaggttgcatctcatgccatgagcctggatggactcacccagggagaagatatagatgcacaaggaccatggaccaagcctggggcccccaacatcaggagaccagggaggtgggacgaaaaccaaagcctggcagggtgggcgaggtgggtgcagggacctggcccattccctcttggggctttggtttccccatctgtaaccatttaccccattttgccctggaagccaagacaactgactaggctggaagcagacaggttggggaagcaagggtgcactccatttagttaggaagtgaggcctttgtctgggatgggagtttaaagtgttttttcccccagtttgtcatttggctttgtttatggtgttttattcttataaaaattagtgtttatgcctgacttg

SEQ ID NO: 158775 - DNA, 760 bp, Homo sapiens
taatgaaacctctgttatagaaccaatatagccaatcacagtttccatacatgcaaggtgaatatagcccagagcatgaggtaactgccgactgcttaagaacagcagggttacacagatggaaattcatggtgatgttgggggaattatgtttaaatcaaacataatataatagccaccacccagtagtagtgagcgatttttcttttgagttttgttttttccattctgagtgtcactatgatgcatagagttgtttttatttagtttttaaactaatgaactcattagtttaaaaatgattttttacattctgtcccagtctcaggttgaacattgtttgtcctagagtctggaatcagccacttatgcaaataaccctgattacttttggtcagaaatgatatttagagatcagaatatgatgccagtagtacaagggatgccgttgctttagttcagtggacagtagtagaaaaatattatttcactgaatctaagatgtggtcaattatagttatatgtgttactaggaaagaaaaaaacagtgccaattaattttaagaccccagctaatgcaagatgcatctttatttcagatatgttaggatacaaatagaatacaaaatgcgcatatgctatggcatatgtcatacaaaatgatgagttcgtatatattttaaactgaaacttaacactacagaatttttacttaagattaaatttttacatataattttctccttcagtgaatgtctgt

SEQ ID NO: 158776 - DNA, 343 bp, Homo sapiens
cagagtctcctgtgcctctaatattttctcacctagagtaagcttttcccaattccaaaccttacaacactcaagctgattattctgagaatcaagcaatgccaagggcccaatatttttctttcaccttctcaaggggatcattttatacttctgatgtgaacaggggattagtctcgagtctccctttagagagaacatagagtcctttttcttaacacattccaagccgtgactcacagaaataagcaggatgggccgggcacggtggctcatgcctgtaatcccagctaattttggtatttttgtagagatggggtttcaccacgttgcccaggctcat

SEQ ID NO: 158777 - DNA, 171 bp, Homo sapiens
gtgatcgatgcttggtatattagatgcttctgaccaagatcttaaatctagattgagtgaagcaaagacaatggaatggttagagttgatttgctgtcattgcagccctgtcctggcaagtctttcactaaaagacatgcattctgcttcttaacagagcctccttgagtt

SEQ ID NO: 158778 - DNA, 379 bp, Homo sapiens
tagctaaaaaccattgatttagccccaggtcttacctattagctccatcctggctatatgttagtagtgtctgggaaggcttaaaaattacaaagcctgggccgggcgctgtggctcatgcctgtaattccagcactttgggaggctgagccgggtggataacaaggtcaggagattgagaccatcctggctaacacagtgaaaccctgtctctactaaaaatacaaaaaattagctgggtgtggtggcaggcgcctgtagtcccagctactcaggaggctgaggcaggagaattgtttgaacctgggaggcagagcctgcagtgagctgagatcatgccgctgcactccagtctgggcaacagagtgagacttgtctc

SEQ ID NO: 158779 - DNA, 266 bp, Homo sapiens
cttcttacctctaccacatatcttcttcaatggttcctctccttcctcctccagtggatgctccttgagtatctgttctctatgttcacttttagtactattttcatggctcaatacgtacttccagactcccttcctcacctacattccaactctaagaatctaagcaccagctccatatctcaacacgtccgaaccaaagttatcctcacctcaataccagaccactattcacttcagttttgtttttttgagacaggtcttac

SEQ ID NO: 158780 - DNA, 360 bp, Homo sapiens
atagaatgcatgtaagggcacacttcttttgttttacagaagggatcaagttctgttcaggaagatttgaaacatagtgtaaagttgttgctgttttaaacttgtaaacctgattcttctcatgtgggaggtacgtaagtaggcctctcagatttcaggttggttctctgcctggtagatacaagggcaaaactattctggaaccatattgatgttaaaaaaattttttacggacttcctgccggcaaggatttttttaaaagattttttaaatgtgtctaagaaatgttttaatttgtcttctgattatacagtgatttacaattcatgcttcttttatatgtgggcaaaattaagaac

SEQ ID NO: 158781 - DNA, 172 bp, Homo sapiens
ggaattggaggctgcagtgagctatgattatgccactgcattccagcctcggcaacagcaagaccctgtctctaaaaacaaataagtaaatgcaatgcttcaaactacctcttcatttatttgacctctaccacactcccagatagtctagtaaaccttattcttagggaaa

SEQ ID NO: 158782 - DNA, 512 bp, Homo sapiens
taaaatgataggaaattctgacacatgctgcaacatagattaacttgaagatattacgtgaagtgaaagaagccagatataaaagggcaagtattatacaattctacttatatgtgatacctagagtagtcaaagtaatggagacagaaagtattaatggtggttgtctggggctggggaaggggggatggagaatgattatttaatggatatagagtttcagtttgggttcattaaaaagttctggagataggccaggcgcagtggcttatgcctgtaatcccagcactttgagaggctgaggcgggcaggtcatgaggtcaggagttcgagatcagcctgaccaacatgatgaaaccccgtctctactaaaaatacaaaaattagccaggtgtggtgacgcgcacctgtaatcccagctactgaggaggctgaggcaggagaatcccttgaaccagggaggcggaggttgcactgagccgagatcatgctactgcactccagcctgggtg

SEQ ID NO: 158783 - DNA, 535 bp, Homo sapiens
ctcccagtcttggcccactaacagctttacaaccaaaacctggagcttgccccgcctaactgtgacccacagctcactaaccttggtgcgcacaacagccacatcttgaatatctgcaccctgaaccactccctagatttcaagaccggcacgttcatctgcccacttaacgcctccatttagtaggctctgaaagatctgactcttagcatggcataaacaaacctgatatccctagtgaatattactcctattgccaatttgttcatcttagttgatgaaacttctttccctacagctgctaataccaaaaaccctggagtcttctctgaaccctctgtttcactccctcaccacctacattatgtaatttagttgtcccttttgaaaccacacatccggaatctaaccacatctcctaaatcacgatcctgggccagtaaccctcacttggactagtctaccctgattttccttcctcctccctcaaccccccagtttgtgccccactgggcacacatgatggaggggtgaa

SEQ ID NO: 158784 - DNA, 600 bp, Homo sapiens
  misc_feature (566)..(566): n is a, c, g, or t
  misc_feature (578)..(578): n is a, c, g, or t
cctagttttagaagtttcaatagcactgtgatggacacacagccagcacctgcctttacacacaatggcccaaaagggaggtggcaaagtaaccaggcatttgcaacacagtgcaatcactgcaggcccctctctacaagccccatacccaaagggaccctggattccctattagagtaaaagccacattgccagcatgagaggaaggaaatggctttctttagctctagaagagtgagacttgcacagtgccccgaagaaagatgataaaacacaatgcccttccagcacccagggtagaccctcctcaggtggtgtcaaccctttgactttcacatgttttcatcttaggctatggagcatgatttctgctattgaaacttctaaaacggggcatagttttagaagtttcaatagcatcttttacatcataagatattatttcttttgggtcgcctgatacataaatgtgggcataggggagacatccatcaatatggcaaaccaaaagttttatttccttaagcttctctttggcgaaaatagcatatcttaatactcttggngctgcgataggncaatccaatatccacatctata

SEQ ID NO: 158785 - DNA, 1268 bp, Homo sapiens
  misc_feature (1234)..(1234): n is a, c, g, or t
  misc_feature (1246)..(1246): n is a, c, g, or t
atctggttcttgttgctttggagaccacaggagaggcggtggtgatggcccatcgcttcagccctgtggcatccccacaggatccatgggcatcaagtaatttccctgtgctcctctgaagataaaccgctgcctgcaccagcctagcagcttccagaagctgtggatgagaagcaatctcccaccaaaagccagagctcacctgcaaagcttcaatcccaagcagaaggaagcctccgttttttccccccagatgagcctgaattcacctccagaaagtctcaatgcatcacaccaagggtcacacacctgctcatggttcttcttgaggcaaagcagctcctccttcagggactccagctgggcctccaggtcacacttggcgagggtgaggttgtctagcaccctgcgcaggccacagatgtcagcctccaccagctgttgcagcgagcgctctctctcgtacctgtaacagggaaagtgcaggagtgacagttagagggcaggaaggggcaccaggacatgactcccagctcgcagctgtaagtccactggcctgccctttgccatctaattgtgagttggcttatcctgtgtagtgtgctcaaagcccagaaagcaacaggatgttccccactcagtcaatactaagcacctgagatgaaccaaggggagcagctggtactgaggatactgtgatggacacacagccagcacctgcctttacacacaatggcccaaaagggaggtggcaaagtaaccaggcatttgcaacacagtgcaatcactgcaggcccctctctacaagccccatacccaaagggaccctggattccctattagagtaaaagccacattgccagcatgagaggaaggaaatggctttctttagctctagaagagtgagacttgcacagtgccccgaagaaagatgataaaacacaatgcccttccagcacccagggtagaccctcctcaggtggtgtcaaccctttgactttcacatgttttcatcttaggctatggagcatgatttctgctattgaaacttctaaaacggggcatagttttagaagtttcaatagcatcttttacatcataagatattatttcttttgggtcgcctgatacataaatgtgggcataggggagacatccatcaatatggcaaaccaaaagttttatttccttaagcttctctttggcgaaaatagcatatcttaatactcttggngctgcgataggncaatccaatatccacatctata

SEQ ID NO: 158786 - DNA, 1065 bp, Homo sapiens
atctggttcttgttgctttggagaccacaggagaggcggtggtgatggcccatcgcttcagccctgtggcatccccacaggatccatgggcatcaagtaatttccctgtgctcctctgaagataaaccgctgcctgcaccagcctagcagcttccagaagctgtggatgagaagcaatctcccaccaaaagccagagctcacctgcaaagcttcaatcccaagcagaaggaagcctccgttttttccccccagatgagcctgaattcacctccagaaagtctcaatgcatcacaccaagggtcacacacctgctcatggttcttcttgaggcaaagcagctcctccttcagggactccagctgggcctccaggtcacacttggcgagggtgaggttgtctagcaccctgcgcaggccacagatgtcagcctccaccagctgttgcagcgagcgctctctctcgtacctgtaacagggaaagtgcaggagtgacagttagagggcaggaaggggcaccaggacatgactcccagctcgcagctgtaagtccactggcctgccctttgccatctaattgtgagttggcttatcctgtgtagtgtgctcaaagcccagaaagcaacaggatgttccccactcagtcaatactaagcacctgagatgaaccaaggggagcagctggtactgaggatactgtgatggacacacagccagcacctgcctttacacacaatggcccaaaagggaggtggcaaagtaaccaggcatttgcaacacagtgcaatcactgcaggcccctctctacaagccccatacccaaagggaccctggattccctattagagtaaaagccacattgccagcatgagaggaaggaaatggctttctttagctctagaagagtgagacttgcacagtgccccgaagaaagatgataaaacacaatgcccttccagcacccataccatgcgctcatgcctgcagttcgattgcattcgttggctacagctgtttcccagaccactctcttatgatccatgtgtatattcagcgatgctacgtttg

SEQ ID NO: 158787 - DNA, 161 bp, Homo sapiens
agtgccccgaagaaagatgataaaacacaatgcccttccagcacccagggtagaccctcctcaggtggtgtcaaccctttgactttcacatgttttcatcttaggctatggagcatgatttctgctatgaattatcagcactcacaaattaatcaagctgc

SEQ ID NO: 158788 - DNA, 422 bp, Homo sapiens
aactcccactttccatcctccccagtaatttccctgtgctcctctgaagataaaccgctgcctgcaccagcctagcagcttccagaagctgtggatgagaagcaatctcccaccaaaagccagagctcacctgcaaagcttcaatcccaagcagaaggaagcctccgttttttccccccagatgagcctgaattcacctccagaaagtctcaatgcatcacaccaagggtcacacacctgctcatggttcttcttgaggcaaagcagctcctccttcagggactccagctgggcctccaggtcacacttggcgagggtgaggttgtctagcaccctgcgcaggccacagatgtcagcctccaccagctgttgcagcgagcgctctctctcgtacctgtaacagggaaagtgcaggagtgaca

SEQ ID NO: 158789 - DNA, 559 bp, Homo sapiens
actgtcggacctacttttcacaggggacactgtgggccagcaaactaaagtgatgtagcctaccagttgaatccaaaccagaccagcaaatgttccttgcatgctacagtgtatgctgtgttgttgctgtcattgggcctagatgtgggggcctggcaggaccccaggaatatttaggggcactgggcattcagcttaatacacccatctggactctgagggttgtaggaatgcctttagcagtcatctgctaaaattgtagttataaaatcattttctcctcctttaattgtttgttatccttggcttcattagtgggaaaggggttgcaaatttgatattggaggtttcagagccaggagtgaaattgaccattttgaaatttgtctgttttgttttgggtttggtgaggggcaggagggagcaagatttttattttgtttatttatgtatttatttttgtctgccgttgtcatttttaagtaacctacagccagacacttctgtagtgaaaggagaatttaagattctacaaagagtcttgggccataataaccat

SEQ ID NO: 158790 - DNA, 171 bp, Homo sapiens
tatgaacacgtgtttcctctctaatatgtgcatttgcctttctgtttacatagaacatatgttctatatgtactaggatatgtatagaacatatgttaggatatgtatagaacatatgttctgtatgttatgtactaggatagactaaaggtttagaaaacctaaaggaca

SEQ ID NO: 158791 - DNA, 231 bp, Homo sapiens
ttatgggctctggccttgattcaagttgaaatgttggcatttcctatcagtgcatgttagcatctgaggctgtatactggcctaataaatgaagtaaattcccgttctcctgcactgctaagtattccccattccaaggttctatacattgggtaatgttttacttggccctggaataatctctagggcatattataatgtttctatactgggaatattcaacatgactcc

SEQ ID NO: 158792 - DNA, 524 bp, Homo sapiens
aagcatctttaagcctattatccaatccacttctctccaatccttccataaaggtgtcatgagactttctcaaatagcttgccataatagaggaagattgactattatagctattacactttcaatctaataatatctcacacatattcgtcatggcgtttacctttgagaaactgatgcaacatgtattgtcttagaatgctgcggttcaggtcttatccacagagtctagcatagggtagcacataggggaggtgctccctgtagacacggtggtgaaaacacagtcctaatatcaactatagtcaggcctgcctcatcctcagcaccactgtgtagaaagaaaactgatatcagagaagatactgggcgagaagagagtcaaggctgcccagctgggaaacttggttatagctaacataacccttagcagaacaggcaattattgcctttttaaaatctgtgattctttcacattattctttttctcattatttcaacaatttcttctctttactataatc

SEQ ID NO: 158793 - DNA, 492 bp, Homo sapiens
ctaggtccctaaccccactccccaacctcggtccctgggatgatcccagagggcacaagaaagatcctggaaagaattcagtccctgggagttattcttagatgcagaggtatccatttctgcaaaacatgggtgcctcacccgacctggcctctgcacaggccaccagctgctctgagggattaactctcagccagttgtgttttaaatagaccctaggagaggagctgaagcattttacctcataccctaggaccttggtcaatggtaagacgtaggacaaccttgagagcagggagaagctgcattttgggctcataactccagggtgaggttagaggagggaaaagctcattccagtcctcatcaggagttagacaaagaagcaacgttctactttgttttttaaaaaaagagatatggagagaaaaaagtggcttgttcaagatcacattgttagttggtggggttaggtctgaggagaggggcaag

SEQ ID NO: 158794 - DNA, 496 bp, Homo sapiens
ctcatctgtacagtgggggcggtactatgcactgagagttgggggcacagtgagtgctcatagatgtatcactgtggttactgtggttgtttttgagactgtattgcactcacacagggtttatgctgaacttgttaggggcctccaggattcaggagacctggactcaagtagagacctggattcaagtggagacagggtttcaccatattggccaggctggtctcgagctcctgacctcaggtgatccacccgccacagcctcccaaagtgctgggattacaggcgtaagccactgcgtctggcctgatttactcaaatatctgagggctcactgtgtgccaggcacagatcacaggtgtgaacaagacaggcagggtctctgacctcagggaacttaaaaatctccacatgaagatctctgagctgccaaacagaagagcaaaagtattctatcaaatctttgttttttttccactgaggagacaaaggcact

SEQ ID NO: 158795 - DNA, 380 bp, Homo sapiens
tacaggattaaggcaaaaaacaggagttttcagttgtaatcctgggcccaggggaatgcatcagttatgatgttaaaatcaaatagtgtgaagattaatagatactgatattattttgtaaaccatcagcagcaatatgaaccccattatttaaaaaaatagtttcagataccaactttcagatctagaagagaacttaacaattatctactctaatccctcacacaggtaaaaaaccctgagattcagagaagttaaattatttgtccaggaacacagcaaacttgtggcagaattgagacaagcccccaggtgcattcccttgggctggactcccattctggaacccatttcactctaacttatggccttgttctttg

SEQ ID NO: 158796 - DNA, 506 bp, Homo sapiens
cagcagctcacatgacctggatactagctggacttggccacatatctgtctgccatataaccttttcgaatcctaatttgcacagctatacaatcatggaggaaacaaatacgcagatggcttgcgcatcaaaagtgaagatcggagccaaatccaagaaagctgctgctgaagggaaaggcagaagtggggaagacttttttcaaaaggccaagggaggcagaaagagcctcctccacaaggagtcacatgacctggattctagctggactttgccacatatctgtctgccatataacctttttgaatcctaattttcacagctatacaatcatggaggaaacaaatacgcagattgcttggccatcaaaactgaagatcggagccaaatccaagaaagctgctgctgaagggaaaggcagaagtggggaagactttttttcacaaggccaagggaggcagaaagagctcctccagaagagtcacatgacctggatctagctggg

SEQ ID NO: 158797 - DNA, 193 bp, Homo sapiens
agaggatccccggaatcaccagcggggcatggggcagaggtcaggcagagctccaagcatgttgaatgccaactgcctgatgggacccccatctgtccactgctgagaggggcacacagacccctgcgggccttgaggcacatctcccagaggtagctttgatcaagaagcagcctgttctgctgccgctggt

SEQ ID NO: 158798 - DNA, 449 bp, Homo sapiens
  misc_feature (22)..(22): n is a, c, g, or t
cgggcgttctagaggatcccgnaacggtggttcatacccccccgatacagcgacaggtatgaacaacaggcaggctaccaaaaaagcaggaaaaatccacaacacccccgatacagcgacggcactgtgttcataccctagctacctagctaagtgtatttttctcctgaaatcccttttaccactctggcctcttctataaggaccctgatctcattccagaggggtctgccctcatgacttaatcacttcccacaaggcttcactcttactactattatcttggggactaggtctcaacataggaattttgtggggacacagacattcagaccgtggcactgatgatggtttagtcatgcctagtatttttatttaactaggttggaggattatcttgtttgtgtatgaagggttgaagtatttatatgttatgtactggcaaacat

SEQ ID NO: 158799 - DNA, 523 bp, Homo sapiens
tggtgccttgacctctctgctcccagattccaaaaatgtaagaaataaatacatatttctatactacccagtttatagtattttgtgatagcagcctgaatggattaagacagcagggaatcttcaggaaccagtctcagataggaagtcatgccaagccaaccatactttaatattccctaggtttatctaaagatttggcaaatatttagtgaacacttactctgtgccagatactatgagccaaagccaccaaagacaaacaaaaaaacaacacacgtgttcctatcacttcaagatcacaatccaggacaggtgcagtggctcacgcctgtaatcccagaactttgggaggccaaggcaggtggatcacttgaggccaggagtttgagaccagcctggccaacatgttgaaacctcgtctctcctaaaaatacaaaagattagccaggtgtggtggcacgtgcctgtaataccagctactcagaggctgaggcaggtaaatgcttgatctgggaggcag

SEQ ID NO: 158800 - DNA, 238 bp, Homo sapiens
  misc_feature (189)..(189): n is a, c, g, or t
  misc_feature (191)..(191): n is a, c, g, or t
tggtgccttgacctctctgctcccagattccaaaaatgtaagaaataaatacatatttctatactacccagtttatagtattttgtgatagcagcctgaatggattaagacaatatctaaaatgagagggggtgggagggagaaaggagaaaataagcatgctgtttagaaatacagagacacgtgccngnagaaagcccgagagacagagctcctgcagcagattggacgctatact

SEQ ID NO: 158801 - DNA, 312 bp, Homo sapiens
ctggaaggaagccactcgtaagagagtacggctaaacactcgttcctcaatcttccaccgccttgtgtggaactcatttcttgcttgtccatcttcctttcccctcccaggggagttctgcatgggaaggaaagaggaagacacctggaggcaggtaacaggaaacttgtctgtagcttctttctaacttgggaagcgtacatacaggggataattttaggcgtcaacctaccatctttactacttgttattcccccagcactcagctaacccatgactgctgctgtggcctcaaatagaacaatgccgtac

SEQ ID NO: 158802 - DNA, 403 bp, Homo sapiens
ccgctccacaccatctccccagcatcctgccgcctccgtccctccacctgtcggcaatgctggctctgccccgtgctcttgaccctgtgcacgagcccagaatttctctgagggtgaggactggctaactccttgcctcgtgtttacttctagtaggcatctgacaagcttgccttcaagaaaaacaggcacactcatccacagccatagcatatcccaagctgctaaaaaatgattttgagataaaacctaccaaaggcaaaccattgaaagtttcttgaaggaaatatttaaacacctttagattacaaaccacctctctatatagtaagaaagagtcgaagaatgtgataaaaggtggtatctgcagagtaagaaggaaagtgagccgctcacaaaaatc

SEQ ID NO: 158803 - DNA, 615 bp, Homo sapiens
acagcacctctcgggggtagggggctaggagaagggtagcattaggagaaatacctaatgtagatgaccagttgatgggtgcaacaaaccaccatggcacgtgtatagctatgtaaaaacctgcatgttctgcacatgtaccccagaacttaaagtataatttttttttaaaaaagtacaattcataggctgggcgcagtggctcatgcctgtaatcccagcactttgggaggccaaggtgggcagatcactaggtcaggagatcgagaccatcctggctaacatagtgaaacccccgtctctactaaaaatacaaaaaattagccgggcgtggtggtgggcgcctgtagttccagctacccaggaatctgaggcaagagaatcacttggacctgggaggtggaggttgcagtaagcctagatcgtgccactgcactccagcctgagcgacagagtgagactccatctaaagaaaaaaaaatacaattcattacttagatattaacaatgagctgcaaaaaaagcactccccccaaaaaaagcccaattacatttagaatattcttttttagaagtcatgggagtgtgtaatacgcttttaaagttttctgttaa

SEQ ID NO: 158804 - DNA, 244 bp, Homo sapiens
gaatgagttcctccaaaagtttatgttgccatctgtccttggatatgcctattttacacaaatgataccaagcaagccctaggacactttcaataaattatacttggttgctgagttatgtaaagaaagcaaaatgctgtagtggagaagctccatacattttcttgatagacatgaaagcctcaccaaaattttccctaggacccgtggttttcatcaatctagagttatcattcatgttgat

SEQ ID NO: 158805 - DNA, 490 bp, Homo sapiens
ttaggatcttttgagcctaggagttcaagaacagcctgggcagcatagcgagaccccatctcaaaaaaacaattttttagttttgtttcctgtgggaaaatatcaggaagaaagagaaggcatgacaaatacaaatactgccttctttttttttccccctaaggaggagtttaagaaatagagaagttaactgtgagagagtagaactgtgagggagaaaacaagtggcctcacagaaaaagtttacagataattttttaacagccctttactctgaagtttgtttgatttatagaaatatagaaatatagaaatgtcacctattactgggtttgttcagaatggcactattctttgatgatagtgccatttgtataaatgtttccaaagtggttgtacatttatcttattaaattgaacagccaagtgtactagcatgacatttagttactgaatgtacttttacatggtttggggtcttttcccctgt

SEQ ID NO: 158806 - DNA, 298 bp, Homo sapiens
tagcaagtgttttggtgcctgttacagagtaaggtgctgagaaaactcataatctggttgaagatactaatgacacaccaagagtaattgaaagcaggaatatcaggttaaaacataaaaaccatgtcctacagttttctagttaataaactgtcccacactccatttaggatgtaatcagtatgcagtaactatttattaaaagactgaaatgtagtacttaacggagagttagaaagaaataatggaaacgttgtgggacttcttggaattttctgatctttgacactttggacag

SEQ ID NO: 158807 - DNA, 797 bp, Homo sapiens
  misc_feature (583)..(583): n is a, c, g, or t
  misc_feature (797)..(797): n is a, c, g, or t
tgatgtggacataatcttatctaattcttacaaccacatgtatagcagacagcatagatgccaccctgtgttagctataatgcttatttctccttgcatgctgggcactgactattttgttctctccttttttaaataaaaatgtttatttttcccattttaacaaaaaaaaaaaacaaacacaaaaaaaaaaaaggggggcgcgcgcgcctctcatcaggagagagatatcatctctctccgctgcgaagaagggggggcgcacccacagaagaaggtcttattatcggcgcgcgatatcacgcgcgcgtttttctttgttctacccagagggggcccccattatatgggggcggcgtattatataacccgcatagggcactcggggccggctcggttttaaacaacggcgtcgcggtgactctgggaaaaaaccgcgcgcgtacgcgcttggggagaatctctttttggggagaaagagagagccccccctatatatcttctctggggggacggtgggccgcccaatatctctttgtgcgacaccaacactctacccttcagccgagagacaatttttacnaggcgcgtccctcaaggcgcgaacaatctttcacacttttcgtaacacggtgtctactaagcgtgtggctcacacaccttaagcgtgtcgcatattatccctttcggcggcctgcgaagaaagtttttcggcctcaacgaggagattgttgcactcgtcaggaacaattttttttatacccgcgggactatctttgttagtataaaaagaggtn

SEQ ID NO: 158808 - DNA, 104 bp, Homo sapiens
atgatatttggttttgattctgagaaatgtatacattattatgcaaagagattcaagggacatggacattaatggtgatagatgttggctggaatcagtaattt

SEQ ID NO: 158809 - DNA, 746 bp, Homo sapiens
aggtttaattgactcatgatttcataggctctacaggaaacatgattggaggaggccccaggaaacttacaatgatggcagaaggcaaaaaggaaggaggcatgtcttacatggccggagcagggggaagagggcaaaggggagataccacacacttttcaacaaccaggtctcatgagaactcactatcacaagaacagcaaggaggaaatccacccccatgatccaatcgcctctcaccaagcccctcctccaacattggggattacaattcgacatgagatttgggtggggacacaaatctaaaccacatcaggaaggcaaaagtcttaaaagagaaattttatgtaagttttgtaataaacctcatgggccagagaagcttattacaagagttgggaaatactcattgataatattggctgttgctggagagatgtcttcacagaattatcatatctaacatttttgtggtttttgagagaaccattgcagcagttcttattatagacatatgtacatgaaggcccctctttcatggcctcccagcttcatttttttatggtttgatgtaagtgactccattttggtgctcacaacttccacatttctcccttttggttgaaatatttttctgaaagcatttcacacttaaaagatatagattggccgggcacgctggttcacacccgtaatcccagcacgttaggaggcggaggtgggtggatcacctgaggctgggagtt

SEQ ID NO: 158810 - DNA, 269 bp, Homo sapiens
gtgcaatcatttcactctttcatgaacttacatatttatgtgtttgaataaaacctatgaatactaactggctctttatttcagtaaatgagactgtggtgaggagtgaattgaaggaggaaagtgtggggcacgtaattgaaaaataagatagagcaatggattttggatgcatgtctgctagtgaatcattctgtgactctaagtacaacacttcgtgctctgattccccatctggaaaattatgataatataactatctgcaaagt

SEQ ID NO: 158811 - DNA, 295 bp, Homo sapiens
ttcatgggccccgcttctatccatgaatcccccgcatggtggcagtgggatctgtgttaagagtccttgtttctggctaggtgtggtcgctcatgcttgtaatcccagcactttgggaggccgaggtgggcagatcacttgaggtcaggagttcgagaccagcctggccaacatggtgaaaccctgtctctactaaaaatacaaaaattagccgggtgtgttggcacacactggtaattccagctactcaggaggctgaagcaggagaatcatttgaatccgggaggtggaggtt

SEQ ID NO: 158812 - DNA, 372 bp, Homo sapiens
gatccccgctgcccacgaagtggcccccagtgagtcagcaagggcagcagacgaggcactgggctcaactttgctgtccctggaagcatgcatgtatctttctagcccctgtgtttggtgcctttgctgttttccaaccccaccttcatacttcctttagggcagggtggactctccagccaccctaccccaatgcctctcccaacctcagcccggcccctcccttgagctgggactctcactccagaacccgcccttgagctggggaacctgtactactggcatcttttccaggaaggaaagggttagcaatagtctggggcaataatatgaggaactaccatttattgagcacttcgtgtacctgccact

SEQ ID NO: 158813 - DNA, 243 bp, Homo sapiens
gggatggacttactcataacctggggaggttggtttcaagatccaagaagatcaagacatccaatcaaatgctggtttttaatgttgataaaatcattctttcaatacatatttgttgagttcttacgtgtcaggtattagggtcacagggatagagaagacataatctttggcctcaagaagcttacagtctagtgaagactgtaaacagacaataaacagacaatttttactatttatttt

SEQ ID NO: 158814 - DNA, 1005 bp, Homo sapiens
attggcagacactgaccccttcgtttgtttctgaggcaagaagaggcatttctcatgggaaaagggttgaggacaggaaagagggctcctaggaaacacacccatccatctaagtccacaggaggccaagtcaaaggtgtagggtcactctatacccattgcttggccctactgtgcctggaatcccccaagaagccaccagaaacaaaaacttctgggaaaagagacagtgggaatttcctcagacagtaatgagttattctggatcaaatgcccactgggccaagaaggtgagtcacctagtcagtttggactgccatagtggaataccattgatgggatgacttgtaaacaactgaaaattacttctcacagttctcaaaagtccaagatcaggtcccagcatggccggattctggcagggaccctcttccaggttgaagactttaacatctcattttcttgcatggtggaaagagagtgagagagctctctggggtctctttcataagggcgctaatcccattcatgagggctccaccctcgtgacctcatcacttcccaaaggcctcatctcctaatatgatcaccttgggggttaggatttcaacatatgaatttggcaggacacaagcagtcagtccataactgtgacacacaggagaaaactgcaggccagccagggagagtggcaaggaagggaacaggtgcttcctctccacagggcagctgccattctgctgagcatctgcaggtgggaagatggccaagtgtttccagagcatcccattttccaagacaagttggaaaatatagattttctttttaacatgaaaggtcagctcctgatctttaaatcttgataggtcattaaacaacttaaaatgcatgtgtgccaagcaaaacacattccagactgtagcccccaagccttcagtctgtgacctctggaaagatctagcatcattttgctgcttgaaggaatgttactgggggcagaatctc

SEQ ID NO: 158815 - DNA, 245 bp, Homo sapiens
tctagaggatcccatgccatgtagtaaggacaagtaagtccgtggtttgtaattttggattatgtttggtatattcaaaatcctatgctttttttcctgatagcaattcatttctttgttttaaagaactgacacatacatttttgtcctacaaaataaagcataattttgatgacagatttgagtgtttatttaatagtgtcaaacaaatagtatatggctaaggctgtccatgagatatgctt

SEQ ID NO: 158816 - DNA, 367 bp, Homo sapiens
gggaccctcagctgagccttctcttagccctaggggcgtgggctcctccctggacattctgtctcagcctgagacttggtgattgcaccttatccctgctagttctgttttgagagttcttttgacctcttgttagctaatccctcgttactctaatccctgttaaaattaataatttacattcaactttccctgtcaaatttctctctcctgatcagacccatagtgatatacttataatagtgaaaaattagaaagtacctaaatgcccaaacacagagatgtttataaatttatagtatatccacatagtaaaacactgtatagccactgaaaatcatattgtttatctatattttgatgttga

SEQ ID NO: 158817 - DNA, 332 bp, Homo sapiens
caggtagacctaaccagaggagagactataactcaggagtagaaaagtgtgttgtaactaggattactgtatgttttggtttctctgagtaagtcttaattgatcccttttgtcccattgtcccggtgtggcctgatgtacttaagggaggcagtaaggccaggttttcagaacacttgagcctggagctaaacagatctgagttcagaaatcacctattcttacttttgcagcatataacacatggagaggtgtataagttgtagtccaggaaactgggggaaggggcagtacatttttttagtgtcagtataacacaatagttaggaaca

SEQ ID NO: 158818 - DNA, 661 bp, Homo sapiens
attaccactgtgtattgagcactgagcaagatttaaggggtactacaggaaatcatggtgtagaagaggaacagacacatatattatgtgccataatagaggcaggtgtaatttgtcatgggatcttgagtgataatattaagaactcagtaagcttttaattaccatgtgacaggcaccattctaagtagtttttaaaatattatctcattgaatcctcataacaaccctatgcaataggtactctgattatcttcattttacagataaagaaactgaggcacaaggagtttaattacttgccataagtgaaaatgttagtaaatggtgaaactgagattaaactcagggagtgtcactccaaagtctgtgttcttaactactaacctataatgactctatcagtttttaagtgttggattcatcgaggtggtattagagatattcatttgcattataataaaaggtgagtatgttgaaatgctttttaaaatagtcatatcattttccattcatttatgattatttattttaataattatcctgttcaagtgaacaattaatgcaaatgtgactccagcctcttacctttttatgcaagtatccatctcaaattctttttttcttggatgtgtatgcctttttttctaattgaaaaaaa

SEQ ID NO: 158819 - DNA, 159 bp, Homo sapiens
actctgaaactccaactcaggctgtgaagcccaggattctgcatcattaacaaacaccctaggaaactattttacctggcccttcacccctcccatttccaaccccagcccacccctaccaaattttccaatttagagcatcattttatacttttctct

SEQ ID NO: 158820 - DNA, 217 bp, Homo sapiens
cagggaagccacagtaaataatgaaaaagcaatatagcctctctaaacttctgcaccactaaaaaagcaaccagattggagttctttctaagcaacaagtaggtaacaaacgtaatacaatcagcatttccaaaagagcattttataataaattttcttttttaattcttaaatggtactatggtatcaagcatggaaagcactaatgttagagata

SEQ ID NO: 158821 - DNA, 333 bp, Homo sapiens
ctctttacaaaggaatcgtggtctttttaccttttagttgggtgaatgttcactttcagaactaacaaatccatttgtataagtatgttgtattgcatagatttgtgcagtacttctcaaaatgattgtgagactcctgtaagcttttggcgaatgacagactcacaacatctgatgttaaattaacatcataaagcagaatttgcatctggccaccaggcctttagtcatcaaactagcaaatggaactaatgtggaataataatgagagagctggcttttgagaacagaagactaaaggggaattttaggaaacatgcagttcacattaaa

SEQ ID NO: 158822 - DNA, 611 bp, Homo sapiens
acattgaaggtagactcttagcaaaccaagtgctgctagtaatgtagttgaagcagtaataatgagaaatgagaagaatgacatgatagaataagattgaaaataaatatcaattacatatagtttaaaaatacccaattatatttcccatttatatctattttgaatttgttccagtagacaaaccttgatttcatttgtggaataagaatcacaccaaagaatcttaccatttttctttgggagtgttctgcctttgataagctttaatatgtgtcctcctatacaactgcaacccctgttagaaactagtctaccaggtagtgtcatttaagacttttgcctacacatttaatatatgctgtgcttttcatttcacatgagaatgagtttttatgctctccatgaaactattgtccataagtagacatgttggctatgccagtatttttgatgtttagcagaatttcttagttatagagcagtaaggagaatatgaaaagtccttttaacaatgcaaatgagaaaatacaactagtctaccaggtagtgtcattttggatttttgcctacacatttaatatatattgtgcttttcatttacatgagta

SEQ ID NO: 158823 - DNA, 451 bp, Homo sapiens
ggggtgatattcataaaatcattgtgaatgccactgtcaaagagctttctccctatgttttcttgtacgtgcaagtactactattaatggttacattttaaaaaccctttggacaatttgaataaatccattattactggaaatttttaacattcttttctctgtaattcaggctcaaaatttggcagggccttttctctataattcaggctcaaaatttggcagtgtcttttctctataattcaggctcaaaatttggcagtgtcttttccctataattcaggctcaaaatttggcagtgccatttctctctccttgctccctcaaatacttcagtcaacttttcctagtgagttactcttgtcactcagtttctgctaccccagcccagatatcacgttgtcacttgccccctccctcccccattgctacaatgtcctgtattgtatcc

SEQ ID NO: 158824 - DNA, 397 bp, Homo sapiens
gaggatctgtgtaagcttcattttaaggctgcagtaaaaatataacatttcatctgtgtgttcagaggtgagcttcagggattgggaacatcctgtttggtagtaaggtcttgagggtaatacacttatcccacacctcttcatactgtaggtcagaccatttgagaaagctgctggtgtcagagaaatggagataaaaatttgtaaaaagaaaaaaaaattgtaaaaaggtgaggaataagtatttggaattattgcggaggggccaagttccacctaaagattttcttaaaacgaagtttcctgttgatttcattttcgataataatagatacttgttcaatgttgctcaatcatctgaagaacaatttattctttctatcaataagtctcaatg

SEQ ID NO: 158825 - DNA, 298 bp, Homo sapiens
cctaccctggctcacacctagagctccaccagcccttcacacacaaaacaacatccaatgttctcccacggccccactcctcctcaggcacccctcgtccttaccctgctctccagacacctccaccttctgcccagctgcccgggcgcaagacgggacagggtgcagggccagcagatatgctcctctttgagacttttgtttaggtcaggaaaggcctgaacacgttacccccaaggggcaccagccagcaagcggaggcaggggccccagagaggcagagaccggctggaggcgg

SEQ ID NO: 158826 - DNA, 618 bp, Homo sapiens
gacgacacaaatgaatggaaacacatcccatgctcatggatgggtagaatcaatattgtgaaaatgaccatactgccaaaagcaatctacaaatttaacacaattcccatcaaaataccgccatcattctttacagaattagaaaaaacaattctaaaactcatatggaaccaaaaaggagcccgcatagccaaagcaagactaagcaaaaagaataaatctataggcatcacattacctgatttcaaactatactataaggccatagtcaccaaaacagcatgatactggcataaaaataggcacagagaccaatggaacagaatagataacccataaataaactcaaatacttacagccaactgatcttcgacaaagcaaacaaaaacataaagtggggaaaggacacccttttcaacaaatggtgctgggataattggctagccacacgtaagagaactaaactggatcctcatctctcaccttacacagaaatcagctcaagatggattaaggatttaaatctaagttctgaaactataaaaattctagaaggtatcatcgaaaaaacccttatagacattggcttaggcaaggatttcacgaccaagaaccca

SEQ ID NO: 158827 - DNA, 123 bp, Homo sapiens
gccaaggcacactggttgagagagaaactctggagccaaagtacttgcatcctaattccagctcctctgttgattagctgtgtgaacttgggcaagttacataacttctctgttcttgactcc

SEQ ID NO: 158828 - DNA, 352 bp, Homo sapiens
gggagaggaagaatagaccctcctatctgctatatcttgaagttatacaaatgctttcagatgaatctgtttctgagtcatgtttctgtgcgaactataaggaagaaaagcaagatctaaaagagaggatatggggcacacctgcattgttaaatgataccataaaaccctattcaggaaagtggatagatactcaagaccaaaagacatgctttctgatgacaatctctacatgttcatgtattatagacatgttttatgaagctgtacaagaatttcccagaggatctgtcacctttacccaccaccctctgctctgctgacacgggcagtttctctcctgagccacctg

SEQ ID NO: 158829 - DNA, 395 bp, Homo sapiens
tttttgcagattgagtttgagatatatcttagttttaatagttttatttcttaacacataatgacttctgaaagatgcctttgcagcatcctgtaatcagctcacatcattcgtttctgtacttgtatattttccagttgttttccggttgaccccaaaattcgtgagatttttttcctacaacaatttcaaaagagttgctgtttgaaattagttgcatccagttcagatcgaggtctgcatgctttctagtctttgttatttattggaaggctgtggtacctactacttaagtttgattgtttcctttgctgcgaagaagctttttagtttaattaagtcccatttgtctattttttcttctgtagcctgtgcttttgggtactctgcatcat

SEQ ID NO: 158830 - DNA, 135 bp, Homo sapiens
tgtgagccatcatccctggccagagacagctcttgtaagatgtctggctctataaagaatgggtgaacaagaaagcataggatattagagacggcgtgaggcaaacaaaagaatttgtttgctgcttgacttagt

SEQ ID NO: 158831 - DNA, 209 bp, Homo sapiens
actgtgtgggcagcggggtgctctgctgaccaagccaatccagagaagaacaggcagctcgtgagcctctgccagccagcggcagcagcaggtagagacccagagccagagcccctgaagagttggcgattattcatcttcattggtgtgtcagcgcattttcagccgtatccaccacagtgatgagctgacttttcacacagtgtaaa

SEQ ID NO: 158832 - DNA, 527 bp, Homo sapiens
tttcaccgtgttacccaggatggtctcgatctcctgacctcgtcatctgctcacgttggcctcccagagtgctgggattacaggcatgagccaccatgcccggccgcatttttaatttctaaaagttctgcctggttcttttttgatatgtccagtcattcttcatgttctcatgttatatgctgatttttgtgactctatagctattctgtagactatatcagacattcccaatgtctgatatccttgaggagggggatgtctaaatttattgcttttttgtttttttttctgttgtctctcctcaatgtagctgtcacctcatgtgtttggtgatcattgattatgaacttctgtttgatctttgtggtgatcttgagagtctaatttgaggatgcttgctttctgaaagcatttctatcagctttgtctgggagccagaaagtttagctggcatcacttttgagttcctacattttgcttctggcccagggctcagtgtcctgatcctattactgctcttggca

SEQ ID NO: 158833 - DNA, 525 bp, Homo sapiens
gtcagatttatgtgttgcagattttttttctagtctgtggcttgtcttttcattttcttagtggtggtttttgaagaacagaaatgtatggaaccccatttataaacttttttcttttatggttcatgcttttttatgtgctagctaagaaatttttgcctaccacaaaattacgaagtttttaaaaaatggtttttcaaagaaattttgtgcttttagcccttacatttaactcagtgataaattttgagttaatttgtgtatatgaaatgagaaagtaaataaatgttcatcctctcactccatggatatcaattattcccacatcatttgttgaagaagactgttatttccctattgaagtatcctgatgactttgtctaaaatcatttgaccacatatgcatagcactgtttgtatggttatgtgaataaaagaaatgaatttatataatgcctttgaaggaaattcaagatcatgtaatacttctcaagtattataataaacatttattttcatacccta

SEQ ID NO: 158834 - DNA, 259 bp, Homo sapiens
aaactgaatggtaaataatggtacctcaaataaaaccttgtgacgtggctgccagattgcaaaggtctaaactttgaaagaatcaatcaggtctcaattgccactctcaaggagtgactatggctaagtagacaagtctgtctatttcaggaatgtggtattaaagagcccattgggctatgaaagtaaagtcgcactttgcaatcggtatatcagtcatacaagtgaaattttgatatccatttagttgatacctgag

SEQ ID NO: 158835 - DNA, 681 bp, Homo sapiens
gtcccatctgcacctgtagcagagtttgacgatgagatcctggtcttcaatctgatattataacgggatgagacattgggatcttgggggaggagatggctgtactttgcatgggggggatgtgaattgttacagccagagggcagaccgtggtaatcccaaacatggccaaaacagtatctcctatcacacattctcttccacagtgtgcctgctatatatttctcccatgagagttgaggtcgacaccagctccttgaacctgggtggacttgtaatttgcctgtaccactgcatctggcctagttcaactttataaataaatatgtcaaagataattcaatattaaagtttatatatttatcattttaaccaaataatgtagaaatagagtgatatgaaacataaatacctatataggttaagaaaaatattcaataaattggaacaattctttgttataaaattcttaagaaactcagaataaaatgcaacacctttttacgattataaacccctcagcaaacatacttcaagcagaaccttacgaacagtataattaaaatgaggaaccgctgagatcactgctctctcattatttctcccggcgttgagctggagtcctaaccaatgtggtaagacaaggaatgaagattaagaggtatatgggctggaaagaaa

SEQ ID NO: 158836 - DNA, 597 bp, Homo sapiens
cctccgcctccaaggttcaagtgattatcatgcctcagcctcccaagtagctgagattacgggcacctgccaccacgcctggataatgtttgtatttttagtagaggtggggtttcaccatgttgactaggctggtctcgaactcctgacctcaggtgatctgcccgccttggcctcccaaagtgctgggattacaggcatgagccactgcatctggcctagttcaactttataaataaatatgtcaaagataattcaatattaaagtttatatatttatcattttaaccaaataatgtagaaatagagtgatatgaaacataaatacctatataggttaagaaaaatattcaataaattggaacaattctttgttataaaattcttaagaaactcagaataaaatgcaacacctttttacgattataaacccctcagcaaacatacttcaagcagaaccttacgaacagtataattaaaatgaggaaccgctgagatcactgctctctcattatttctcccggcgttgagctggagtcctaaccaatgtggtaagacaaggaatgaagattaagaggtatatgggctggaaagaaa

SEQ ID NO: 158837 - DNA, 446 bp, Homo sapiens
tgtgccaccatgcccagctaatttttgtatttttagtagagacagggtttctctgtgttggtcaggctggtctcgaactcctgacctcaagtgagccactgctcctggccaacaagtttttatgtgtgttccacaggagattgaaaagtgaacatagtttttgtaagctcaaagtgttcgtatttgtctcacacaatattttgttaccattattaagcacataaagttttgctttctgaagactgtgcaataagtggtactatatactgtcatcaggagatgcataatgtcttacttcttgatgatattagtagccattttacatcgctagggattccaaaatggtgatacttaaacattttactctgcttatttggtgggaatctctaaagtaggggtctccatctcccaggccacgtactgttaatctgctgtggcctgtaagt

SEQ ID NO: 158838 - DNA, 228 bp, Homo sapiens
ctccctctctctggatctctctctctctctctctgggtctctgtctccttctctctgggtctctgtctccctctgtctctgggtctctgtctccctctgtctccgggtctctgtctccctctctctctgggtctctgtctctccctctgtctctgggtctctgtctctctctctctgggtctctctctccctctgtctcagggtctccatctctctctctctgggtct

SEQ ID NO: 158839 - DNA, 405 bp, Homo sapiens
tgtgaaatctctggccctgacttttagatttctcgatccctattcctccctcagggctgctatataaccccgttctcagcatcaggttgggaattctctgtttgccattatgggggagagaagaggtcttggtcagctgtttttctgccctttgtataaccccaggctaattctaatcagggtttattcgatgctcatggtccttctaggtaactagtttaggatgtcataaaaacaaggttggataattatgtcatgaccggtttcatatcactctgcttaacattgttctgcattaagtgactgaatatagaggcaatgacaaaataaatgaacaaaacatcctgcccaatcccagacctgcatttgagttttatgcaactaaacatcatttgagaaaaaaga

SEQ ID NO: 158840 - DNA, 567 bp, Homo sapiens
aaaaaaaaagtttacatagttgtatgactgtgtgaaggtgtctgagtgtgccgcggtagaagtttgtttctgatttattataatgtatgtgcggttaaattttaggaagaaatagatacgttttattttcttgtttttttatgattgaaggagcagaaggtgtcttttgcaggggtgatcaggctcagggcactcaacctgggctcttgaacggttctggttttctgggaccccctgagatttagctacagctgtgcgtgtctgtctgtggttttctctggggaatctctgtagtcttcgtcaggttcacgaaagggctagaccctgtcgtctagtttaaccccctctagggaggggcacagacagccattgcagatcatgcagctggttcctcgtgaccggggccgtcgtgcatgtaggaagagccggctcggctccagacactgctgggctcacatgtcacgtgaattgcctcactgagacagcagctctgtgagatcgtggctgtgagtcggagagatctgacaaggtttcctgttgaaagcaggatgtgaattgggcgtgtga

SEQ ID NO: 158841 - DNA, 194 bp, Homo sapiens
atgctgattttcgttttgtgttgtgttgtattgtttctttgcttttagttttcaaaatgtattctccttttgcattgttgctgagatcaagaaattgtactctgcactactatcttcacctccagaacctgccagtgaaagcttattgagttagagggtaccatagacatcttcctctcccaggcttgcagaga

SEQ ID NO: 158842 - DNA, 699 bp, Homo sapiens
ccccaatctcattttcattgtctgtaaaatgaggggttaggtcacgttgacaaaatttagctaattttaggctctgaactccttttaagaatctaatcattactaacgattctccagaaaacgaaattgaacatatgtttaaaattcccaggcaacacagagacttaagaacttcttggcttgaatattatcaaggattactccagttcgaagtgtttgattctatacaataccaaaataagtcccaaattatagtgatctaacaaaaccatatgtgaccattgcagtgtggcagagagttttgctgcaagtttgcccacgtatgtgaactgatgaagaccttcatcttgtagctgcaacatcaggaatattcagcctctttcttcattgcatagtgagagagagaaccaaaaaccacatagggagttttcactgcctctgactggaagtggcatgcattcctttgaattttatattattggccagatcttatcacctggcacttggcccctaactgcaaatgggatagaaaatagaaaagagtatatttggtaaacattatatattctctttcacataagctttctccttacacagatattttcatagctcaaccagaaacttttggttaaataagcatagacttgtctaaataatggaatactatgaagctgtcataggtttgtaaagattgctaag

SEQ ID NO: 158843 - DNA, 339 bp, Homo sapiens
tggatatagagactggaaaaatagacactggagactcagaaagatggaaggttggagagggtttaggaatgagaaaataactaattgggacaataaacaacattcagatgattgtcacaccaaaagcccatacttcatccctatgcaacatgcttctgtaagggagctgcatttgtactctctaaagtattaataaagagattaaaaaaaaaaaaggcctggcgcggtgactcaagcctataatcccatcactttgggaggctgaggcgggcaaatcacgtggtcaggagttcaagaccagcctggccaatacaggtgaaaccccgtctctactaaaaa

SEQ ID NO: 158844 - DNA, 246 bp, Homo sapiens
gcggccgcctactactactactgctcgaattcaagcttctaacgatgtacggggacatgcttctgtaagggagctgcatttgtactctctaaagtattaataaagagattaaaaaaaaaaaaggcctggcgcggtgactcaagcctataatcccatcactttgggaggctgaggcgggcaaatcacgtggtcaggagttcaagaccagcctggccaatacaggtgaaaccccgtctctactaaaaa

SEQ ID NO: 158845 - DNA, 466 bp, Homo sapiens
  misc_feature (438)..(438): n is a, c, g, or t
atattttgtcctttaacctacacttacttaccagctctcaatcttctcccgtagccataccctcaatcaatctaagctcttttcacatgacttttcactacatgaagatgtcaaacacatgcttggataagtcatttttttccaggctaaacatgtctcacatccctcccacattacttatatgatatggctttgaatgtctcaacaccctgagactgttccctccccacacaagcttcagcttgtctacatcccttttaaagcctcacaactgggttggcccagtggctcatgcttgtaatcccagcactttggaaggccaaggtgggaggatcatatgaggaggctaggagttcgaggtcagcctggccagcatagcgaaaacttgtctctactaaaaatacaaaaattagtcaggcatggtggtgcacgtctgtnataccagcttctcaggaggctgaggcac

SEQ ID NO: 158846 - DNA, 360 bp, Homo sapiens
ccatcataaacaagaaaaccctatatcccacccccaccccctggtaaataccatatgacattctttagaaacacatttttttttaatacagaaaagcttaaaggcaccagaagtgaaaagtaacacacatttccaccatccagaagcaactggtgttaatatctggaacataaaatggaatcacatcttagctgaaaattagattctaaagttgtgtacaaagtgaaaattgtgtatgtcaaaacaactgttgaaggccgggcacagtggctcacacctgtaatcctaacactttgggaggccgaggtgggaggactgcctgagcccagatgttcgagacccacctgggcaacatggcaa

SEQ ID NO: 158847 - DNA, 622 bp, Homo sapiens
gtccttagttagctttggggaaaattaatctgcggggtggtgctcgacacgcaggatgctccgtagtcgctcgtagctttgcctcaaggtcttgagtgtgagtgtatgtgcacaatttcataattacatcctgtgtctttatatatctttagtttgaaagctcttgctagtttttaagtaaatcattccaagaatgaattatctattccttttgtgtctttccttagtgaggctttccttatgatactttttcttagcacttatcacctaaccaccaagcatttttgttttttctctgcttattgtctggctccattaaagggcaggtggaagaaatactatgacatcgttatactgaagactatgcatagtttctcatgagaaaaatcaagtagactctcagaatctgttttctcaaaatctgtacatgctctgcagatgttcacttagctagtttctggtgtattcaaagcagtgaattatgtagcggaagtggtaaaacagacaataataggcagatatacttggaaacagtaagaaataactggccataaagaggatgtcatgaaaaactacagaaaaatacaatttttaaaaagtgagtatatagtgaaggagctac

SEQ ID NO: 158848 - DNA, 312 bp, Homo sapiens
actgcccatggcagtaacctgctcaatagcacagcatcctgtattcacttcttcctgtccccatctccttccccactcccctactagtaattcccaagatcacctcccaaagaaataaatgcatgcaaccccttgtcttgggtctgcttctgggggaacccaagctaagccctcccctgtgcatccttcctgcacccatccctgtgcctcccgtccacctgacccccatgcatcaggagaatgaaggtaggttttctccttgaggaaacataactaataacaagatcacaagcaacccaaagacacagacat

SEQ ID NO: 158849 - DNA, 655 bp, Homo sapiens
aggatctccttctcgactgaaatagcatttcccacccccaccaggcatcactctgtctgctgccatttatcatcaaagagcgatgtcactgggcatgtgtttaggtttggggcgggtggcttttatttttttaattttagagatgaggtctcactatgttgcccagcctagtctcaaattcctaagctcaagggatccaccggcctcggcctcccaagagtgctgggattacaggtgtgagccatgtttcccttggtctattatctttaagtttctagaggagaaatttttagacaagaggatgaatttttttttaaaagaagtattacaggttaccaaactgctttccagaaagggtgcactgaattctactctcaaacaacagggcatgaaaaatgttccctcaccaaaaccacaatagcattttaaaatatttttctttctggtaataataacagttgaaaagctgctattatgttttcattgcattagttgaaatttgtagggttaaatatattgtgctatatttatttagtcaactatatatttcttttttgttagcctggtgtttttttaaaaagtattaagttatctgttttctcctggttgtctttgtctctttttataatctcctgaactcttcatagttttatat

SEQ ID NO: 158850 - DNA, 239 bp, Homo sapiens
atgtggatcaatgtgtgttgaaggaagtgttacatatagggacaactttgaggtacatttggggacttaagaagtgaattctggaaataggtagcatttatgtagtagtttaaaaaatatctgatgctgggaaatcactccacctactccctgcaaaatgccccaaaccttttgtttctgatgtacatggtaggcattcagtaagtttagtaaatgtacttttctgaaggtgactgtaa

SEQ ID NO: 158851 - DNA, 623 bp, Homo sapiens
gagacgagcggcggcggcaggcggccagcccgggtctacctcgctccgtgcagggccgggagagggatccgccatattggagctggggccgaaggtgccttggagccgcggcgcgaggcgggtggaggtggcggccctggcctggatcgggaaggagtcggctctgccctggcccgcaaggctggggagctaatgagcctctctggctagtctcctccccgtccactccctccactttctgccgccgggacccggctgggagccggctgtggcagtggcagtggcagtggcagcgacaggatgttctccaagaagccgcacggggacgtgaagaagtccacccagaaggtgctagacaccaagaaggacgcactgactcgcctcaagcacctgcgcatcgtcatcgagaatgcagaatctattgatcttaaacagtttttcgaccaacatttttcacatatatactatgtgttctttgaaaattttgtgactattgaagctagtcttaaacagaaaggtcacaagtctcaaagagaggaattggatgctatactttttatttttgagaaaattttacaacttcttccagaaagaattcatcagcgatggcagtttcatagtat

SEQ ID NO: 158852 - DNA, 105 bp, Homo sapiens
cacggccagtgcaaaggctcagaggtgggaacagctgggagtgttcaaggaggagcagaaggtgaaacggagggagggctgggtaagcgatgcgttggagagaag

SEQ ID NO: 158853 - DNA, 374 bp, Homo sapiens
ttgccctattcataccccttgactagactgcaatgcctgtttacttatctgcttcttcctccagactcttagctccttgagagcaggaatcttgccatcttcactattgcagcccgtcaaacagcatagtacgcagcacacagaaggcacctagtcaacatttttgtaatgatctcataagggaaaggagagggttttgttttgttttactttttagtttttgatattaccatgaaagacatataatcaccttaggagggaaatggtaatagcccagactagagagagaaattgaagagatgggagttagaggggaggagagactgagtaagtgaattaggagtggttgctggacattgaggataacatgaata

SEQ ID NO: 158854 - DNA, 511 bp, Homo sapiens
gtcataaatgggtaaccacagttgatgcttgatagcaaaactggtaagcccagtaataaaatgccgtcttccagataaacaaatccaacaaaccgaaaggcctctagtgtataaatattaacctatgctctattctgaatttatctccattaacttcctgacttctgaaattcttgaggaatagtcaaaatatagactatttctttccttgtgataccttattactaaagtgattattccagaccttaaagttaaaagctgcttgcaaaactactttattagttagctctatttgagaaattactttaaaaaagtaacaacaaagaagtaacaagatttttaaccgccagagaaaaggtaaaaaactagagttgtcttgtcttagtatcctgacttataaggacttcctcttgcaattcatccaaaagcaataagcagtaaactaaaaaacacaaattccatccctgaggaaactgggagacatctgtagccccaaaccagaaaatgtaac

SEQ ID NO: 158855 - DNA, 278 bp, Homo sapiens
tcctccatgtagttgtaggactagcggccccaccacatgggatgagagccctgtggcggctgcctccagcccctgcctcccaggcagctcattctaggaatgctccttattctctgggaagtttccatccacagctcaaccaaacgtttttggaatgtgatgtttataattgtcacttgtgcaagttctatatgtttggtaacctgagtaaacctttgtttattgcaatactatcaagtattcacttctcacaattgaattggttagatacatatctt

SEQ ID NO: 158856 - DNA, 626 bp, Homo sapiens
ttagcacaggagatttgtttcttggaatattttggagaggatagtggttgatgaaacttcctgcttaggagcagatgggtgagaagatatcagtgaaagcttagattaagaagcaggcatttgaatgagccctaaagacagcagtgaacaatcatcctcctcagtattttactgcattgagctattctttataattttcacactgtaaaggagacatctgtgttcttggagatatatcttaaaataaaaaccaacaagagtacaaaacaaaccaacttttaaaagatcaacctgactgggaagaaaagtttcctataaaaatggaaatgcattagaaaaccattgtaacttgtattcagatagcgccttatgcatatgaagccatcatttatgagatctcagaactccaaagactttacgaacaatcatgacccttgtaaggtccagaggaagcagaagggaaagccaatgccatcttttgcaaagaaggaacacacggaggcagcaatatttagattagttgctcaagttcaaacaacctagttgatttaaaagttagaagcaaaatattccaggatctaaacttacatcctcctatcttagatgtctggggcaatctggtggcg

SEQ ID NO: 158857 - DNA, 520 bp, Homo sapiens
ggagcagcccgggcagagtcccagaggccctgggagggtcccggtgatgcaggggggtaaacaagccaccagcggagacagaaccagtgtgcggggcttggaggaacaggtgggtggattccagtgcgtttggaagatgaggttcccaggactcgctgatggcagctgtgagtgggagtccagccagcatcccttccagatccctcttgtggaccgagatccaggtctcagtgtagaccaaggaacagaggcagcccctactcgggctcccaggctccagccaggcctgctaggtgggcggcctctgcccgtgtgatggaaggaagccaggctcagagatggggtgacttgtcccacgtcctggagggtctcacagctccaccacggccaggagacttcagtccagggggcctccatccccagcgaccttcacctgacccccaggggaccccagccaacaagacccggcctgcagctccggaacgggggagggctgctctccaccgcccctgtgcggccg

SEQ ID NO: 158858 - DNA, 369 bp, Homo sapiens
gaataattttttagtctgtcttcacttttcataaccctaatatttttggagagtacagactagttatttttcagattatttctcaatttttgcttgctagtgtttcttcagtgttggattctggttatgcatttttagcagaaatacatctcaatacatcatattatgatgcatatgtcatcagtttgtccaataaatgttgttaactttgattaaagtagtgtctctcgggtttctacactgtcaacttactatttgtctctcatgaggggatatttaaatgctatgtatacatcttcttcctcattaaacttttgtatgctaggtttagcatccaattacgattcttaccagaatcaattattacta

SEQ ID NO: 158859 - DNA, 155 bp, Homo sapiens
atcgacccccccgccgcctgccgcccaaaacacctcataaatatagttgcacggatgaatgaagcacagaaagaagtttgtagtagatgtcaaagaataaggataaatgaatatttttttttctcctttttttttttttgtagttggtgtttgga

SEQ ID NO: 158860 - DNA, 178 bp, Homo sapiens
aaaggtcctcagcttgacacacaagtccctccaaggcatgcccatgcctttctctccagccccagatccctcatttccaagcatacacactggattttcccagctagattcctaatgaatgccattgccatgtttacaaggatcttgtcctttaagaactgggagcttatgaagaatt

SEQ ID NO: 158861 - DNA, 417 bp, Homo sapiens
gtgacctcgggtccaagccaagagaaagaagtacaattccactggggcagcacgcaggaagagtgactttagagtgcattagatctggtggtggggagatgagtagttttctcctgattgcttctattttctcagggaaagtagctgttagtggagagcaggttgtttgaggtttgaggagagaggcgaaagtctcaaatgcccatctaggatcatgaattgaggagggaaattgttgggctgtactaagggcccactggaggtttgtggtcacacatttaaagtcagacaatccacatggttttgtgtgttcttccagtgtggggtaggcaaggagttgacttggggttttgccagagaataaaaggagagagaggtctaaagatggaaagattaggcaaaggggcaatcattgtg

SEQ ID NO: 158862 - DNA, 413 bp, Homo sapiens
tggtgtgaaatgttcagaaatgaatgtttagaatgaaactgacttactatcagctccgaccctgggccctgcctgtcctgacaggtgtggacgccaccaccacactcacagctgtgaaacatctttcctacagccatataagtggcaactcttgagagtttagtgtgcttttaagaaagctaatgacactaagaggaggagaatggtgctgaacagtcaattttgttttcatcttacagagaacagtaagctattaagagcaatctgctcaacagcgagacgtcacgaacaagctgagccatctcccctggtgtcctgggctaaagaatctccttagaaataacagcatttgccagacgtttatgcagaagtggatgcattatttaacaaagtcccgtattgtttattctgga

SEQ ID NO: 158863 - DNA, 225 bp, Homo sapiens
actgcccactacctgcagaataaaggcctcaattccttgtcatagattaatggctcgaattcccactcacctctccagaggatctcctgcttctactgagccactgcaattcactgaagaagtatgctctttcagctgtggcactcttagccctgacacactctttacgcagccccttctttatctggctaactcctacttacccttagatctcatctgaggcct

SEQ ID NO: 158864 - DNA, 263 bp, Homo sapiens
gtcacgtgtctgccaagggaatctgtacccgggtgtgtatcgaaacagaatggccttctctaaagattaacttaagtggcttgccctcatcgagccccttcctatgtatggattaaaaataattttcgataccagtggaggaatgctgttgtccttggtctgctggtggccagcttcctaaacggcattttttatttgcttctctctggtaggccttcgctgttggtgaggaaacattgaactttgtccagggcatttgagct

SEQ ID NO: 158865 - DNA, 380 bp, Homo sapiens
tggattactttttaccttggcagaatcacaggaatgtcaaggtaaccaggccacctcagcatagctctgattctcacccggtcacctgacttgcccgccctcccccatgactcacccagtggctcagcatggggcctgctgcactgtggctgctggaatctgccaaggacctcctgggactgcccttggttttgtgtcttccttagagtagatcaaatgagaggaaccacgtgaagtagctcacacagggcctaacagagcaaacacaagacgtggaaagcagacttggtgaggcttgagtttagtttgagggttgcgggggtcccagctctgctgcttaacagccctgtggccatgggtatatcccccagcattcagag

SEQ ID NO: 158866 - DNA, 464 bp, Homo sapiens
gatagtactttccacaggggagtgaaacgacgacctgacttgtatctcaaaggaacattctgactgggatggacatagggtagtagaagcaggaaagctggttgagaggctattttataaacgatggtagtttttaccaaggtggtagcacaggaggtagtgaagggtagtcaggtcatgagtatattttgaaagtagagctaactggattcactgataaatcaagagatacatcaagaagactccaaggttttagtctgggcaactggacagttcaaattactgaactgtgaaacactagggactacagaaatcaaaacttgggttttggatttggtacctttgagatatttattactggatggctgaatactgcccacccttcccaaacaatgttcaggtatccaggacatgagacttcagtatcaagaacatattaatgtccctgtggaaaagtattggta

SEQ ID NO: 158867 - DNA, 428 bp, Homo sapiens
accccctctgcaggaagacagacgtgagggctgggagggtgcggatgcaccagcggctgcaggaccacaagccagaggggatcagctcttcaaagggcactgggccaggcttcccagcacccagggaccctgagctagccttgtgagtagagcaggggagtctggcaggtagaggatgggaggtaaagggaggcacagagtgggcggaggctgggaagtgtgaaagggcactgtgtacagaacctagggagtaagcagaagccagagatggatggaaagttgggctgggctgcattgtggaaagccttgaatgccatgccaaggaacttgggccagtgtattcaccttggcttgagttgtaaaagcaacagtgcagattcctgggccccaccctgggcctctggatctgaatctggagggagacgctg

SEQ ID NO: 158868 - DNA, 354 bp, Homo sapiens
aattttggagcagtgaagtagcaaagtcctttgagggaaatatttaagtcaagtctgtggtttgatgagttagatatgttggtcccatctgaccacatgagaaacagatcctccactgatcatgttttctgcgtagataagagggaatgctcatattcgccggtctgtcttagtatgtgctcagatcccaagctttatgggacttttggaaagggatggggctgtgattaggacctttgaacagaggtcatgttcctgccgggaaactggaggataaattttattattgaatggatctctcagaccacaagatgattctaagtcatctgacatccttatcctctaaatcagaaa

SEQ ID NO: 158869 - DNA, 573 bp, Homo sapiens
cctccgcctcccaggttcaagcaattctcctgcctcagcctcccaagtagctgggatcataggtgcccgccaccatgcctggctaattttggtatttttagtagacacagggtttcaccatgttggccaggctggtctcgaactcccaacctcaggtgatccgccagtctcagcctaccaaagtgctgggattacaggtgtgagccaccacaccctgcctgttgttattatttgtggttattttttagggtcagggttcactctgtttcccaggctggtctcgaactcctaagctcaagtgattctcctgcctcggcctcccaaaatgttgggattaaggtatgagccactgcacctggcctttctttctttctttcttttttttttaaacatcagatagtggagcaataatattggtcatcagtgtttcttttcttttttaaagcacttcgttacttcctggcactgcaagatgctaccgctcatcttgtttctttctttccccagacctagaatcagctatttctgaaaggagtcctggtttctttaattggagaatgatattagaaacca

SEQ ID NO: 158870 - DNA, 659 bp, Homo sapiens
tcgtacggagattcctttgtcttctacaaaactggtacttggtgcaaaaagatgtggactgctggcttagagagaagccaaatgagccctcctaacatacagaggccattgtattgtgttccagaattaggatggcctcaggagtccatcttgtcccgtttctttctaccttcatccctccttccctcccttctttccttccttacttccaagctgaggtctcgctatgttgcccagtctggtctccaactcctggcctcaagcaatcctccctcttcactcagcctcccgagtagctgggattacaggcatgtgccaccacgcccggctaatttttgtattttcagtagagacagggtttcaccatattggccaggctggtctcgaactcctgacctcgtgatccaccagccttggcctcccaaagtgctgggattacaggcctgagccacagtgcccggccgagtgcgtgtgtttttaaagtgtgcatcattattactgaacagcaacaccaagagagtctcacggttcctgtgtgttcccacttggactattttgcaacactcctcttgacgttgaaaagaaaatgctatgacacttggttactgctgaggcgaggccaaaccaccctctccagacctgggaaaccagtgagtatt

SEQ ID NO: 158871 - DNA, 327 bp, Homo sapiens
ggcatagtaggctgaataacgccaccccaccccgcccgaagatgtccacaccctaatgctcagaacctgcgaacacattccccgacatggtaaatgaggttttgcggaagtgattaaggatcttgagatggaagggtcattctggattagctagtggacccaaggtaatcacaagcatccttctaacaggagagcagaaaggtcacagtcaggctgggcacggtgactcacgcctgtaatcccagcactttgtaaggcgaaggcacaaggatcacttgaacctgggaggtggaggctgcagtgagccaagattgtgctattgcattc

SEQ ID NO: 158872 - DNA, 464 bp, Homo sapiens
gccactgcacgccgatgggtcaggattcttaatgaaatgtgctactacagtaagcccaaagctatgcatgtttattcttaaaacaactccctgtagattaatgataaaaattaatgatttaaggtctgtgatttgagagttattgcttgtaaatttgaatgactgggctagtaacagtgacagtctgatctaccagagagacagtaagggtatgtacatattttttcttggtcattttcagcagcagtactcacccattgttgggaaagagtatatggtcttgattttctcttctcagacctaaccttattctcaccatagaccagtgtgtaatggtagttttaaccaaaaacagtgattgttttactttatgtgcatgttagatacggcatctttttactggaagtttatcatttataaggacaactttttcatgtttccttcatgtaacacccatcggcgtg

SEQ ID NO: 158873 - DNA, 495 bp, Homo sapiens
  misc_feature (458)..(458): n is a, c, g, or t
gccactgcacgccgatgggtcaggattcttaatgaaatgtgctactacagtaagcccaaagctatgcatgtttattcttaaaacaactccctgtagattaatgataaaaattaatgatttaaggtctgtgatttgagagttattgcttgtaaatttgaatgactgggctagtaacagtgacagtctgatctaccagagagacagtaagggtatgtacatattttttcttggtcattttcagcagcagtactcacccattgttgggaaagagtatatggtcgtcgagggggttttcagagtcgagactgtattatgaccatcgatcagtggtgtaaaggtcgtgtcagatcgactacagtggattgtcccacgccaagtgcatgtaaaatgacagggatccatgaacatggaagtctataaattaatgaaaggacaacctgtcaagtgacccttgatgnaacacgcaacagcgtgggggattatcacaggtcgacc

SEQ ID NO: 158874 - DNA, 205 bp, Homo sapiens
tcattcccactagtatctaaatggtagctaaaactctttcttttaaacaagaaaatttagattaaaaactgaaatataccatagcttgatatggcacctggtcaaatataagattttggttggaatttttttttccactctgttggaaagtgtctaacattgtaacagacacttcctttgaactcttgcccagaactggattgct

SEQ ID NO: 158875 - DNA, 508 bp, Homo sapiens
ggtaaaggattacaccaaattgccaggaatacgtgtacaacatgaatacctctctgttttgctaacagagctctaaaaagctttagaactgaactattatatatagtaagggttttgatcttaaagaaatgtagagccggaaaggaattttgagatattttaagtcaagcagaagaaacgtaactctatggttcctccctgcctgaatgaattagttgaaaagaaaaacacagatggtaaatataattaatttacaccacctcctgttcactatcccccaaagcactaattgatatgttcattcattcaactggttttattttcttcagagagacacagggttctaccactgcagaagacataaaagtatactagaattctatcatgaagtaattaatgcaattcaagagaaagtagaacgtgacggaagatagagggtggaaggaaaaaagaaaaattaaaacagataaacattttaaatagtatacacaatttgcctgcctttcca

SEQ ID NO: 158876 - DNA, 986 bp, Homo sapiens
attattttcattcctgggaaaacctcccaccgctgtctccagttgtgtacgtgggtgtgtatgaaatccgccccaggccccttgtcaccccacagtatttctttacgatcctcattctactgttagaaatccagaggaatgtgaggaggaaagcaagtataaacttcatcataattataacaagttgttaaaaaggttgtgttcatttcagaaaatgtcttcatgaggtctggtggtctttttccctgacaatttgtatctggtgttttgtaaagcattaccattttatatgaagttaaagcagttactttgaaaaagttacatggggtaagtataaaattggaaaggatatttttgtagttttaagaagagtaagacttctccgcgtgaaaaagtgttttcttgtgaattagctgaagctaccctgtattttaatagttaggctcagaggtgacacatgctgtgctttttcttcttgaaggcaggttgggagaaggtaagacaagtagttgttatttttaaagagctgggaaagctgcgtatcatgcaattgaggaggggctgtaggaagttctggtagcagcccctcctacacttaaactttagccaggaagctgattttgcatttgttagaaaaaggtatttgtcacagtacgttcaatttgggaagagtgttttcttgctgtttttgtctaaaatttgaacatcaaaatatccaaatcaacaggtcagatggattgcttgacttgggtgggtacttttgtgtatgttggggatatagaattcccagatgtaatataggacaccacctaaagttttttttcttttctcttttttttttttttttttttgagacagagtcttgctctgttccgcaagctggagtgcagtggtacgagctctgatcactgcaacctctgcctcccgggttcaagtgattcttctccctcagcctcgccagtagctgggattacaggcatccacca

SEQ ID NO: 158877 - DNA, 1338 bp, Homo sapiens
attttttgtatttttagtagagatggggtttcaccatgttggtcaggctggtctcgaactcctgacctcaggtgatccacccgcctcggtctcccaaagtgctgggattacaggcgtgagctgttgagcccggcctaggtccccatttctttactggctgtcagctgaggattcttctcaactttagaggctgcctgcattcctgtttgtggttcccttccttcatcttcaatgccagaaaggtggcttccttctcacactttagtgtctgacccttcctcctgccttttctcacttctgctttcgagggtctgtgtgattatagcaagcttacccagataatccaggataatctatttgaaggtcatctaattagtattcttaattccatctgcagagtccctacatggtcgtacccagattgtgtttgattcagtaatgaggggatgggatcttggaatgatatctttagaatttggcccaccaaaggcagaattcaggttttcctgccattttacatcagggacttaacaattcctgggaatcagcagctggacctggggccatttacttatcaaacctagggcaccattcttaaccttgagccttacatttctgaggcttattacaatctggcctgctagatttttatatttgggtcacacacaggcagagtgtttctgacatttccagtcaactcccttacctcaaatatcatcaatttcaccactgaaaatgttccaacagctgtaatactaattaacaaagtcagtaatttaaccaatatgaaagcccatttctgacccaaagtatactagttaacataacctgctcttggatgggataaggatagctagcagactggcttgcagtagtgtctcttgagtgtggcttttgattaaaagctggttaactactcttggagcctgtcttccagattaagacaattcattgcttttaggcagttggcttacagccactggacatatcccagcttatgttgaagtgttttgaaataaaattcaaatgatatagtagactcttgccatcttaaccgagagcatcgagagttcagtcatgtctgtggttctcaccctcgtgcctggtatgcagtggatgtgtcacagatatttgttgagtaaataaaatgaattaatgcatttccatgctttcatatataacaattttagtacagtgtgagaacagcatgacagattgcactggaagaaagcagaaatgttactcaagttactttgtcgtactaggagcttattgtactcatgatgctataaacatgtagactacaaactggaacttgaaagtgttaacatttatttt

SEQ ID NO: 158878 - DNA, 230 bp, Homo sapiens
atttttcagtttatttttatttatatattaataaatacatgtatttctttattttatgagcctttcccccacaaaaatatattaagatcattgaaaagattagtccaaaaaagccaagtaaaacgagtttggaaagaggaaacaggctgttatgaagaagactgaatttcagcttaccagcaggcggggtaaagaaggaagtcatcttggtgaagagtttttccatagac

SEQ ID NO: 158879 - DNA, 490 bp, Homo sapiens
tggaagacccctccaatgagtgaattcaggagaaaaagcttatcaataattatgagtaaaaaacttctgagattccagtaattaaaacaaagtagattatgtaaaaatatgaaggacagaatttacatgatagtgggaatgcatgcaacagacaactttctcaaagtgtggttcgaagatcacctaagtcagaattctacagatttgaactcactaggtaggaagagggacccaggaatctgtattttcaataagtatctgaggtaattcttattaacactctaaaatttgagaatcactgatttggaaacaggttactaaaaggagaatagggtaagagaaaaggttacttttaaagtgatgacacttagggcagggtgtgatggctcacgcctgtaatcccagcactttggaaggctgaggcaggagaatcacttgaacctgggaagcggaggatgcagtgagccgagaccacgccactgcactccag

SEQ ID NO: 158880 - DNA, 515 bp, Homo sapiens
cgtctctagtaaaaatacaaaattagccgggcgtggtggcacatgcctgtaatcccagctactcgggagactgaagcagaagaatcgcttgaacctaggaggcggaggttgcggtgagaagagatagcaccattgcactcaagcctgggcaaaaagagtgaaactccatctcaaaacaaaaataaaaacaaaaacaaaaaacaaacaacccaaaaacaaaaagaaaaattagccgggagtggtggcaggtgcctgtaatcccagctactcaggagtctgaggcaggagaatcacttgaacttgggaggcgaaggttgcagtgagccaagatggggctactgcactccagcctgggcaatagaatgggacttagtctcaaaacaaacaaacaaacaaacaaacaaacaaaaacagaaaaaagtattgaacggtttgctctataggggaggaaaagtggagcaaataagtctcaaagaagatggtacagacatacagacatttggtatctttccctg

SEQ ID NO: 158881 - DNA, 576 bp, Homo sapiens
ggctcctgccaaaactagaattagaaggagtggggatcctgtaagtccagcccatgctctcccttggtgttgggctgtaaaaagatcacgaggagttcagttgggtgagcctccctccttccatcactaaaacacaatcatctcacattataaatatctcagaatcttcctaagagatcagtgtagttcttcttattgttcaggaaaattagtacatggggtcaaggagcaggtcatacacattggtctccacactatggggagatccctcctctgccttggcctctgtccaaccacatggaagtcatcctcttccttttcttcatcatcatcatcctatcactgtcaccattctcacatgtttgtggggattttacgcaaaacacagagttaatatttttacatgatatggatcccgaaggcagacaagattcctggcattcattcatcacaaaaatatctacaactaacagagagtacgtatgattatgtaacacatgcatcagccacggactgctcctgccaccgagactgaatcatgctcatctttgtatgacccacacaatgtctgggacg

SEQ ID NO: 158882 - DNA, 391 bp, Homo sapiens
ataaacagtacagaaataaatcctcatatatatggtccaacggttttttgagaagagtgccaagatcattcaaatgggtaaagataatcttttcaacaaattgtgctaggaaaactggatgtccacatgcaaaagaatgaaactggatccttacctaacatcatatgcaaaaattaactcaaaatggatccagagcctaaatgtaagacctaaactattaaactcttagaagacagcacaaagaaaaagctttgtgacactggatttggcaatgatttcttgggtatgacaccaaaggcatgaaggcaacaaaagaaaaaacagacaaatggcacttcatgaaaatttaaaattttctgctatcaaaaaaggcaatatataaaatgggaga

SEQ ID NO: 158883 - DNA, 479 bp, Homo sapiens
aatcacagctttaatactagttatgaactattaaaaggtctaaatttttttattgtggtaaaataataaaattcactattcgaaccatttttaagtacacagttctgcggcataagtacactcatattgttgtataaccactaccaccatccagctcccaaacttttccatcttccacaactctacccattaaacagcaattctccactccccctcccccagcgcctggtaaccagcattctactttctttctctatgaatttgagtactccagatacctcgtataagtagaatcatataatatttgtcctaaaaagtctaaaaatatttttaaaacagaaactagcacccaaataaattttaaggtacaacatttgaagcatatgattctgtatacgtttttaaatttttgacacaaaacacattcacatataaaatgtactaagtcttcccttagttaaataaattcgcatatttct

SEQ ID NO: 158884 - DNA, 822 bp, Homo sapiens
atacacattgaatagagcttctaggaaaaaacactggaatttagcacagaagtgacagggaacctctgaggcacagcaggaggaagtgaagcagccagcctggccaggattggctcagagccaggaggagcaccacactgcaaataaaaggcaagcaagagatccctaacagtccatgttcccactgcagactcctgcagtcctagccattggagtgccccttggcctttggaggccctgagagtagtataggaagctacttgtagtccacgcagtggcattgttctagagagggagtttgtactgtttctcacacccctccctgcaaacagctgcagcatagtgccattttgggagcccagccactgccagattacattctgccctggagcccagcagcctttgtatccccacatacctggagccctactggcatcctcccatgtccactcagagggcttcagtgctgtgatgctgactggacccagtggtgcagccaggttcccaaaactctagctaatgcagtcctctgcaccatatgaaacaggcagtgcagcacaccaggagtaggagagtggccctgggacaaagggagccaaagcatgcactccccagagcctgagaactgcctccctggtgttgtgccatatacagtaaccctgacccttccactggtagggttgctgacatacctgcatgtgccttcagaggccctggagattgacccaccagagctagcacccatgtgcaccaccaaggtacctgaatacaggcacatgccacctgctggtacccacacatgtcatccagggacccaaggac

SEQ ID NO: 158885 - DNA, 259 bp, Homo sapiens
caggcaggagctcctggagctgtagcctcctcacccaaggcttccagctccttcctgtgtggggtctcagacacgcgacccacccggacgtccgtgacagtgtagcttcttcatctccggcatgacccgaatttcctcggggccccccactccctggggaacaggaagaaaatacccatttcaccctcactgatatacacagcacacaggcacctacgtacacacttgcacacatccagtgtctcagcccgtggctgct

SEQ ID NO: 158886 - DNA, 485 bp, Homo sapiens
ggcgatctagaggatcccgggttcccttgtctcctgctctagtctgtactacaagagccactgccctgaaaacacctttgtttgagaattccttctgcctctttctgtttccaagatcccaaacctccccctttcttggtttactccctcactttggtgggacatattctccataagtttcctagaagtgacatgtgaaagtatttttagtagagatggggtttcaccatgttggccaagctggtctcgaactcctgacctcgtaatccgccagcctcagcctctcaaagtgctggaattacaggcatgagccaccacacctggccagcgtttcttctttttctctctaatttatcaaatttggaaacagttggaaaacatttaaaggaaataagtctctgtgtttttaataatagtttaaaagttaaaggaaaacaaatgaataatattctgtttattatagtcagacaaaatgtacatacgaa

SEQ ID NO: 158887 - DNA, 293 bp, Homo sapiens
tttacccattcatccactgacgggcatgtgggttgtttacaccatttggctattgtgaataatgttgctatgaacatgggtatgtaaaaagctctttgagaccctgtttccaaattattttgggtttacacccaaaagtgataatgctatgtttaattttttgagacccagtgagttttctaaaaagagggagaaggaatacgttccctccagaaaattactagataaatgtaaaaaatctgatcatttttaaaattactatattgtacccatttatgtaatagatcttactg

SEQ ID NO: 158888 - DNA, 827 bp, Homo sapiens
ccctgctgtccccatcacaggcctgcgtggtatgaccttcctccaccgccctactcttctgacacggaatctctgaaccaagccgacctgcccccctaccgctcccggtccgggagtgccaacagtgccagctcccaggcagccagcagcctcctgagcgtggaagacaccagccacagcccggggcagcctggcccccaggagggcactgctgagcccagggactctgagcccagccagggcactgaagaagtataagtcccagttattccaaagtccatatgggttaatctgctctgacttgttgccattctaacaatttgtgctcatgggaagctctttaagcacctgtaagggtgtctcaagttacagtttgggatattaactatctctgcattcccctcctcccccagacttcagagatgtttttctggcgtctcagttgacatgatctgttgtgcgtcttttctgtcaggtcactcttcccttgggacccgagatcacaccctcatttttcacattattctgtttctgttggagagacagcatataaaacagtattgaaataggctgggagagagcaatgtttctgtgctatattggatgctcagaagtgcaggagacgctggacccaattctctctgctgggtagttaccttatagcatttggggatttgggttagatgatctaaccaggaggacatcactggatggtcacccccccaaaaaaattccatttgagcatcaaaacctgctttgcacaatcctatttgatgcccccagttcagcagagtcagtggccaaagaaaactttggacgtgagtaac

SEQ ID NO: 158889 - DNA, 434 bp, Homo sapiens
gagacaaaactctcactctgtgttatccaggctggaccgcagtagcacaatcacaactcactgcagcctcactgggctcaagcaatcctctagcctcagcctcccaaagctgggattacaggtgtgagccaccgcacctggccacaattcctaagtttcaaatgtctccctgttctgagtagcataatgaactctctctctcccacctaggatatgaatcctccctctgtccattgtgacctcagtgtctatgctgcctgcccataagtcacttagtagccatctcagttaccgtatcagctgtcgtggtattctggtgcttgtgttcaggtcacccttatttggcttaacactggccccaaagtgcaataatagcaattctggcaatttggattgccgaagagaaagtggtaaagtgccttctttaagtgaaa

SEQ ID NO: 158890 - DNA, 599 bp, Homo sapiens
aaaaattcctgagttgaaaaggatttcagtcagagcactgattatcttgagaagcctggttaggttttttgttgttgttgttgttgtaatttaattaaaataggcccaattaatggaaataaagttagtcttttattataaataaggcttcagttgttggaataagttctatgaaatggagacggagagtaaatgttgttcagaggatgcttatctaggtctcatcatgtccaccattaacccccattcttccggtttgacattttgcggatcattggtgatccactgaggttgaaaagaggaaatacatgaaacagagctcagagagctgcatttgtcactgcattgactgctctcggaaaaatctgggtacgaaatgccatctaaaggtatttaccaaggtaaagctgggggtgagcttataaagggagactattcctgtcccaaattatcaggaagtttggaagctatttgctgaataaaagagaattattgtcttctaagaggcaatcttagtcactatttaagtattttaaaataatcttgagatgaatgaatttcggctgaatgcctttcttatttgctaagtggcttgtgtg

SEQ ID NO: 158891 - DNA, 311 bp, Homo sapiens
gtgctggaacattaatttggatgccaacatttcttttgcataaaaatgggatgtatgaatctcctactttgcttcggttggcttgagtcctttgtcttctgaacactttcaataaaaactctgaagagcttctcatcactgtagaatatagtacaactgcgtaaagttgccctccaggacctgcagattccaacctctgcctgactccaaagtcgtcatcttgcgtcattctcccttcacccacattgtgctccagacacattttccttcagtttctctaataaatacaacacgcttctcactgcttaaga

SEQ ID NO: 158892 - DNA, 502 bp, Homo sapiens
accttgaaggctggttcataaacttctgtgctattttccccaataaattacaagctaatcaaagacagtacacaggacagtatggtgtgtgctctgctgccaccccttggataggggagcaagcattctggccaaaccacggaatcaaggaaatttatgatacactgcttcagttatcatcacaaacacttgctaggcttctaaactgtaatttccaaaaaacctttttgataattccttctggagttatgtcaaactctacatacatgccaatggagagaaaagatacttgctttggaagagactggaaacactgggcaactaaacagaacttccatcacaatctagactgtaggtgccacctacctgacacaggggtccactcatgcacagggagaatacgaagagataaaagatggggaaaacacttgagtaccaattttactggcttatgcttggtaagccaattctcaaggggcctacaaccctaggggtttgtagg

SEQ ID NO: 158893 - DNA, 326 bp, Homo sapiens
aaagccctcagcttaatgacatgatgcaatttgttaaatgtagttaatcagagatgtaaaaagtacaattagtttttagtgatatgatttgaaaggactagggtaggttatataaaggatacgaggctgggagtggtggctcacactgtaatcctaccactttgggaggccacggcgggtggatcgcttgagctcaggagttcgagaccagcctgggcaacatagtgaaactctatctctacaaaaatacaaaaactggccgggtgtggtggcttacgcctgtactccctgctaccctggggggctgagacaggaggatcccttga

SEQ ID NO: 158894 - DNA, 141 bp, Homo sapiens
ctccagttctcagtgggaatgctttcaccttttctctgttcagtatattgttggatgtgggtttgtcatagatggcttttactaacttaaggtgtgtcccttctatgccgattttcctgagggttttaatcataaagcgat

SEQ ID NO: 158895 - DNA, 436 bp, Homo sapiens
gccgcacggggcacgtgtcttccctctgcctccggtggcgccgcacggggcacgtgtcttccctctgcttccggtggcgccgcacggggcacgtgtcttccctctgcttccggtggcgccgcatggggcacgtgtcttccctctgcttccggtggcgccgcatggggcacgtgtcttccctctgcttccagtggcaccgcatggggcacgtgtcttctccccaacccccgtttcttactgtcttggtttccccttggatcgtacctcagactttacttagtggcagtaggagtgtccttggtgtcctgtagtgtccacagaggctggtgtaggctttcattcatcaaacatctgctgactggcaggaacgggtctggctgctgggttatggtctcaactctaccccggatgggactgcctcagaaagtgaaggagc

SEQ ID NO: 158896 - DNA, 371 bp, Homo sapiens
tcagggaggctgcagggctgaagttggatataggttccctggagggcaggcaggacgcagactggcctggaggctgggcttgggcctgtgaggatgggggctgagcctctcagggccttagtgatgagggtggtgccctgcacagggtggcagggcagcacacagatccgcttcttgcctggggaggaaggatcgttgtgaagtggccaaagaattgaaaatgaaaagtcacaactgagccttgaaggggaagaagctgtacctgaggctggggccaggctaggcctgggtgtcctggccataccacttcccatctctgtgcctcagtttccctctcacaggatgggacacatatgtctacctcccaagtg

SEQ ID NO: 158897 - DNA, 180 bp, Homo sapiens
agccatgatcagaccccaccacccctcacctgcgctgcatctggtgggagaagtgtgtgcgaagaacaaagaagtgcaatgtggagccctccaaggactcccagtgctacgtggagaatctgaatcgactcccagagtggccaagcctccgggaagtgacattgaagctgacagtggaat

SEQ ID NO: 158898 - DNA, 379 bp, Homo sapiens
ggccggtaccgtactctaacattatgcatcatgaagttcctctcttaaatcagttccttgccttatgttcacacacgtcctttctgctatcaggaatattcttcctaatctttttcaccaacagggtagagagaggtgctaggaaggagatgttaagtgggaaggagaaaggaagaataaggagagctggaaagagagtcggaggaagggagggaaaaagagaatttgagatcctcaaggccttgctaaacacaagttcctgtccagccttcatgaaactaagaggctagtagaagaatataataaagtcatataagtggacatagagatattgaaggattttagagaagtcttgatctaatgttacattttaagatta

SEQ ID NO: 158899 - DNA, 311 bp, Homo sapiens
cacacacacaatatgtcctcagctacacaaaaatatatgttaaaacgctaatatcaagaagtggaattatggatattcttactacttttgtgtttttttccaaactttcttatgcaaccaccttttaccgcttgagcatcagaaaaaaaaaaaaagaaagaggtgcttagtaatccatcatgataaatagtagtataaagcatagcttgagaagataatcagaaaattagacttaaggtataattaattccacattttgactgtttatatggcaaatgatatcttagagccctcctcaatttgaatactgg

SEQ ID NO: 158900 - DNA, 201 bp, Homo sapiens
caaagaagagagaaagagagggctagaggcacagctgttacattacaggagcttcagaaggacgaactagcccaagttaggtgaaataagagaggacgtcctggaagagacagaatctaagtgaaactgtgaaggctacatggggatccttcataggagtgcgcaacacagtttctcccatgcaatccccactgagtttct

SEQ ID NO: 158901 - DNA, 164 bp, Homo sapiens
ttcgcgtgatcattaactcacttgttcagtagattatttttttgcctccaatatgcaggccctgagctaggggcacaaagtttctacaagaggctctaaaagtacaggccgggcacagtggctcacacctgtaatcccaggactttgggaggccgaggcaggca

SEQ ID NO: 158902 - DNA, 173 bp, Homo sapiens
  misc_feature (28)..(28): n is a, c, g, or t
tatatccattagtcaaacttcaaacaanggagaaagttactctatgtaaattatacctcaataaacctgactaaaaagaaaaaatgtagaaacaaaacaaaacaacaaaaaaacaacaagacgattcctgattcccttagctatttatggtgcaaagctgtagctgacccagg

SEQ ID NO: 158903 - DNA, 188 bp, Homo sapiens
aagccaagtctgaataataccacacatcatacattatcagtggtccctgtctcccttcttgtacaatccagaggaatatttttatcaactattttgtaaatgcaagttttttagtagctctagaaacatttttaagaaggagggaatcccacctcatcccatcttttaagtgtaaatgctttatttaa

SEQ ID NO: 158904 - DNA, 762 bp, Homo sapiens
gggaatggtccataaatggtagctgttcttggtcttcccatttcagagatgagaaatctcagaccctggaagtcatggtaccactgggcaagggcaccatggttaggccattagcctcctctcagaaactcttttatgggtccacttacccactttcctgccttgaaacaatagaagaactaagggttttatctttatcttggttttttatttcttaaattctgtttctttggttttcttttttcttttttttcttgagacagagtctcactctgtcgcccaggctggagtgcagtggtgtgatcctggctcactgcaacctctgcctcctggtttcaagtgattctcgtgcctcagcctcctgagtagctggaattacaggcatgcaacaccacacccagtcttattattattattattattatttttgagaaggagtttcattgtgtcacccaggctggagtgcagtggcgcgatcttggctcactgcaacctctccctcccgagttcaagcagttctcctgcctcagcctcccgagtacctgggattacaggcccctgtcaccacacctggctaatttttgtattttaattgagacggggtttcaccaggctgatctcaaactcctgacctcagtgatctgcctgccttggcctcccaaagtgctgagattataggtgtgagccactgcgcccggcccagctaatttttagtagaaatagggtttcaccatgttggccaggcgggtctggaactccctg

SEQ ID NO: 158905 - DNA, 188 bp, Homo sapiens
cagattttcagaaacctagctaaccattgctcacagtgaattcacctggatctaacgggctggtttctgtccccaacaggccctggctgatccaggaggcctgcctcacccactccacccacagagctccagcagggaaacagcgggggcctccataccgccaccactactccatgaggagtaaatgc

SEQ ID NO: 158906 - DNA, 653 bp, Homo sapiens
acagttgaggctgggagcagaaataatcaacatgcccattagatacaggacggaataatgcttctattggttgggtcccttcgagagagaaccattctctgctttcaataggacagaagagctccttggcactggatgcctccgggtctggttgagagaggaatggttaggagactgttctgaggatacgcagacatcatccaaagcttcctacattcagatgaggacagaggttgggccagagctttgtatgcttgttacctaaggatggttctgaccatgtaagcagatcacagaaggtaagccatgctgaagaacttacaatagttatacttccagtttgtccatttttatctccatgggtagcaaataggttcatgatgctgttatttcaattactttacatcctgctaatggctagttgtgtgatcctgtaacttaatttctctgtgcctcagttttatctgaaagaaaaatccagccaaaggctttagaacagtgcctggcatacagtaagtgctcaagaaatgttggtaattattattgctatgattcatttccacaagaatttgcaattttttttcttttctgctaattgactttgtccaactcccatcatctttgggtcatttttatggaaatagactggtaat

SEQ ID NO: 158907 - DNA, 609 bp, Homo sapiens
acagttgaggctgggagcagaaataatcaacatgcccattagatacaggacggaataatgcttctattggttgggtcccttcgagagagaaccattctctgctttcaataggacagaagagctccttggcactggatgcctccgggtctggttgagagaggaatggttaggagactgttctgaggatacgcagacatcatccaaagcttcctacattcagatgaggacagaggttgggccagagctttgtatgcttgttacctaaggatggttctgaccatgtaagcagatcacagaagctggaggcaaaggatgccaagatgggaaagccacataatggaaggatcctggatttcagagctgtcacttggaggaggggcacccagtgaaggtgtcttatctaacccacaccatatcttcatgaagtggccatatggatttgatccctatccttcagaggtgctcagcctaagggaacacggatagtagattaagcactgaccaggctcaagtttgtacattccaacttgttgtttgggccttgttggacataactgaagtctggatggcagggtgaaaattggataaacagccacactgactcagggg

SEQ ID NO: 158908 - DNA, 595 bp, Homo sapiens
agagttagcaatttgaagatagattgatagagattatctaatctgaaaaacagaaaaaagaatgaagaaaaatgaatggaacctcaaaaaaatggggcatgctaacataggtgtgataggataccgaagaagaagggggagaaaaagcagaaaaaatatttgaggaaataatggctgaaaagttcccagatttactgaagaacattagtctgctcttgcaggaagctcagtgaactccaaatgggatacacacgagatccacaaatagatgaatcatagtaaaatgctgaaaactaaagacaaggagaaagtcttgaaatcagcaagagaaaaagaacttgtcacttacatgagtttacctgtataacaaacctgtccctgaacctaaaataaaagttaaaaggaaaccaaaactcatcacttacagtgaacctcaataagattaacagctgacttcttagcagaaccaatagagactagtaggcaatggaatgacatacaaattgctgaaagaaagaaaataaaaactaccagtaaccaagaatcttatatctagcaaagttatcttttaaaaaaatgaaggcaaagtaaagat

SEQ ID NO: 158909 - DNA, 356 bp, Homo sapiens
ctagtgctcttccgagaggctattgaacacatcacacggatcgtgcgggtcattggacagcctcggggcaacatgctcctggtgggtatcgggggcagcggacgccagagtctggcccgcctggcttcatccatctgcgactacaccaccttccagatcgaggtcaccaaacattatcggaagcaggagttccgagatgatatcaagcgtctgtatcgccaggctggggtggagctcaagaccacgtccttcatttttgtggacacccaaatagctgatgagtccttcctagaggacatcaacaacatcctcagctcaggcgaggtgcccaatctctacaagcctgatgaatttga

SEQ ID NO: 158910 - DNA, 640 bp, Homo sapiens
caaactaccccatgaggcctgaggagccgcccgaaggtcgcggtgacctggtgcctttttaaataaattgctgaaatttggctggagaacttttagaagaaacagggaaatgaccggtggtgcggtaacctgcgtggctcctgatagcgtttggaagaacgcgggggagactgaagagcaactgggaactcggatctgaagccctgctggggtcgcgcggctttggaaaaacaaatcctggccctggactcggtttcccagcgcggtcaacgcatctggaggggactggaggaaacccccttgttggaagagattccaagagaagcacggttttctctttcccttgccctgactgttggagtaaaaaacctcttaaatccattgtatcagaggtccttacctctctgacagttacaatgatctttgtatctgaactttgcacgtctgccgaaaaatccgaacctgttgactgggatttttaagaatccgtttctcccttttgtgtattccatattggccggccccaaggatgctcgcagaagccagcccccaaccccagcccttccgtatctttcccctccatcgcggctttgcgatgaaagattagcccgcgaacagaggcattgattacaaacatgtc

SEQ ID NO: 158911 - DNA, 781 bp, Homo sapiens
tttttttctgtgatggttgaatttagaagagttgggttcaaaagtgaatcctcctctccctctatgtagctgggccattcagaacatagcacggtttgcttgctgttggggacctgtgtgctgtggctgtccttgggcaccacccctcaatcggagggtgttttgttttctttagggctggctggggcatgccttggcaggcacccgccacagaacacatttgttaagtgaaggggagagaaagtcctggctgcttggtatagggggccgagcttgagtgaggcctcctctgcagtctggaaggtctgattatggcagtgcatctgggggtcagcaggaccttagagactgatttgtatttatccaactcttaagaaaggaatttatcgttaaaaatgaaatggtatgaaataaatagcaaaacgtgggtgctagctagtgccgactgagtttgctggccagcatgctctcagaagtactgccctggccgggggtggtggctcacgcctgtaatcccaacactttgggaggccgaggcgggcggatcacaaggttaggagatcgagaccatcctggctgacacggtgaaacccccgtctctacttaaaaatacaaaaagttagccaggcatgggtgggcgggcgcctctagtcccagctactcgggaggctgaggcaggagaatggtgttgaacccaggaggcggagcttgcaagttgagccgagattgcggccaactgcacttccagctgggttgacagaagttgagactccgttctcaa

SEQ ID NO: 158912 - DNA, 269 bp, Homo sapiens
gtttgaagagattttattatagtatgtgtgtagcacttagtcacttcattattcaacatttcaaacgttctaaaagtccatttcttattaataaggcccaaaatagaagattttagaatatacttggtttattcagagtatattgttattcaaaagcatgagaaaaaaaaatcaggaaactttaatgtacaaaggctttgtaactaatcagaagggaaaaacactagctcgccttaacaaaattattaaagactaacatggaagtttgg

SEQ ID NO: 158913 - DNA, 293 bp, Homo sapiens
aacccaaatatctgacattaggcaaccggttgaataaactattggtatagtgatagaatagaataccgtgtagctgcagtcaagaaagttcactgtacctatgtagcgcgatctccagaatgtattgtaaagtgaataaaataagatgcagaatagtatttaagtgtgtcttttttttgttaaacagaggtaggtagaaatattgtttacacttgtatttttatacagtaacaataataggtagtcgagggaatggggtagacaggagtgggagtgacacttataagtgggag

SEQ ID NO: 158914 - DNA, 271 bp, Homo sapiens
ctcaagtgctgtttcttccacataattcaaatctgattatatctgaacaaatcaccaactggaagtgaagaattttctatggatcagtttgattccattgggaaaatactgccagcaaaaatagtttggcggtccccgtggcaaaacttagaaacctgttttcttgttttgaatccctctgggtaagagcccttaccatgttgctcataatcttatttaatgccatttttagctggtatgacctgaagtggaatagccagatggttttgtt

SEQ ID NO: 158915 - DNA, 492 bp, Homo sapiens
tcagagacccattttgacctcactgtgatctaacattgtaagacagaagtgaggaaagtatttaaaattctaacctaaagcttttactagactaatgaagcaagggtggtttaggtgtcacaggatgaactacatttattttcccacttaaaagtagatttagggacgggcaagggggtgcctgcctttggacccagctactcaggaggctaaggcaggaggatcacttgagttccaggccagagtaggcaaaataccaagaccccggtctgtttaaaaagaatttttttaattaatagatttttttgtcccctcctaaaatgcttctcctgtcatcttccttatgctaagccctcttcctccatataccttagcacatcccaagtctcttcctctcctcctcccacccttatcaaataggtcaacgttaagatacacacacacacacacacacacacacacacacacgtaaagccatcaaattaataagaa

SEQ ID NO: 158916 - DNA, 324 bp, Homo sapiens
ttgacctcccaggctcaggtgattctcccacctcagcctcccaagtagctgagactacaggtgtgcgctaccatgcctggctaattttttgtattttttgtagagacaaggttttgccatgttgcttaggctggtctccaactcctgggctcaaggaatctgggtaattctatgtttaatcgtatgaggactcttattttgcagcgcacagttagacttgaccatcttcccatattagcacgtgtacacttacttccggcttcttcttcttttttttttttttttttgagatggagtctggctctgtcacccaggctggagtgc

SEQ ID NO: 158917 - DNA, 391 bp, Homo sapiens
gaattgaggtctcttgctgcccagtttggagctctttccaggacatataatccaaacaaatttttgcaccttgaagtattaatattttcctgatggtaaaatctatactgtatattgaaggctctttagaaaattagaaaatgcctatgaatcatgctgtataaagagatggcaataatctgacatagcaattatctattcatgtaaaattactatttgcaaccagaacttctggataagggctccaatgttcccaagtcaggaacctcagcttccctttctaattattataggaggcaaacctgggggaaaatggttatgctaaaacatttaaaaagagaataagcacaataaattctaaaggttgaatgaaatatttaattttagcaat

SEQ ID NO: 158918 - DNA, 340 bp, Homo sapiens
ctaaggaagaatgcaacagatggaatgtgtttaaaaacagggaagcaaagtggcctccagtgagaccctatcacctctctacttatactgtccccaaattacctattccaacaggctttatcgcctacttttgttaagtttccatctcagcagtgagaatttaaataactgccatcatagccaacttaagctatgagtaatggaaacaaatctttttcaccaacttccatcagaaattcttttcaagggcccttataaacgcgatctttttttctaagccttaaatatttgatctcttgcttgagactatacaaaccagatcttcatttcacaagacctg

SEQ ID NO: 158919 - DNA, 268 bp, Homo sapiens
gtaagggagacttataggacagagatgtttatgatggctcagtcagatggatgaattatgattttgtcaactagcacaaattctaggtggaaaaaaggacgtggctgactttgttgtttctgagaaccttaaattaagaaaaaactatacctataggaatttagatttttccatgtcatatttaataaaaacaaaaaaacttcattggttttcatattagggagaatggagactatctagatgtaaaaagaaatcactaaaagagcct

SEQ ID NO: 158920 - DNA, 119 bp, Homo sapiens
aagcagatgataaattgctctgagacatcacttatttttaattttattttttgtcatagttatttgtacacacagagattcaactagatttataagatacatttttgaaaagacagttc

SEQ ID NO: 158921 - DNA, 308 bp, Homo sapiens
gaccagggcaaatcccatgtacagttttccacccttggttagaaggaggagaacaggaaaaaaattttattgaatccatccctagagctcctcacaagtcaagtcttgtgggagacttttagggctggaggtgagtgcagcaacattccagatgcagtgagttcctctgacagcctgagcacatctccacaggccacagaggcactacagtctatgcctccaaacacagggaaaagtggaggctacattcattcatcctgggcttcacactaagtcccaaatttggatacaagagcatcttctagaaa

SEQ ID NO: 158922 - DNA, 171 bp, Homo sapiens
cggcggtaccatcaactcacataagggtacttcttcctctgcctctggataaaccttggtggggtccaagggggaggggaagaagtaaccctttatgtgagtttgaatgggcagaagaagaaaaggatgaagttgtcttctaattgcactctatgaatgttgcttttttgt

SEQ ID NO: 158923 - DNA, 738 bp, Homo sapiens
tacatgatacgaatcgagtcggtacggggttctctaggagtcgacgggccgcttgacttgctgggatctcggccgtcgtataaaggacctgtgaccccagctgttagaaccaggacctgggagcagctgctttctggatccagtcctccagggataggccatctgctgccatgtgagagaaccctggaaaagaaactgaccacaagatatctttgtattccttttctgtgtgctccagcccctttagttctttcctgtcccctctcacctaggcaaacttgagaagcatgatgaatctgcactggaaaactcgcaatggattttccgttttcttcccctttccccactccaccctgtcagcacatccagcccattggaaaatagtttccaggggatgtaggcagacttatatgggcagcttcttcagtgggattggtactatttagcaggctttcattttattatgaataacatggctttgcattataggcctagaagtgtccttaaaatctcatctcatggaagaggaacccaagattccacattctttagccttgcattcagggcctaccctcttctggcaccagcctgattttctaaatgttcagttatctcctgctaaacctggaaacatttgctaacttctccgtacacataccacctcttcttgattctctgcctttgtttgtgcctttatgtcccccaccatgttcttcccactctcctttatccccgtca

SEQ ID NO: 158924 - DNA, 722 bp, Homo sapiens
tgagagctcatgcatgcatgcaggcacaatgggacccattgatttctggcattcagcttgtgcatagaggacctgtgaccccagctgttagaaccaggacctgggagcagctgctttctggatccagtcctccagggataggccatctgctgccatgtgagagaaccctggaaaagaaactgaccacaagatatctttgtattccttttctgtgtgctccagcccctttagttctttcctgtcccctctcacctaggcaaacttgagaagcatgatgaatctgcactggaaaactcgcaatggattttccgttttcttcccctttccccactccaccctgtcagcacatccagcccattggaaaatagtttccaggggatgtaggcagacttatatgggcagcttcttcagtgggattggtactatttagcaggctttcattttattatgaataacatggctttgcattataggcctagaagtgtccttaaaatctcatctcatggaagaggaacccaagattccacattctttagccttgcattcagggcctaccctcttctggcaccagcctgattttctaaatgttcagttatctcctgctaaacctggaaacatttgctaacttctccgtacacataccacctcttcttgattctctgcctttgtttgtgcctttatgtcccccaccatgttcttcccactctcctttatccccgtca

SEQ ID NO: 158925 - DNA, 502 bp, Homo sapiens
tgaataaaatcttcctcactgtgctttaactagtgtcactgattttttttttctttaacagcgggatacggctctagcagaggtagagaaccataatctctcgcttgaacacaactaatagactttcttctttagagcaaagctccttgaaagagctacttgaactttctccagtttctgtgctcccagctcctatttgttcttgaatatgctccagtcaggcgcctaccccacctctccactgcaacagctctcactggtaccaatggcctccatgttgctaaatccaagggtcattttcagtctctttcttagctgacctatcagcagcatctgccaaagttgattactctctcttccatgcaatactgtctccccttggcttcaacatacatcactttccttttaccaatctggctgcagcttctcagcccattggtaggatcttcaatttcctaagctctaaacattggagcacccagggctcagtcctcagacccct

SEQ ID NO: 158926 - DNA, 473 bp, Homo sapiens
gtagagatgaggtcttgctatattgcccaggctggctagaattcctggtctcagccaggcacagtggctcacgccaacttctgttttttatattttagccttctaaaatagcctcactatctatggtcacagcagatagaatagtccataataatctaatctactccagagcaattcaagagggaaatactaaaaagagattactgtttctgttttgttgttgttgttttcagacagactcttgctctgtcgcccaggctggagtacagtggcgtgatctcagctcactgcaacctctgcctcccggtttcaagcaattctcctgtttcagcctcccgagtagctgggattacaggcatgagaattgcttaaacctgggaggtggaagttgcagtgaaccaagactgcaccactgcacaccaatctgggcaacagaggaagattatctcaaaaaaaaaaaaaatagaaaagaa

SEQ ID NO: 158927 - DNA, 779 bp, Homo sapiens
cgcagaggccaaagtgggtggatcacttcagcccatgagttcaagaccagcctgggcaaacacagcaaaaccccacctctactaaaaatataaaaattaaccaggtacggtggcatgtgcctgtcgtcgcagttaattgggaggctgaggtaggaggattacctaagcccggggaggtcgaggctgcaatgagccaagatcacatcactgcactccagcctggacgacagagggagatcctgcctcaaaaataaaaaataataagtaaataaataaaaagaatatattcactattttgcttatcaaagtctcttaaaggaggtgacttacctacgctatggacccaattactcagccaataagaggacacggtccctgcccatagaaagctgatgtccagcctgacctcaatacaaaaccatccagttaaagtggtgggggtggctatgcagagacgggcgggtgccgggagagtcaagggcagccccttggctggccaggggctcagacagaccagctggggagatgcatcactcgcccaggaaaactgatgacagcttagatggcactgcaagagcagggaggatcacactcatgtccagaaagtgaaacataaaacagctaaacatgtaccacacagctttcatacaaaaattttatatacacaaattttgaaaaaatagagatggggttttgcttgttgtcccggctggtttcgaactcctgaactcaagtgatctgcctgcctcagcttcccaaagtgatgcaattacaggcat

SEQ ID NO: 158928 - DNA, 237 bp, Homo sapiens
tcaagtctaacttcaagtcaaggggtctttcacttcattatgctattcatttgcctggggaagggatgagggggagcgatcaccaaatagccttattctctgggatctggcagtgctggttctcagcctgcttgacctcagactcaccccacttttctgctctgctctctacagacaggagggtgacctttgcacactgagttccctgggctcccagatcagctggtttccgcttgg

SEQ ID NO: 158929 - DNA, 456 bp, Homo sapiens
gggaacgggttgtctctactctgcactgcatgtctggggtgccttgaaggctgaggttagaatgatcagagagtcccttactcaggggcctggcagtaagtgcagctgtcacctgagacctgggcaggggcaggggccaggaccaagacacctacactcccttttccacgtggcagtgtggcttcttttcagcaagggctgggttttgagagttagcatcctcgctcacagcagacctgaccagcgggaggaagctgtgtcatcttttgtatttgggtcctagggctgcgtacaaattaatacagactagatagcttaaaacaacaaaaatgtatacttttacagttttgagggctagaagcctgaaattcaggtgccagcagggctgtgggaggacactacctcgcctctctggcttctagtgtttgctgacacctttgacgttcctcagcttgt

SEQ ID NO: 158930 - DNA, 240 bp, Homo sapiens
cttcatcactttaacctgattgagccaatttgtgtgcaagaaggtaatgtgtcatgagtatcttggatcattgatttgggcctttattacattaaaatgatcatttcagccctattagattattccatttgtatctgcttatgaacaatgtcaaaatggtatttctaatgggttgtcactccatgttcaaacattttaagaaaattgtaggtagtgacttaaattgcattaatattaaag

SEQ ID NO: 158931 - DNA, 238 bp, Homo sapiens
ttttaagcataacaccaactgtattgattttaatattatggaacaaattctaatgtttcatgtatatataagccaaatttagatactttatattattatatcgtagatatatattccaaccaaaaagctcagcgcaaattaattttaaattgtaatggatctcaatccaacgtgaaagaaatataccttcttatttaccaaagtacctaaagatggtaaggtgagccaacaaatataa

SEQ ID NO: 158932 - DNA, 164 bp, Homo sapiens
tctgatggttaaggaataccataccataccaacatgtaggaggacacagagtgttaagataataattctaacttatttttccacagaattacatagttctatatagttacaaagaaatgtatgaacacatatatatcactctaacactactttttttttttttg

SEQ ID NO: 158933 - DNA, 270 bp, Homo sapiens
ctcaggctcggtacctgttccccctaaaaatccttgaccttctgaactttaaagcatttttatacacaattttaaaattttattttgaaaaattacaaaccttcagaaaagttgcaacagttcaatgaacaatcaaatttaccactgttaatttctttccttcctctcttccttcttccctccttctttcttttgctgaactatgtgcaaattagttgcagacatcataatacttcatccctaaacactttggcatatagttcagcctaa

SEQ ID NO: 158934 - DNA, 561 bp, Homo sapiens
aaggcagattaaaaacaagactcagctatatgctgtctataagaaacacactttgaatacaatgatatagataggttaagtgtaaaagaatgaaaaaaggtgtaccatgcaaacaccaatcaaaatgaagctggagtggctatattaaatcaaatagtcttgagagcaagaaaattttccaaggattaaagagggaattacataatgataaaagagtttattttccaaaaagacagaactatataaaatgtgtatgcacctaagaatatagctttaaaatacataaagcaaaaattgataaatctgaaagggaagagagacaaattaacacttacagttgcaaacatcagtacttgtccctgagtaactgatataacaagtagatagaaaatctgcaagggtacagaagaactattctaacaaccagctgcatttaattgacatttatagaacactctacccaacagcagcataatacacattcttttcaagtgcttacaattacagcaaaataggcaatagcataggtcataaaaccttttctaatttaagagaaatgat

SEQ ID NO: 158935 - DNA, 513 bp, Homo sapiens
ttacaacagtgatacctaccttcatggggttgctaggaagaaatgagcaaatacatatatatttaaagcttggttaaaacagtgccaggcacacagtaaatgccaagtggttcacaatagtcctgtgaggtagatgctgtcattcccattttacagaacaggaatctgcggcacagagaggttaagttcaaggttacacatgacctagcaagactgtggttggtgcacaaatacaaacatacccactctggaactgcagtgtcagaagggagaaagtgacagatggaactgttttttttttcccttccctattttgttcccaccctcatactcctactattctaaatggtttggcctcaaacactgcactaagaattattctgacagcacaatggtaatccctaggttctgtttcttggcccaggtggtggtcacctgtgtgttcactttgtaaaacttcagctagatcaagcttgtctaacctgtggcccatatgcagcccaggatgacttt

SEQ ID NO: 158936 - DNA, 138 bp, Homo sapiens
ggtcaacggtttttgggcccctactccactgttattaagactgagctgtcccaagcagatagaactctaaataaggcctcaggcgcaggtgagttccctgagcctccaatcagcattatagtggatgcttttctatct

SEQ ID NO: 158937 - DNA, 539 bp, Homo sapiens
ataatttcttaaaatagacaggcatgttataaggaagttgaagtttatgtgacagtataccagatgcacagaaagttctggaggaaatgaaggaaatattgagaggggaaaactactactttcttatctctgacaaattggattgatctgtagctggagtctggagagagtgctttccaggactcagtagtacctaaggcattactcaagggataggtaatgatggacaaaccagatacagatccttacttggtgctttccagggctaagtagcaccctagtaaggcattctaggctttattccaaggaatggcattggcagaaagaattgaaggaagtagtgggagaaagttaggacaactgagttgctccaggtttggtgtggaaagcaactgccagctgtgaactgtgccgtgggacatctttgacatccatctatgaacaagcacctgtagagagctttcaggtccagttatgttcaataatctatactaggtcaaagatgacattaatgcatgtttctgttgaaaaagtttaca

SEQ ID NO: 158938 - DNA, 274 bp, Homo sapiens
tgatgatgtgaaacccaattgcagcttcaaaagccagaactgtgtagcagccagactcagagaagcgggtcccctacccctgctgtcccctgtcctttccaccctgtccccatgagctaccctttctttcctgggtggccttgtgtgctttcatttgcccactttcttgcacggaaagaatgtcctacagggaactcctcttccctagcagtatgtcctggaaaccacgccacgtctgtccacaggctcctgctcattcctgtggacagccata

SEQ ID NO: 158939 - DNA, 214 bp, Homo sapiens
ccacttgtttgaggaccactctataagcagcaaaatcgccaagagttctttgtcttcttccccaaacttgttttccatcctgtgccccatcttccagataacagcattatttgtccataagcataatcacatacatatctctctgtagcatcactactgcacattgccctccacttcttccacactacagacaagtaccatgcgttggccaccc

SEQ ID NO: 158940 - DNA, 469 bp, Homo sapiens
atgagcagcacaaacacaaaaaaattaaaaattgagtaatgtctcaaatatgtactgtacagccaaactttgggctacttcacaaaggtggacagaaatgtttgcatggctgcctgttagaatccacaaaaagttttgatttgaatattcccacttgacacgaacactactgtattatgtgaagatatgggaaaagggagcagaaatggctatgaacatgctggccactcacagataaacagtctctccaaggtgcacaagagagacaatgccttcccattccccggtgctaccctgttccattctgccagggcccagctgggtccacattaggtagtttccagtggatcaatggaattgttgtttggctatctggtagatctagctaaaggaatctaaagaagacagttccaacatgaaaatagtagctattaacatatctattcataaatatttgttgagaatctac

SEQ ID NO: 158941 - DNA, 413 bp, Homo sapiens
attaaagtcccaactttatctttaatcttccactgaagattttcaactatccctctttgcctctccagcccactacactaatttagaacttaatagggttcctgctctacagtgatattccagaaatcacagtctaatcagtgaatagccggcttcagagttcttgggcatttccaggcacaaaaactttctattaagctgtagcccctgtatcagactctgtatcaggcagagtctgatagcattctgcccatctcattcagtactgtttataaataataagggagccccattctaaactctggattccagccatgggctcagttgtagattctgtgtcacaatttttgtcccttcaaccccataatggcctaactactggtcaacatgatctcctggacctaaaggctggt

SEQ ID NO: 158942 - DNA, 792 bp, Homo sapiens
tctgtgtccacacacagagagtacctgtgtggatgctccagcctggggcattccctagcctctgtgtccacatacagagagtacctatgtggacttaaatgatacctactgtctggcgtgggcttactgtctggcgtggacctactgtctggcgtggacctactgtctggcgtggacctactgtctggcgtgggcctactgtctggcgtgggcctactgtctggcgtgggcctactgtctggtgtgggcctactctctggcgtgggcctactctctggcgtgggcctactgtctggcgtgggcctactgtctggtgtgggcctactgtctggcgtgggcttgccagtcatagggtggcagggaagagcagggtgttgtgcagcgtgaccgcattttgatgcaaacagaagaatcagctgtgggttataacttcagtatttaccatattagactacactttgagaacactgttttaatgtatctccttgatctgactaaataaaaataacagggatatttttaaggagaagggatcggtgtaatcagtatgagtactgcaatgcttaaaaacatggcgtaggtgtcactcacacaggaagactgaccaaaaaaaagaagaaaacacacaaaacaacgctttcggcgccccgccccagaaagtttaaaacactcgcgtggggcgggccccaaggtaggacaggcacgcggccaggaaccgggcaccaggggggtccccaaaaaaccgggacgggtggaacaccggggccggggcacggcacaaggcacgcctcc

SEQ ID NO: 158943 - DNA, 381 bp, Homo sapiens
acaaactataaatacgttagaatagttgcctgtgatatacctgggaaatagaagtgggaatgaggacaaaataaaacaaatacatgaggcaagagagtccatgagtagaccccaatgatgattattggccatgaaaggaagcttgatggctggatggaaagaaggaaggaaggaaataagtaagggagagatggcggatggagctggatgtgtccttccagggctgtacaaaggagggggaccccaacccctagtccagacaaaggtccctaaggcaggtgtacagtattgtggggatgaattcatcagccacgagagactgacccatctaatgttaaattcacttccctgctctgactgctgactcatccagcagttagc

SEQ ID NO: 158944 - DNA, 130 bp, Homo sapiens
attgaatactgtggcttccttagccattattgaagtgcattagggaacagccctaaagctgtagcctgtgtattagtctgttctcatgcagctaataaagacatacctaagactgggtaaattttaaagg

SEQ ID NO: 158945 - DNA, 266 bp, Homo sapiens
gggcgatctagaggatcccaacgtcagcactccttgtatcccttcacccctgcctggaccaccccaacccagtccttctgattcttcaccgaactaagggtgtgtctaagtcaccagttctcatttatttgcttgtttatttttcatcctatcttgtttaaaaattgattttaattggcttagaaaaataccaggattcacagaatgcacaaatctgtatgcaagagaagcagcaggctgcgttaaagtaggagactcggtcaaca

SEQ ID NO: 158946 - DNA, 310 bp, Homo sapiens
ataggtcggtaccaaatggatcctttttcacttaacatttaaattaggatatgttgtagagggcagtaaagaatagatttatgcttatttttggatactacacataatggtttagtcaattgagtaagcaacttatgtacacaaacttgaaatatctaaacaattaaaaatgtctataagttataatgcagtttaaaatatctataaatgaaaacattttatatgctgaataaaccacgtgtgtgttcaagagttcagtatctcaatataataatcatttggaaatgtatgtcactgtacactaaacaat

SEQ ID NO: 158947 - DNA, 267 bp, Homo sapiens
agagccttgtgtggtgctggttattaccgttgcggctgtatatggtgtgcaaccctcccaggcatgtgaataagcacaggtgctagaagggcaggattggatggaggaaggttccatccctttggctgttgggcagaggtcaagccaggtgcatgctccattcacatcagcacctgtagctgcccggagagggcctcccagatgcaggatcctggaatggcaaacaggcagcaccagagtgtgaatggcggagctctcatagaggct

SEQ ID NO: 158948 - DNA, 293 bp, Homo sapiens
agccagatctgtggaaagcagccttgttaattctgaataacagtttttcaaggagccattattataattacagccatttcatacgttaaaaaaaggaagggtctggtggcagggacaggtcttgagcccacgactccactggattgtcccccatgatccccttttcaccttggagttccaaggttgtcacagtgtggtggtctggagtcatgcagtaccggagaaaggctcacgatggggctgaattcatcacagaagacttcttggagacaagtggtaggatcaacagctgt

SEQ ID NO: 158949 - DNA, 531 bp, Homo sapiens
gtccacacaggtccaacgcaggtaatgtgaatttgggtgcaaatctacctgaggactggcttctgataacaaattcttgttcccttgtccatggaaggtttatttcttgttcacccttttaccatatggggttgcagctttattcagtgacctcgtcattagccttcccaccttgggtgggccccaggctgcgtctctttccccacacctcatgtagctatcctggtggaggttcaagggctcccggtgaaggcagcttcagtgattgattgcttagcttccaggccttgtttttacttgaattttgctcttggtggattccttccttttgtgcctggtcagtgatgtttgtaaaaatcttaaaaatctcatctagcagcagagttgttaatttggagggttgttcagggtatctagtttgccacaatgcagttcacaacctggtttggaacataacattgtgaattaggtgttgagtctttgcattccttaatcatggcaatccttgtcattgttcctgtgatataattg

SEQ ID NO: 158950 - DNA, 550 bp, Homo sapiens
caggtgtgccaagatccttcagcccttggaagcgggtgcctgagtggggtcttagctgactagagtgcctgggcagacaagagcagctccatcttctctttagagtatgttacataagcattaaatcgagggtgtgccctgacgtaaggaaagtagaagctcaccagcctgctgcactcacatcagcgagagggaacatttgcccctccatgcctactgcccttcccgcccttcagcctcaggttacaggaataaataagttaattaatcccaagtggggagagcctttgaagagtattaaaaggagaggaaggaatggttggaacctgttcccatcaggaacagatgagtaggtcaagctttattcacttttaaggaggaagggattcctaaaggacaaaccaaacttgcttttcagggcgttacaataaaacgttcttaaatcctgaatatcacacatttctgggaggaatgtcctgccctttgggaaaaatagcaagaacttcgagctccctctagaggccagcagtgataaaagagcgtcgtagtg

SEQ ID NO: 158951 - DNA, 462 bp, Homo sapiens
gttgaggctgcagtgagctgagattgcaccattgcattctccagcctgagtgacagaataagaccctgtctctaaaagaaaaaaaaagtctaaggggtgttctgacatccaattaggcaaaagcccttcaaggctggctatgcttcttgtaactgtactttcatcccacctcacacctccccaccccactctacctccaaaaaagaaactgacctaagcccagagccgatcccactgttctcagcctctttaccaggggaaatgagatcttaagaacagaccaaaaagtctccaaacctaacagcagtagggaatgctcacagggagctcgatgtgagcgtgacctcctcatttctatttgaagaagctgaggcctaattcagtggagacttgcccaaggtcacccaacccacgtgtgacaggacatggccaggatccagaccctaggttctttaggctatg

SEQ ID NO: 158952 - DNA, 194 bp, Homo sapiens
ctggggacggatggggttcagcttgctggaggggccggccagcctccaacctcctcacagggagagcctccctctccactctctccccagggatggctcttgggggctcaagggagcctgggcctctgccagcctgcaagctgcctccaactctcagtcaggatttggatgcccccagtgcagtcctgaggccg

SEQ ID NO: 158953 - DNA, 421 bp, Homo sapiens
cggggtttggtcgtcctggcacttccgcaagcagcctttccagctgtagctccggaaggtgctctgacatgacagttcaaaaacacacttccccctggcctgggcttcaacactcacttgtcagaaagtgaggtcctgtatgccccagtcctcggccagagaagcaagaagcagatttcccagaggctgtggccccttgcattggtgaggacactggggtgctacctctgtttgaggggtgactgacaactgtgctttcttagggtggagttggtctgctgtcgtgactgtctgcttgagatactgacccctggcgatcagattctggaagtcctctcctgaggctgctgaagtcgtcccagaggcttgtccagccacagcagtggagaaagatccaatcaggcaggcaggggcaaacggg

SEQ ID NO: 158954 - DNA, 442 bp, Homo sapiens
ctattgctcagtctccttgctactatgtcctgccttggtttctgtaactctcccagctcccctcatcttcaactattccttcttagtctcctttgtaggctcaatttcctttctatgtcccctctctcatttcatcctctctcattttccagcctccttcagttcatttctggaagctctttcttctctcattctcctactctccaaggaaaattttatccgtactctcagcttctttgagctctctctaggtcccaaatctacatccaactgctttctaggatctctagatgttccccaggtgctccaagctcaaccatacaaatgaaaatacagtatgtcctgaaacctgctcttctttatgtatttcattatctacagtaccaccatcactcaaaccagaatctcaggaatttctcctctccttcaccgtgaaaggatc

SEQ ID NO: 158955 - DNA, 397 bp, Homo sapiens
gacggctcatcagcacagctctgacctgccagcctcccccacagctgcctccagcctccagagcggcttattcaggaacagaggcagatgcagtgtggagcgcagctgcgtgagggttgcgtgggtgtgtctccatgggagtgtgtacagtgtgcctatggtgtgtgtatgtgtggtgtgaatgtgtaggtttgtgtgtgcacatgtgagtgtgtgtgtatttgtgtgtgtatgctatgtgtatttatgtgtgcgtagttgtgaatgtggtgtggatgtgtgtttggtgtgtgtgtgtgtgaatatgtgggtttgtatgtctgctgtgagtgtgcagcattatgtggtgtggatgtgtgtttgtggtgtggatgtgtggtgtgaatgtgtgttcatg

SEQ ID NO: 158956 - DNA, 129 bp, Homo sapiens
gccattcccaaagcatcctggtttatggccagagaccagtgagctagagtaactctaataacacctgcacgtaatggctaaaattgctttaataagggatagagactttgacgtcgacgcggccgcgaa

SEQ ID NO: 158957 - DNA, 230 bp, Homo sapiens
ctttccccttcaagaagcttagattagtgtgattaaatcagtgtgatacagtggtgataagagatccagcactccactcgacatcattgtccgttgtcatgacaccaagttacagcatttgatcaatggttcctgtgccatgttgcagtacacttggctcatcttagtctttttgtcaagctgcctttcagcgacctggttctgcaaagtggttgtggcagccattggat

SEQ ID NO: 158958 - DNA, 493 bp, Homo sapiens
attccagatcccaagcctcctggattccttcagagggtctgcccatgccctgaattccctcctaactccccacctgtgccctcggtcccctgggtggtgcgggaacgcacatctggtgggtgtgagcaagcgtggcccgtgctggtcacgctgtttactctccctgaagatggacagtagggcttaatctggtccaggtcatgagacctggctggcagcctccaccattagacaactcccaagctcatcagacttttcaatgatgcggcttcattctcattaaaattaactttctggctgggtgcggtggctcacgcctgtaatcccagcattttgggaggccaaggcgggtggatcacctgaggtcagcagttcgagaccggcctggccaacatggcgaaaccccatctctactaaaaacacaaaaattagccgggtgtgatgggcgcctgtaatcccagctacgtgggaggctgaggcagaagaatcactt

SEQ ID NO: 158959 - DNA, 397 bp, Homo sapiens
cactcgctctactcagccaccaccctggattggcttccaaccaagttgtgtttgcttttccctctgcctgaaatgtccttccaaaggggaccgtgtggctcccttcctccctccttccctcccttccagcaagtcttaggtctcagctaaaactgcctttgctctaagtcaccttcattgcctttgacatggcacaccactgcctccagcactccctccttatccttcctccctgtttattttattttattactttttgtttatttattttgagacagagtctccctttgtcacccaggttggagtgcagtggcatgattttggctcactgcaacctgtacctcctgggttcaagtgattctctcctgcctcagcctcccaagtagctgggattaca

SEQ ID NO: 158960 - DNA, 585 bp, Homo sapiens
agcccaaagtgaaaaagaatgatccagccccaaatgtcaatagcactgaggtggagaaactctgctctacatgttctaataatactcgaaatttttccattacctcatttacataccacctttccctgaaataacttttaatcactcaaggtttttccaacacatgtgtgatgtggctgggggtctggttggatttcttgacttcacagatgaagctactgatcaaccacaggaagcagctaaatacagttgctcagactgaaaaaccaagttgctgcaggactacatgctcatccgcatatgctaagtacattttccacatttggtactttttatggggcaaataaaacccacgttgctttctcaagatcacacaaagatcaatcagtgttctccattgaaatgtcacccaactcagggaaaagcaaagaaaatgtgcctgtctgttgaggttgaggagtccatctctgggaaggggcagtgagatgatgagtattttcatgtctcctgaaagtttaaaaaacatgaatttttaaattttcaatataatagccagaaaaaaatctattagttttcacttgggct

SEQ ID NO: 158961 - DNA, 210 bp, Homo sapiens
tcaagcactgctgcaggcaatgaaaagctaaaataaaaataactgaaccaagcctgggcaatgtggtgaatccttaactctatgaaaacaatatatatataaaaatcagcagggcgtggtggcacatgttactcgggagtctgagatgggaagactgcttgagcccagggggtcaaggctgcagtgagctaagatcgtgccactgtattc

SEQ ID NO: 158962 - DNA, 875 bp, Homo sapiens
tgtaaaaagttgtactgagaaaggatgaagacctaaacaactacagaaagaagattacagtgtttgaatgacaggaaagcattgaactatggttagctgtctgttgcagtaaagggaagtgagttagctcaggaggtgaagacgtttaatgtgaaagtggctgcaggtagttccatgttgtgtcacaatgccattcactgtgctcctggatgtcacaattacactgaagtgtacagggcaaaaggctaattttaaaattagccaaataactgggagagagttgaaagtaccttatgtataatttctcttctgctaacttagtatgcaatctaaaattcttgatttcttgatttttttcatattttaagtaggaataatttctgacttgcctacatctcagatttattgtaaaatgatagatgcacaagtattttgggaacccaagtcaaaaatcactttaaaataattatttttattggaatatatataatcaagatttgatatttaccaatatcaatactcaaacaggcggggcgcagtggctcacacctgtaatcccagcactttgggaggctgagctgcaccgatggctcgatcccaaggagttcaagaccagcctgagcaaaatgacgaaaccacacctctacagaaaatacagaaagttatccagggataatggcacatgcctgtagtcccagctactaggggtgggtggggggtttgaagcgggaagattgcttagtcctgggaggttcaggctgcaataagccattatcacaccactgcactccagcctgggcgacagagcgagaccttgtctcaaaaacaaaacaaaacaacaatgacaacaacaaaacacctctaaagcagcaatt

SEQ ID NO: 158963 - DNA, 375 bp, Homo sapiens
gcacgcaggaaaaagtacccgtcttagcccctgatcacgtgctcctcgtccaggtaacctcatctccagaaaaatgaggctgaggaggtttgactaatgattatgcttatcccagaataattttctagatttctgtcaatgccttcccttcctcagataaatccagtacaatcatttcctacgccatcctgctttaagcacagcatgcaggagtggcgggagcttagagttaagatctggaaactcccaatcaatgacttgccctgtcatcttgagcagcggcttcccggacagataggattccccgacacaaaggcaatcatcaccatctcagctctgatggagcaagccacttaacctcgtgaagcctgtttc

SEQ ID NO: 158964 - DNA, 457 bp, Homo sapiens
ccatatgatggagtctgcacattcagatgatagacactatatttcctcctttctttattgggcttacaatgtcataaggatatggacttcttaggaaaaggtagtgatttgaggaattctaaactacaatttaaataaccatcctgctattttgagcctttggcataccatacactataattttgtcgctgtgtctgtgtaacacaagataactgatataagcattttatatatgttcatgggttagatgtgaatctttatccaaacatgctgtagcctgcctgattccttatgggccaggaaggcatttagaatactaagatatatttccaattgtgcttgctcagatcaaattgagaataattgtgggatccctgggtgaattttaaacaaatcagagggtaacacagccaatatttgagccacgtagctggctcttacaatgaaatgtctatag

SEQ ID NO: 158965 - DNA, 618 bp, Homo sapiens
gtaaagctctcagaagagtacctgtttattagcacacgatgctatataaatgcttgctgccattattataatgccagataatttggcaggaggccaacttgtacaaatccttacaaatttcaaaagacaatgtccagaaatacagttaggtactaaaatgagttattcagaaagccttatgagacagtttttacacaaccagtggcaaaactatcacaaaataaaaatgcttcaactataatctttagagaaacttgtggcacactctgagccatgaattatatgagcagaagagggccttgagaacttcatatgctgtgaccaaagaggcagatgtacgtggcaaactgattcttctggcaccactcagctacaaatctgccctgaagtatgtatagttatggagcttgcccacaaaactactgggatagtaaagggtgaggtaacgatgctttcaatattgattctttctctaatttcataaacactgtatttctccaaacatctgatgaaggaccaaaacagagggctatcgttcactacccatagtgaactggtctttctgccattggaactctctgatattggctcggaaatctctgagtttggaaagtctga

SEQ ID NO: 158966 - DNA, 381 bp, Homo sapiens
aaggactgcgccaggcatggcacccgagggaagagtggcacccccacctttggtgaggttctccatgcaggacggtgccctgagtggtgtaggaggccctgtgccgggtgagcctgccagcaggagtcatcggacaatgtggttgccaggtgtggccgctcagctccgaccaactccgaacctgtgtggtcagaatcacacaggacaaaccaggggcctgtttagccccttcaggctgcctctgatgggagagaggctggatgcatattctgagaaagtggttctgtgttattgaggttgttatgacctaggctacagttgaaagtcatctctaagcacttatagtagtatttgctaatcacagtattgctaacacaatag

SEQ ID NO: 158967 - DNA, 172 bp, Homo sapiens
gcagttcaaggctgcagtgagctatgtttgcaccaccacactccagcctgagtcacagaacaagacctcatctctaaaaaacaaacaaaaaccaaatccacatatcctaaaaaatgctccttttcagcattctcttctctatggacaaagggctggatgctttaagaaccaa

SEQ ID NO: 158968 - DNA, 331 bp, Homo sapiens
gcaaacatatctatgtttctgtgttttctgctcactctcttgatatgcttgtatgtactgctgttcaatgtatgtctctttaatatgtttcaacatatttagaatatattttgaaatacattttaaagcatgcttagtcacttcatttctatttctcttttatggaatgttgatatattttggcaatgtagataattttatctttttgacaaatctttcctcaactaaatcacctgtttatttaattactgtcactaacaattacaagcaaatacaaaaataaaaaaaaaaccttcttggcaattttaaaaataatgattgtcataaaaca

SEQ ID NO: 158969 - DNA, 136 bp, Homo sapiens
tccttgctataccctgaatccctcttcctcatccagccaatgatagctttctgtctctgtggattagtttgcgttttttagaatgttatgtaaatggaatcatgtagtaagttctcttctttgcctggcttttgct

SEQ ID NO: 158970 - DNA, 361 bp, Homo sapiens
tgcaggctctgagaaccactccccagacccccatgaaatgccggcagctccagccacaccccagctcactttggaggcctgctcgaggctcaccgcctccaggaaggcttccccctgagcccaccactgtcacccacccctggtgccctctccgcttggctccaccagtacctagtgatattgctcagggtgcacaccctcagccgttacaggcctttctcccctccctcagcacttaggttgtgttccccaggcaggggctttgtctctcccatcaggcgagagctccctcgggaatactccagaacacagcccctcgagttctagggctgtatcagaagtcagtactttctctccctgc

SEQ ID NO: 158971 - DNA, 367 bp, Homo sapiens
tttttttattttttgagatggagtcttggtctgtcaccaggctggagtgcagtggcgcgatcttggctcactacaatctctgcctcccaagttcaagcaattctcctgcctcagcctcccgagtagctgggactacaggcgcccaccaccatacctggctaatttttcgtattttagtagagacagggttcaccatgttggccaggatggtctcaatctcctgacctcatgatccgcctgcctcggcctcccaaagtgctgggattacaggcgtgagccaccacgcctggccaatgtctgggttattaaagagtaaaggaaacagagcaggaggggaggggctgcactaagacaaaaagggaaagga

SEQ ID NO: 158972 - DNA, 387 bp, Homo sapiens
cttcacaacacagttgaggcaagtacaacaggcattattctccacttcaaagataaagaaactggagctcaggaaggttaaatgtcttgtacaggtcaaagtccatggtgagttttaaccctattctgagtcagatttcatagctgatttcccaaaagtacaccactttaattttacccatcctcctttctatattttcatttcagttgaaaggagttattaatcatttacaatatgtaaagcactgtgtaggagatatcaggggcatttaggaaaaataaaaaccaaaaaatcctagatttctagtgggtttactgggaagacatactaataatacataaataagtccaacataagacaaacggtaaattatcagacatcctaaca

SEQ ID NO: 158973 - DNA, 401 bp, Homo sapiens
gaacaatcgagctcggacccctccataatgtgggcccaccagcataatccagggttaattcacagccttaattccacctgcaaccttaatgccccccacttttttttggagtcagagtcttgctcttgttgcccaagctggagtgcaatggtgcaatctccgctcacggcaacctctgcctcccaggttcaagcaattctcctacctcagcctcctgagtagctgggattacaggtatgtgccaccacacctggctaattttgtatttttagtggagatggggtttctctatgttggccaggctggtctcaaactcctgacttcaggtgatccgcccacctcggcctcccaaagtgctgcgattacaggcgtgagccaccgtgcctggccaacacatgatt

SEQ ID NO: 158974 - DNA, 203 bp, Homo sapiens
ctcaccatgtcccgttcccctctgcaccctgcatcctctaggcctttccaggggctgtgttcttggcctggggtggtcttttctctccttacctggctgacagttacttgtccctccgcaggggaccatgttcggacccccaggccagcccactgctgctccttggcactttcacggccctggcgtgtccccgtcatagctca

SEQ ID NO: 158975 - DNA, 502 bp, Homo sapiens
tctcacactactataaagacactacccgagattgggtaattcataaaggaaagaggtttaattgagtcacagttctgcatggctgaggaggcctcatggaacttacaatcatggtgaaatgggaagcagtcatcttcttcacaagacaacaggagagagaaggattgtgtgtaggaggagctgtgaaacacttaacaaaaccatcagatctcctgagaactcactcactatcgtaagaacagtatggcagaaaccgcccacatgatccaatcaccttccaccagatcctgccctcaacacatgggtattatgaagattacaattcaagatgagatttgggtggggatatagagccaaaatatatcattccacccctggcccctcccagatctcacatattttttacatttccaacccaacatcatgccttcctaacagtcccccagagtcttaaatcatttcagcagtaactcaacagcccacagttcaaagtctcatctga

SEQ ID NO: 158976 - DNA, 239 bp, Homo sapiens
ggcaaaggtgggagcaggtggttgtggggagagaggcagggagaccagagctggctggagcagaatgaatattgacgggagtagaggaagctgggaatattgaggggagtaggggaagtcagaggaagctggttcctctagggtgggctcttatggctagtaaggactttggctcttactttgtgtgaaaatgggagctattgcagtgtttggagttgtagaattctaaatgcatagtg

SEQ ID NO: 158977 - DNA, 469 bp, Homo sapiens
ccctaaaaatctaattgtaactcgaaagtaagatagagagacacaagtaggctttcacatagcttggctgtgaaaagcaaagattaaagcaagtgctgggattacaggcatgagccaccgcgcctggcctgaaaccccatttctttacaaaaaaagtgggggaggccagatgtgtacatgtttgtgctctaagcagccaggagctgctgtggctggtgcatggtctgagcacatgtgggctgctgccctgatgggtataaggcagaccctccactccaccagcccacccggcggggacatcagccagaaagatggtagccattgagttctagctatgtgggccttggtttcctcacctgcaaaatagccctgatgatctcaagggtcctttcccgctctacagctcttcattttgggcggctccctaactgatgtgctacaacgtgctgtgcacttttctagggaccat

SEQ ID NO: 158978 - DNA, 411 bp, Homo sapiens
ttttgtattttttagtagagacggggtttcaccgggttagccaggatggtctcgatctcctgacctcgtgatccgcccatctcggcctcccagagtgctgggattacaggcgtgagccaccgcgcccggccgaaagcattgccttcttaacccaatctgatccacggaaaactctaagggtagcctgaacactcgcagtgctttggggatggtttggagggcaggtggtagtgggagatgttacaaatgaggaagtgacacaaaactgaggcaggaggcactgaaacagactctgcctgtagtatgggggcccaggatggtccaaacgaatggctttaatgcctctgaggaggcaggaaggagagccctgcagaaccagccccaaacatgtgctcatctgtgctccctacc

SEQ ID NO: 158979 - DNA, 407 bp, Homo sapiens
cttcagttggccctgtatgatgttgtcatatatagaagagtctttgtctgcaattagagtttactcatgaaagattccattctgacctttggggtgtgcagacttcaattgtatcatatccatctaaaagaaagcctgtttgttttgtattgaggtagaaattacagattatgaagagaaaaactctaagagaaaactcttatttttatcaaatagacaatgaaggcatggtagttcagtagaaatttgctaaatcagtgtctgaatgatttcatgtacagattttagatttatggtatcagtattccagatctccaaacaagttcacacagaccccagtagatgcctgtgtgacacttgtcagtatcctcactcacatgtcagagtttaatcaaatctggtttttc

SEQ ID NO: 158980 - DNA, 198 bp, Homo sapiens
atgactgtgagaatggagtttgactaacatttattttttaatttatcttgtctacttgcttgatgagtgtctctttggcagtagctgcttctgtgggcagtaacctgatttagaaggatctccacactttgttcccactccatgcctcccacgcatctcatctgcatgcctctccccagacctctctgaatccaatct

SEQ ID NO: 158981 - DNA, 268 bp, Homo sapiens
tgttgaaagcggagagaaagcatggaaatggcacactggctctcaaatgcctggatgtgacaaacaatgcttctgctcctgtattggtgtaaaggaaaagtcacatgatcctaactgcaaggactttactgttcccatgtgtccaggaaggagacagagacaaaatgtgggtgagtactatacccttccccataaactgttacatagtgggtgctcaacaaaaagcaactatgatcatttggtattatactacccttctcatttctag

SEQ ID NO: 158982 - DNA, 490 bp, Homo sapiens
tttaccttaccctccctacccttatgtttctcactgcagttttgtccaatatacctgtactcctccccagctccatcccccatctttaccctcatctcctaccacactgacgcccagggcaccttatgtgtccagctaagtcatattcattattcctgaatgctcttctttttcaggcccatgttgttaccccagtaatgcccatctctactttttctacctaacatatttattattcatgacccaaatatcctttgttttaaaagaaaaaaaacctcctttactatgtaaaactattatttacactgcctcaaaacattttgttatagtacttactgtgtgtgtatatattagcaagtcttacttaccctccttgtttcactaacttccagcacagtgcctagcctatggtagatggctagtaatttattctaattagaacaaggtggatgtatttattatctatctttttgaagtttagatttagcat

SEQ ID NO: 158983 - DNA, 719 bp, Homo sapiens
tggcagccggctcgggtccccttccacaccatggaagcttgttctttcgctctttgcaataaatcttgctagtgttcactctgggtccacactgcctttatgagctgtaacacttaccgcgaaggtctgcagcttcactcaggaagccagtgagaccacgagccccagaagaacgaacaactccagacacaccgctttaagagctgtaacactcaccgggaaggtctgcagcttcactcctgagccagcgagaccacgaaccaaccagaaggaagaaactccgaatacatctgaacatcagaaggaacaaactccggacacgctgcctttaagaactgtaacactcaccgcgagggtccgtggcttcattcttgaagtcagtgagaccaagaacccaccaattccggacacaatactagtacatgaaatgataggcttttcatggactttgaatatgggtcattttagcttcctcaagtaacctgttctagcctttaatccttaatgtcagaaagttattcttttacctaacaaaattcatttgattttgaccaatttaactttcatagattataacaaattactatttgacagagcattagaactccagtaaccaagttctctgattttacagataaagaaacaaagcttcagagaggtaagtgtattctgaacacataaaagaaggcaaattcagacgtgtgatttgcaaaagtttt

SEQ ID NO: 158984 - DNA, 144 bp, Homo sapiens
gatctggttgtgtaaaagtgtggagcatctcccccatcaactttctctctttcttgctccattctcaccatgtgatgtgcctactccccctttgccttctgccatgattgtaagcttcctgaggcctctgaggaaaccaagcag

SEQ ID NO: 158985 - DNA, 399 bp, Homo sapiens
gtactgtgaaactaatatatctgagacaggtttcagtaaatttagaaagtttattttgccaatgttgagggcacacacccatcacacagcctcaggaggtcctgacaacatgtgcccaaggtggctggggcacagcttggttttagacattttagggagacatgagacatgagacatcaatcaatatatgtaagataaacattggttctgtctggaaaggtgggacaactcaagcagggagggggcttccaagtcacaggtaagtgagagacaaatgattgcattcttttgagtttctgattagtctttccaaaggagacaatcagatatgcatttatctcattgtgcataaggatgactttgcatagaatgaaaggcaggtttgccataagcagttct

SEQ ID NO: 158986 - DNA, 375 bp, Homo sapiens
aagctggggagaggtgcaaacagtgttgtggagtgctgcttcatttaaacaaaagtgaaaatcaatcatattttcatctggcccataatcaaacacaacagggaagatgataggagataggtggaatttgtggtattcactaaaataagcagcaaagaaattaatgacaaaatacactcaaagcatacagtccagactttctggctgaactccttggtacagataaaaaacagatctacaaagtggtaaagagaattattttacattatccacagagttatggacagacaggtcgcaagagactccaattttcagaaataatttacaacgaatagtagatatcttacctgacacccagcttccaaagcctatggt

SEQ ID NO: 158987 - DNA, 509 bp, Homo sapiens
ttgttcaggaaaagggtaaaaacagatggatgaagcgcatgtggcaaaacccagcagagtgttgagttttggtgacgatcatttggagattcgctgtgctattctactttattaaaatttaattgaaaaaataaagctccccagaggattgtgatgtgcagtcccctttggaaccactgtcctatataccagctacaaggacagggcatgcctggccctcctaccaagggccatgtacacaaatggaagccagcacgtgacatgccttcctgccacaggctggggttgtgggactgcaataggggacacaagcaatagcggggacatggacacacgtgaagatgccaggaggcagcagtgctgctggtggaggtattactaagtccccattatttttttttttagatgaagtcttgctccgtcacccaggctggagtgcagtggcgcaatctcggctcattgcaaactccgcctcccgggttcacgccattctcctgcctcagcctccc

SEQ ID NO: 158988 - DNA, 118 bp, Homo sapiens
ttaaagtccttcttttgtgagtatacttcccattaattttgcttttcatttacacacaactgtaggtcactaagccaaagtctcctctaagtaaagatggttaaggggatcccaattt

SEQ ID NO: 158989 - DNA, 989 bp, Homo sapiens
gaaatgaaaacatctatacaaatcctgtacacaaatgttcatagtaacattattcataatagccagaaagttagaaacaactcagattccaacagctaatgaatatatacattaaattaggttatgtccacagaatgaaatattattctgcaataaaaatgaagtactgatatatgtacgacatggatgaatcttgaaaacattacattaaatgagaaaagccagtcaccaaagaccatatgttatatgactacatttatatgaaatgtcagaataggaaaatctatagtgacaaaaagtacattagtggttgcctcaggctgagggtggggtggtggagtaggcaatgactacaaatgggtactgcgttttttgagggggtaagtaaaattatttttaaattagattgtggtgatgtttgcacattaaaggcctattaacctcataaacttgtcattagtctttgaagaaaaaatatgtaaaagaaaaatgtatgtatacataatgtaagaatttgtctctaaagcagcgcttaaaattctttggaaaagtttgacaaggtatatcacgtgaattcagattcatcttaaagaattatgcttagacaggaaaaaggaaacttattttggtctcaagtagaaaaatatattgctttgagttttatgtaggtttagacttttaaaatgttagaattgattcttactataagtgatttgtgaaattacacctttggtttgatcaccggtgattacagtgttattctcatacctttgtgtattgaactatttccagaaccaagcttatgtagatcctgaacagtaatatgagaatgtgattagtatttgtcacctttattttaaaactagcatctgaacacttcaaagctgtcaatgtggattggttagaccaataatctctgcttgatccttacaattaaattttgcaactaatagtattgttctttcaaacaggtgacatgttttccatga

SEQ ID NO: 158990 - DNA, 464 bp, Homo sapiens
tgaaacttcagactttttcacatgaaagtttttttttttctaaatgccttaaccttgggtatactcaagagtaggggatgcagatgaggacaaatggctaatgcagggcttaatacctaggtgacgggttgacaggtgcagcaaaccaccatggcacacgtttacctatgtaacaaaccacgttctgcagtgtatcccagaacttaaagtaaaataaaataaaataaaaaagataagatttggacatagaggcggaaacacgggaagagtgccgcgtggcaagggaggcaagatgggaatgatggtctacaagtcaaggaaggaccaatattgcctgcaaccacctaagctaggaagaggcaaagaaggacccttccctagagccttcacaccttgatatcagagttccagcatccagaactgtcagaaaataaatttttactggtttaagccaaaaaaaaaat

SEQ ID NO: 158991 - DNA, 156 bp, Homo sapiens
tcagggctgggagatggcagaaccttctcacaggggttgtgacagaggagttgggtagatgtgttctcagcatagatgtgttctcagtgggcaaaggtggaattcccttctcttttctgttttcgcttgacaacacaggcctgcagaaacagcata

SEQ ID NO: 158992 - DNA, 527 bp, Homo sapiens
cggcttctagcacggggcccagcacagaatgggagctgaggaaatgtttgcagcaagagataaaactgcttcacagtgtgtgttatgagttgaactgtttcccccaaaaagatatgttgaagtcttatgacctgaattgtgtttctccaaaatccatatgttgaagccctaacccctgtacctcaggatgtgactgcatttggagaaagggcctttaaagaagtagtgtaattaagttaaaatgaggtcatgtgggtgggctgtaatcccatctgcctggagtccttacgagaagggaagatatggacatagccatgcccggaggaaaggccaggtgaagacacggggaggagacgttcctctgcaagccaaggagagaagcctcggaagaaaccagccctgcggaccccttggtcgtggacttccagcttccagaactggcagaaatgcatttctattgtttaagcccctgggtctgcagtactttgttatagcagtcccgcaaacgaatacaaagtcctaacccc

SEQ ID NO: 158993 - DNA, 907 bp, Homo sapiens
agtgagagattgcagttaaaagctgtttattactaaagtgaaggccagttatcaggaggatctgaacagggaaggaaaatgggctgaaatcacaagtttgagttgacagctgaatgtttctagggagtcaaatatccctaggattcaaattgagttaactgggagtggcaagttgattgatagtagtgaggacagagagacagtcaaagaaaggttttagctctgctgaatatttagtcccaaaggaacatccaggtggtgatgtccagtagttgggaatgtagaactaaagtgaagaagaagggaaaccaaagaaaaagttgatagtttttgagactactggagtggctgtaatttaccagggagagagcaaaaaagggtgagagaactagtggcaaactttggtaacagttgcatataaggtgcaggtggtataggtggagaaaaagaagctagaggagaggtgatcagaaccaattgtgtaaattgttgtggaaactaagaaaaagaaaaattttaaagaaaaggaagaaaaagtttaaggataattgatagagcaaagtcaggaaggagacaggaggattggatccaaagtaagtatacagatagagggatattttctcctctgaagtaagataatactaaaaatgatggtagggagaaaaggtagcttcatattgatctttttggcaaataaggtgatagcatgcacagagtaaaagagagtagggagagtagactttagggaaacaggaaagatttacagctgatgtttgagagacttagttgtttacagactgatcaaaagaatgctaagcagccctgaacaccttgccaaagatggatggctaacttgatgctagatccaagcggcaagctcaagagcaggaaagggcaatatggggct

SEQ ID NO: 158994 - DNA, 853 bp, Homo sapiens
agtgagagattgcagttaaaagctgtttattactaaagtgaaggccagttatcaggaggatctgaacagggaaggaaaatgggctgaaatcacaagtttgagttgacagctgaatgtttctagggagtcaaatatccctaggattcaaattgagttaactgggagtggcaagttgattgatagtagtgaggacagagagacagtcaaagaaaggttttagctctgctgaatatttagtcccaaaggaacatccaggtggtgatgtccagtagttgggaatgtagaactaaagtgaagaagaagggaaaccaaagaaaaagttgatagtttttgagactactggagtggctgtaatttaccagggagagagcaaaaaagggtgagagaactagtggcaaactttggtaacagttgcatataaggtgcaggtggtataggtggagaaaaagaagctagaggagaggtgatcagaaccaattgtgtaaattgttgtggaaactaagaaaaagaaaaattttaaagaaaaggaagaaaaagtttaaggataattgatagagcaaagtcaggaaggagacaggaggattggatccaaagtaagtatacagatagagggatattttctcctctgaagtaagataatactaaaaatgatggtagggagaaaaggtagcttcatattgatctttttggcaaataaggtgatagcatgcacagagtaaaagagagtagggagagtagactttagggaaacaggaaagatttacagctgatgtttgagagacttagttgtttacagactgatctgctagatccaagcggcaagctcaagagcaggaaagggcaatatggggct

SEQ ID NO: 158995 - DNA, 164 bp, Homo sapiens
aaatcataattccagcgagatcacctcacacagagcacttttcaatactcttcaaagatattcacatctacaaacactacctcggctgagttctggagaagaggaaaagcaggtttcagcagcacaattttatacacagagagggacgctgggcactgcagctg

SEQ ID NO: 158996 - DNA, 130 bp, Homo sapiens
aaaagctatggattttgtcttagtataagatacacaaatgtataaacctttatagtatgtacaaagctcagtccctaaatgtttgtaagaaataaaaaaaattcttcctggttttctaaataatcttaat

SEQ ID NO: 158997 - DNA, 412 bp, Homo sapiens
gtccttccttcttcaactgagatgcccctgatggagcaggtggcaaggggtcttagaagggtctgacagccgtccacagccacaaggctgaagaacccaggtggtctgccttgtcttctgggggtctgcagacagggtcccttccactgcagctcctgggcagacctggcccaaggctttgagctcccttataggccctgggaccttaggcagtgatgggcttctctgagcctcagtttccttatctgtaagatggatacagaggacccctcccaggggttagacagaccagtgtgatcagtcaggatctggtttgaggaagctgagccaggctgctgaggaccgaagccatttctgctctgacttggtttccctcctgtggcctctctagtcctatcctgcttctggtggg

SEQ ID NO: 158998 - DNA, 256 bp, Homo sapiens
gtcacctcccaccagtctccacttccaaccttgggaattacatttcagtatgaaatttgggcaggggaacacatctgaatcatattactggacaattgttgtggtcttttggtggtgtcatatttccctgcttttttcatgtttcctgtgtcattctattgatatgtacacatctggtgttccaatttttaaaatttgcttttgtagaaaaatatgttttcctgaacttccaacactatgttgaataggagtggtg

SEQ ID NO: 158999 - DNA, 431 bp, Homo sapiens
cgttactttcttgtttacaaacctaaatgattacttcatttaaagaaaatctaaactttgtggtttggcattcaaggctttctgtgatctgattccaatcaagtactctaagcttatctccttctgcaccatatgcatgcactttgtctgcagggaagccttcctgctactttccacgctgttctctcagtctcctgtgtttttgctcatattctcctctctgcctggaaggcccttctcaccaatccttatatcttacaaccaggtcacaaggggggtgtagacttacccattgggcagatgagaaaactaagccccagagaaattaagtaacctgcctgcagtctttcaggacctaagtggcagagtaaggtttcaaactcaggtccatgtgattctctgtatcccttacccagggaagactcctcaga

SEQ ID NO: 159000 - DNA, 489 bp, Homo sapiens
ggttgaccacagtggactattacattgaacttggcaacacgttccaaaaatcactgtgactcttggcaacaaaatagatgaaattgaaaactagttttgaggtgttagagatgagaagcaattttaggaatattcaattgtgaagaagatggaatggtagggaaaagtggagttaagagaaattttattaccattatgatttgattttaaaatgggagaaaaagcatgtagatatgctgatgagaaagatccggtagagaaggaaaaattaataatgtaggagagggagaaaaattgctagacaaagtcattgagtgggtaagagaaagacctggcttacatccagagcaatttatctacagcaatacaggatgaaagagaatacatgagcatagaggcagttagtatggaggagatggtggtgggagcttgcctaagttctcttgtggctttcatttcccagtgacacaggaagcaaagtgaacaact

SEQ ID NO: 159001 - DNA, 318 bp, Homo sapiens
caaaatcatttttggagaaaggcgtagacctgtctcctgggtgcgtccttaactttggcaaataaatctcctaaaatgattagagacttgtctcgtcgttttcttcgattgacaatatatacacacatacatacgcatacacacacacatatatacgcgcacgcacatgcacacatatacatgtccacacaaatgcacacacacgtacatatgcacacatacacatgtacacatccacacgcgcccacacacacacacacacagacgtgtctcacaccacagcagccgcctcgggggagtcacagcccacgcatcccc

SEQ ID NO: 159002 - DNA, 263 bp, Homo sapiens
gttgagcgggcgtgcccctcacctcagcccctccagagtagatggcgcgacaccccacggttctttgctgacctctccagcccgcgggcgcggcgcctcttccccgcccacttccttcatgctgggcagtgaagttgatgtagaagaaaaaggagtgtgttttattctgggctcaactgcgcccctttttaaggtcacgtgagatgagtggttgcggacttccttaaatcgctcagagaatatagccaaaattgggctgttgg

SEQ ID NO: 159003 - DNA, 1169 bp, Homo sapiens
cgggcgagtggcactcgggtgtggggagcgggagggcaagagatgagtgccgggcaagatgggcaggggcccgtgccctctgcacacatatataaatataaagaacacctagataaagtctatatatctctatatctatatgaagtcatagtttgctttatttttgtacctgtgcttagagatgttttgagcagtgctaccttcccaggcagtctgggatactagctcatgccttgacgccacctccttccctgctcttcctttggtattctctctgttcagagttgcttgggtctttctgatggaaatgtgtatatatgaaaagtttgtaaaataacaaaacaaataacccacctgcaggaaggacaagtgagctgaaggttgtgtggagctgcaggatctgatagccctaaagaaccaggaccaatgtgtctcttgccacttgggagggatgttgacttgaacttctttgcagaggggcttaacagggcaaggctgaggagatgaaaactgtgactccatccccacgtggctgtggaaaggtaaccagttcctcagagaaaacctggcttcacagcattagaaagggggtggttgagactacctagggacctacggtgacacctgtcttggtttgtagcactgtagctcagacagctcagaccgctcatagagggcatggcaatgggagagtttgtgaggctggctgcctgggcttggtcttggagaacacatggcctgtttagtgttgctgcagattcttagagccagtgtgaatgtggtatgtagtataaatatgtcatctatgtttttttcagttatttttaattggaaataaagtgccattgcaaataggatgctccaatcctgggacactgagtggaggatgaggagggagagatgaactgtgggccggcctgggagagggggtcttagtggaaccttccttctggcctccagccggggacttacaaaactgaacaatgtattggcagaactggacccacaatgggagattctggggagcaggagttcacttgtatctgagcaggaagcagtgtgccctgaagaatacctctctgagcaaattccagacctcacacatatgcaagggctctgccttgcagcctcagcaagcgtctcctggtgctagctccttcctgacttgc

SEQ ID NO: 159004 - DNA, 446 bp, Homo sapiens
tttgtattttcatatagattttacaaagtgttttgtcagtttgcacaaaaaggaaactgctgtgctctgctggggctccacatctttgtgcaatgatttggaaggtgcctccagattgaaccactggtgattgtgggactcaccttatggtgtacccttatgtcacaggttatagttctctgatacctgttgtcaaacatctcactttgatgcttcatatattttgtaaagttttatagttgtttcaagctggatagttaatacagtgccagttattcagtcatagttggaaacagaaattatacatagaattttacacccagaattctatacaaaatgtaggagaatattatataggaaatatgacttgttcttatgtttttcttcaacagttcagaaatgtagattggaactatgataatataatactatgtaaacagaaagtg

SEQ ID NO: 159005 - DNA, 469 bp, Homo sapiens
cctctctcacgctgttctggtgacagagctctcaggagatctggtttcaaagtgtgtggcacctcccccttgtctcttcctcctgctcctgccatgtaagacatgatgcttccctttctgtcatgattgtcaggatcctgatgcctccccagccatgcttcctgtacaactcgcagaaccatgagcaattaaaactcttttctttataaattacctagtctcaggtgtttatagtctgagatggactaacacagcatccaaacaggaaaataattcaatccatctgtcttcactgatgatacaattctatgcctagaaaatcccccaaagtaattctagaatagataaataactttagtaaagtgtaaggatgcaaaatcaatgtacaaaaatcaccagcatttctatatcccaaccacatccatgctgagaataaaatcaagaacacagtcctatcccatgtacaata

SEQ ID NO: 159006 - DNA, 708 bp, Homo sapiens
ataacacaaatagtcctatatataacaaagaagttgaatttataggtaaaaacctctatcaaaaacataaagaaataatgccaattctgcaaaaactcagaaaataggagcgaacacttcaactcattctatgagatcagcattaccctgataccagccaaagaaattacacgcacacactgtaaaaaatcttgtgaatagcacagttataaagacactgacacttaaaatggatatttaaatatcatcttgtggccagacttagtggctcacgcctgtaatcccagcactttgggaggctgacgcaggcaaatcacttgaggccaggagttcaagaccagcctggccaacatggtgaaaccctgtctctactaaaaacacaaaaattagccaggtgtggtggcacacacctgtaattcctgctacttgagaggctgaggcatgagaatcgcttgaacctgggaggcagaggttgcagtgagctgagattgcgccactgcaccccagcctgggcaacagagcaagactctgtctcaaaaataaacaaataaataaataaagataattacatctaaagatgacaagtaaaacaaagctgtcattcaaacaaaattagtaaaatatcttatctctgattgggaattctaaaggaacattttgccaccaaaattctgataatccccatcagccccaaatacttcaattgct

SEQ ID NO: 159007 - DNA, 293 bp, Homo sapiens
acacacacacacacacacacacacccctactccttcccatttgtgtcataaatacagtgtcatcagctatatcctcatatccaggagcaaggtggaactagttctttgggcttccatagcagaatgaaaactcaggcaactcacattcttggtcatagaaggtgagttcttccctgatctcagaatccaaatggtagtagaatataaaatcaatgagtttgtgctggtccttagggtagatttcaggaaaaattagaaaggaaatgaagaaaataaattgttgggtttttttc

SEQ ID NO: 159008 - DNA, 611 bp, Homo sapiens
  misc_feature (611)..(611): n is a, c, g, or t
gagagcagtggcccatctctcccatcctcactctgtgcagcctgaaagcaggcaggtaggctacctgtcctacctgtgacatctggaagtgtttctgcttagagcatcggtcacaactgaccttacaaatgagcctgtctcatgaataaacaaacatctccttcttactcccccaggcccttcccttgggggaacaaaggtgtctacctctgggaccacgcccccctgcagtcttgctcacttgtgcaggaggccagagactgagcttttatttatttatttatttatttattttagacatgaagtctccctatgtcgcccaggttggtcccagattcctagcctcaggcactcctcccaagtacgtggaattataggcataagccacggcacctggcctcctaaacttatgagtgttccaacttgtaatagactttgaaacatatacaacttgttggtgcgtcccaggccaatcctcacatttggctttgattagcctttatcaaattattctgcctcaacagacttaattttggtcaacaatttaactgaggtactttatagataacagtgtccattataccacaggaaatacttcagtgtttaaatan

SEQ ID NO: 159009 - DNA, 258 bp, Homo sapiens
aagagttcttttgtagatttaaaaaaaaaaaggaagaaggaagaaaatgactttcccttctttgccctcagtggtgtggattcctttatacatgtattcaatatctctgaagtagtcgttgtaaaatgactgggggtggtgggaggtcaggaaaagactagtaaaaaagaggtttatgggcatttgagggagatgagaaggacttccagatgcacaaaagccaagcttcgaggaaagggagagaagccctgcaccagg

SEQ ID NO: 159010 - DNA, 395 bp, Homo sapiens
agcttttccactccacatgccaataaattcctttgtgtttgtttgtttaggccagtttaaactgggcttctgccatttcctaccaaaaatatcccaacgcagcctatttgtgccaaatagctgagaatctgccacactaaaataagaacatggttgatgttggcaggtttgtgaaagcggccgaatgtcattaccttgaattcactgttttgtttgttttgttcagtgtgttactgcactgtgatttaatttcaaagagacagaaagagagggaaaaataggcttgttttctgatacacatgtaggctttttcttatggtgattaagtttctagacattgtcaaccatgctttcaagtgttgaaggttaacctagctaggttttgagttctctag

SEQ ID NO: 159011 - DNA, 471 bp, Homo sapiens
ccgggagcccttaaccctccgggagcccttaaccctccgggagcccttaaccctccgggagcccttaaccctccgggagcccttaaccctccgggagaccttaaccctccgggagcccttaaacctccgggagcccttaaccctccgggagcccttaaccctcccttaacccttccgggagcccttaaccctcgccgggagcccttaaccctccgggagcccttaaccctccgggagcccttaaccctgaaatcccacaagctccaaagggcccttctccagaaaagccctatggggagtaaagccaaagaataggcagaagacgtcagctctgtcctaagctcactggtgacactcatcaagcgtccagagcctagaacagcgcctgacacagagtcgatactgtaaaaatagttgctgaggggccaggtgtggtggcacatgcctgcagtcccagctacttgggaggct

SEQ ID NO: 159012 - DNA, 452 bp, Homo sapiens
ttggagatttgtgccctccatgcaggtggggaattagaagtggaattttttaagtcttgcattggaactagcaccaataattaaatggatgtataaataaaaggaacatttgttagaaggtctttaaaaaatatacctggaaaccctcgaggtggtgttggggctcagtaaacaataccccaaaatgaaggcctcagaagcaaaagtttttctgaccttcccctgccctcctgtttctcagtcccattcttccccaatgctagccatagaaactaggatccctcttcctcaaagctagtcataagacctaaaaatattactccaatttccctctgcctttctgtgtaaaaactgaccacgcagaaactgcctgactaccttgtttgattataggtcataagacccccatttcagaaaaagttttgccccctacccagaaaaaaaggaatgtg

SEQ ID NO: 159013 - DNA, 448 bp, Homo sapiens
gcacaatcagctcactataacttcaaaccacgggctcaagggatcctcctgccctcgcctcccaaacagctgtgactacaaatgtgtgccaccatgccttgctaattttgtaattttttgtagagatggagtctcactttgttgcccgggctggtctcaaacttctgggttcaagcaatcttcccacctcagcctctcaaagtattgtgattacaggtgtgagccaccacacctgccttaaagtctcatttcattcacaaaatatgaatatgaattgagacctgaaaattttgctacgcatcacacagcatcaaagcggatgggcttagtgaactgaaaactgtgtttattctattgccactttgtagcatcacttcagctggtaaacagaaatattggctattcagcaacgcgtagaagcataatatttctttttcttttttctttt

SEQ ID NO: 159014 - DNA, 429 bp, Homo sapiens
gtcctggagtggctcaccggcgaatgggctcgacctggggaaggggatgctgaaggctcttgttggagcttagccattcagttcctggggccagctgttggaatccggcaccctgtatgtgtagccctcagtattgctggctggtttctagccctttcttagagttgccctgttggggagggcacctgggggtgttcagtgggtgaagcgtctccaggagaacctctccttcccacaggatttctgttcctgtgtccgttcttctcccacagcttcctcacgaagcatcttcctggtggtagagctcttgactgtccagccttggccatggcttgggccttccatggccgggggtagcagggatctcagcactagccacttcctcaggggtatttggactccagtgcactcttcatgctccttccatct

SEQ ID NO: 159015 - DNA, 248 bp, Homo sapiens
tttatgtggtcaggaaggctctggtcaacagaaggctgttagttaagtttggggaaagttaaaagttctacacaaattttcaactgcacaggaggctggcgcccccaacccctgtattgttcaagggtttgctgtaatttgtattaaaacaccaagcccccttacacctgggtgagtctctctccctgaacagatgtgacaacattaccctccgaagactcccagagagaaagagaacacttcaaatt

SEQ ID NO: 159016 - DNA, 510 bp, Homo sapiens
agaatcagaattcggttatattttaaaggcaattatagtagaactattacttttttgttttctgttataatcttacctagacttatttaacatacttaacacataatattttaaggctaagtatttctacaaaggatttatcattcaatcattcttatttagtcaataaaatcttttggagattaatttttagtaagcctaaatacccaaatagccaggaatgtgattgaggatcacatttttaaaacccatccctcaaaaagaaaattgtaatatcttgagagacaggtatggtttgaagatcacccctcttcaaagtgagttcaatatctgacctaatggaatcactccccattccccaggactaggtgacactcactgatctgggaaaaataaacacgtgcaactaacaagagaaattttgagaattatgagtaagctttgaaaatttgggtactgaaaatagagagggagggagagagggaggtgatagggagggagggaaagaat

SEQ ID NO: 159017 - DNA, 379 bp, Homo sapiens
tctcgccaagctcctgattcacaagaccggaattaatgtacgtgcattgctgccccctgctggatgtatggaacccatttttgtctagggcccagggaaatgccatttgcaaatttcaattacttatcaattccttttcctccatcccccacctgaaatatcactcccctcaaaggactctgttaggagaccattccatctgagctaatgggcaaaacattccttataatgcaattagtgggcttcctcatacagtaaccccattgaccctctgtcggtgcggcttgctggaggcaacggaaaataggaaacacagcatcttgctcctccaaggaccactttttgaaaatacccccttgaattaacattaattcaggca

SEQ ID NO: 159018 - DNA, 301 bp, Homo sapiens
  misc_feature (14)..(14): n is a, c, g, or t
ggccggacgagatntccttcaattcaagtgctctagggcttatgtgacagccaccaaatggtagacgtgttgcaggggtccagtgaggagatagggacttctgtccgatttttgcgttgggataaaatagcatctcactacgatatgaaaaaactctccgaattagggtagggtttcccaatagcgtttatggtgccttcttgtttgctctcttagtctgtgttcctatgccgtctacatggatgggtcaaagactatgttttcttaacctcttgggtcaatccagttgttttccgtatac

SEQ ID NO: 159019 - DNA, 476 bp, Homo sapiens
tgctgggattagaggggtgatccacagtgcctggccagactccattattttaatgaatgagcagtttgcagccaccacagtgtacctagtcactcccctagtaataatgaacacttaggttgcttccagttgtgtgccactgaaaaaaaggatcgagaatgaatcgtcgcctcctttggggcagcattctgtgatatcccctgctccctccatgccatgttggtgttaaactgtgcttggagattcatcagctagaggctgtgaggttctgaacaacttttcaccatgttaagatgcttggccttggctgtgagcagcagcctggaatgggggcttcacaggagagggagacttgcttgactgcacctggtggcagtttgaacagtaggtgcggtggccccacctgctcagctgtcccacccttctgagctgggcaatcttttaggctctgggttcattgactttaaggcaaatgg

SEQ ID NO: 159020 - DNA, 367 bp, Homo sapiens
agagatggtgtggagcacaggtgactcctaaccggttgcagggaacataatcaggtaaaactgttttacagtagctactgaaactaagtatactcatccctgtggcccagaaatcccactcctagggatatatccaagagaaatgtgtgcacatgtacacaaaatctgtacaagaatattcataaccgccaaaaactaggaacaacccaaatgttcataaaacagcagaacagataaattgtagtacactaagtcctcacttaatgttgtcactgggttcttgggaaactgtgacttgaagccaaacaatgtataacaaaactaggccaggcacagtggctcacgcctgtaatcccaacactttggg

SEQ ID NO: 159021 - DNA, 472 bp, Homo sapiens
actctaagataaaagccaactcctctaagactacctgtagtcttggccaggcagagggcttgccaacaataaaatctcactagcttcataggaaaattatttgaatattttgctagcatttatagtcctaataagttattttttttaaatatttaagcaatgcttttttggtagttttgatatataaagtattccaatttgtttttgatataatgagtactaatctttactatcaaagtttttatcaaagctattagtatcaaaaaaaggtctcatgaccaaataagaaaaaagaattccccttatagaacactaggaacatgctcttaattatatgctgaatgactttacaaactagatgaatataatataaacacacatgcatgaattctgctgtctttgagtaccttctactcagacttcttcccttccttccttcccttctagacagaaactacttacagaaagcaat

SEQ ID NO: 159022 - DNA, 641 bp, Homo sapiens
aaactccatctcaaaaataataaaataataataataataataataataataatgtgtgggcagatgtcatctacaccatagtttcagaatgcaataaattcacatttaaaaaccttgaagtacaccgtatcaaaactttacttcatctttcattcttatgtgattcagttgataggctggaagaacaatgaaagtgagttccatcatgctgcctggtgtccgtgtccttaatgataaagactttgagtgtatttgcaaactctctgttaatgacagcatttttttttattctgagctttattaaggtataattgacatacaaaaattgtacatatttaaggtgtataatgtaatgttttgatatacatatacattctgaaatgattaccaaaatcaagataattaacacatccatcacctcatagttatccatttagcaaatcctttactaggtggcaaaattgattttaaaatcacatttttatccccttgaagttttttcatctgtaaattttcaagggcagtcttttaatagaatacaaacagctcattccttatgtggctccaagctggcatttcagcattgggtttaaactttagagcaacatatgaaaatctcctgaataaacttgtcaatgatt

SEQ ID NO: 159023 - DNA, 401 bp, Homo sapiens
attggacagcttgaaccctcaacctgtctcaaatgcgcacttgcctctgttgggaattgcacagacaaggggaacgcgtccaaaccacaccaccctctatgaccagataaggagttttaactaatgcacaggccctcagattggtccttaacaattggtctttaaatgatgcagctcagggctgtaccatgaagagcgtatctgaaggagcaaccaaattaacaggaggttgaatgcctcttgcctcccttccagaagcaaacacatgactccagagcaggtggggagatgccactccattcttacttgctgagctaggttgcctgtttttgttcacacacctcagtaagtgagcacttacctttcaggccctcttagaattccagaaacttgaggctaaa

SEQ ID NO: 159024 - DNA, 446 bp, Homo sapiens
gaactggaaattaccaaacgatttccaattttaagagatttggatcaggtggcttagaattagattaaagacaatcaattccctgaaacaatcaatgccatacataatcttccgaaggagctttttctattgctgagaggttgctcatctggtcttgtttcttatccctatagaaaccttgatgtcaattagtattccacgggaaatgaagctagatgagaaagtgaacccttgctaaataaattagaagagatgataattaaagcagagattccaaaccatatcagagaagcagctctatcttcattttaccattacttccctaaaagcaatatatggcagtttacaaattacacatggaaatgaaatatatttaattttggatttttttgtgcttttgagaatcagaattttataatatctcttgactgaaggggaattaatct

SEQ ID NO: 159025 - DNA, 481 bp, Homo sapiens
catctgctaaaaaaatctggcagacttttacccataatatacaaagaactctcacacctcaataagaaacaacacaaaatttggcacaatatttgaatagaaatttcaccaaagaagatattttgaatcatccataaccatactataatgattaaaattacaaaaactgatacaacttaaactctcatgcattgttggtggaaatggaaaatggcgcatctactctggaaaagagttttgaacttgcttataaagataaatccacacttaatcatacataaccatgcaacccagcaattccactcctaggtgtttccctaagagaaatgataacatatgtccacaaaaagccttgtccatgaatgtttatagtggcattgttcatggtcaccaaaaactcaaaacatctcaaatgttcattaacttgcaaatggataaacaaattgtgttctctatatacaatgaaatattatttagcaac

SEQ ID NO: 159026 - DNA, 133 bp, Homo sapiens
gggcttctcttggttgtatgaactcacctcatggaactgtcgtaagactcaaaagagatagtgtaaacaaaagcatcttgaaaactgtattagcctgtagatatgtggttcatgtacatccaggcactttaac

SEQ ID NO: 159027 - DNA, 543 bp, Homo sapiens
gaatgaaggtggtcaccaatgttgaagggcaggttgctccagaaatgcctgctgaaaaaaaaaaggtgtacatatacactcatttttatcaccttgtctagtcttactaaaaacgaaactaagttatagatctacagcattcttcatatttggttaacttgatgactgagccaaatgaggccgaaatgaccaatgtacaaaatacatggcaaaccctattttcacttgtagctttgcctctatcttccacagtgaaacgttattgtaaacaaaaatgagggagggcttcacctaagcacatcaagacataaagcaattaagatttccaactcactggtctcctctcaaaccctgatttaaaggtttccatgcaaaattggaactgcaaatattttgtcctatccagtcttaattttacacattgttcaggataagcatatcctagaatcaatatcccacagtctgaagaaagcactaggcctttgaataggtcctggtatttggggacaccctaaggaactggtgatgcttgaaaaacctctc

SEQ ID NO: 159028 - DNA, 434 bp, Homo sapiens
ttacaacagctcagttacaacagctccagttacaacagctccagttacaacagttccaattacaacagctcagttacaacagctccagttacaacagctccagttacaacagctccagttacagcagctgcttgaggccaggagtttgagaatagccttggcaacatagtgagactctctacaaaaaaatttttaaagaattagctgggcatggcagtgcatgcccatggtccctgttacttgggaggctgaggtgggaggatcacttgaatgcagaaggttgaggctgcagtgagccctgatcatgccattgcactccagtctgggtgacagaatgagacatgatctaaaacaacaacaacaacaaaaacattggctgacacttacttgcccatagggatgctctgattggttacagctccagctccaggtta

SEQ ID NO: 159029 - DNA, 509 bp, Homo sapiens
  misc_feature (75)..(75): n is a, c, g, or t
aaatagccaaaacaaccgtaagtacaaaagaaagcggaagcatcacactacctgatttcaaactatattacaagngctacagtaaccaaaacagcatggtactggtacaaaaatagacacatagaccaatggaagaggttagaaaacccagatataaagccacacccctacaaccatctgatcttcaatgaagtcgacaataacaagcaatggggaatggattctctattcaataaatgctataactggctagccatatgcagaagattgaaaatggacccctacctttcaccatatacaaaaatcaactaatattggtaaggtagaatagggcttttgtgaagaatcctgaatacatacagtagatatggtgcttaattctataggtcgtggtgggtcagtggggattttagagcaggtgagctgcattttaagattgattaggcagcgttttataggatgatggattggggaggggagaaactggaggtaagaagaccagttaggat

SEQ ID NO: 159030 - DNA, 290 bp, Homo sapiens
ggagtttgagaccagcttagcaatatggtgagagcttgtctctatgaaaaaaatttaaaaaattagccaggcttggtggtgtatacctgtattcccaggtacttgggaggctaaggtgagaggattgcttgagcctgggaggcaggaggcagaggttgctgtgagccaagatcgtgccagtgcactccaccctgggtgacagagcaagactccatcaggaaagaaagaaagagagagagagagaaggaaggaagggagagagagagaaagggagaaagtggaagagaaga

SEQ ID NO: 159031 - DNA, 442 bp, Homo sapiens
actaccatgtaaatgtattgagtaaataaaacataaatatacctaatgaaaacttgtgtttttctgacaaagctcatatttatttaacctaacttactgaccagtcaacctatgtaccatttaattatcaggatgtatcaattaaaccagtttgctatatttactaatacatacatatgatccacctcagagtccagagggctattccaccaaggaatccccacccacctcaatcacttcagtgaaattccctagacatcttgctctctaaatttaaatttgaaataccttataaaagctggatatcagtaagttggtattctatgaaggatagattttaaaagtataatgttaccatcatgtacttcgaagaacttataacgagaaaggacaatgcgcataaatgcatgtccctaagacagtgaatcatctccgatggact

SEQ ID NO: 159032 - DNA, 546 bp, Homo sapiens
cacttggaaccaagtacagacattgtattgctcctcaccctttaacattcagttcatggccttcctctaaaaaactatggctgttcaacaccagaccttcagagaaaaagcaattccaatcgcatcttcctgaaccctgcttcgcaaagtcactttttggctcatacatcttttgtgactgctattgctggcagaataaagttcaaacatttcagcctgttatgaatgaacaagctgggctgtttaatatcagacacttcagagcaaaagataagaaagagagtgagttctagaaatactgtctctctgccagggccaaacctaggaagagtccccaaggaaggttccagaggacaaacaggagatgaaaaatctggctttgatgaatatgaaggaggacggtaataaatgaagaaatgaatgaaaaagaatgaatgaatgcttgtgctcctagtgaattatttatcatcagacaagcttgaatagccctacatgctgatttcatttctttcaggtgttttatctttttaaagaaattgtgtatgt

SEQ ID NO: 159033 - DNA, 591 bp, Homo sapiens
agataaaagttctggcatgctgggattgataccttgtgttattggttcattagtttttttggattataaacaagataatctaacacctttctgtgtttggggaagtctttatcttaggagtctttgtgagagggagagcgatctccaccattaagaaagctaattgttcactttccccaccgcttttgcagttaggatgcaatcctgtggcctccatgactggcagtgcttgcctacctcagaggccagtgatctgcagaggcaggcggtatgtagaatctgtattctctagtcaaggagggatggggatgggatagcagcttatcttttccataggcagcagtgactgagattccagttgcaacacttagtgcctggtgttggtatcagtataagttgcagtgactgagtctcatttggtcttcactggaccatatctgtggtttgaattttggatgttcttaactatgtagctttccagcctggtccccatggggttttctgtgagttgcactgtttacttgcttagcattctgaacctgacgttttagagagatcactccatgtccagtgcctcaggatggtgtgcct

SEQ ID NO: 159034 - DNA, 559 bp, Homo sapiens
agataaaagttctggcatgctgggattgataccttgtgttattggttcattagtttttttggattataaacaagataatctaacacctttctgtgtttggggaagtctttatcttaggagtctttgtgagagggagagcgatctccaccattaagaaagctaattgttcactttccccaccgcttttgcagttaggatgcaatcctgtggcctccatgactggcagtgcttgcctacctcagaggccagtgatctgcagaggcaggcggtatgtagaatctgtattctctagtcaaggagggatggggatgggatagcagcttatcttttccataggcagcagtgactgagattccagttgcaacacttagtgcctggtgttggtatcagtataagttgcagtgactgagtctcatttggtcttcactggaccatatctgtggtttgaattttggatgttcttaactatgtagctttccagcctggtccccatggggttttctgtgagttgcctaatacactttaataacttcctttcagcttaaacaaagccagagcc

SEQ ID NO: 159035 - DNA, 526 bp, Homo sapiens
ctatgttgcccaggatggtcttgaactcctggcctcaagtgatccttcataccttgggctcccaaagtgctaggattacaggcgtgagccactgcgctggcccaaaccctagtatttctgcttctgatacaccagagtccttctctaaaccactaagactattggttttcacattttccctgttgcttttcgcaaatggaagctcctatcagagtcttcctcactccaaagaagtgcccccgtgatgagtcagcctggcatcatcaaccacaccccaacaccaaacccttgagccatcgatgaggcagtggggctcaccaaactcctgaaacagcaaatccccacagtcttcctgggtccttggccaacctgccttggtgagtgggaaggacacaggtgattctctccactttacagatctgactactcaaccaaagcacagaggggaagcacaaaggccaggagtctaggagaggtcccgtggtcccagatgggggaggaaaaggcagtctgatttggattcttc

SEQ ID NO: 159036 - DNA, 535 bp, Homo sapiens
tgttcaactttttttttatttggccatcaaaaatagtgtcattaatattttcaaaattataaataataatttgaaattatcattatttggatatataattctaggtggagaattattttctgccagcattccttctaagaaattatccagctctgtgtttgttggaaattttgtttcaccttgttgctgtttcttagtaagcaatctaaatgagtattagatttaaaaattatatcttcatatctaatgctggatagtttcatcataatgtatctaagattcatttaacaaatgtctgctaagtatatgcttggtgagagacacaattttagaatacaaaggtacagtagttttgaaaactgtgctgcctgaggtgaggacggacatcttccgccaattctggaaaaacttcagctggtggccggacacggtggctcatgcctgtaatctcagcactttgggaggcctaggcgggaggatcacaaggtcaggagatcgagaccatcctggctaacacggtgaaaccccatctcta

SEQ ID NO: 159037 - DNA, 423 bp, Homo sapiens
aagtgtgttcattgagcattttgctgttttacatgacctcgccataaaggagtgtctctacgagaaaggaaaaacctgtttcataacgcagtgcagagctttgttttctctcgtcagggtgacagccctttggttcctgccagtgggtatgcgacaggaaggtggggaaactggatcatgaaaattccacggctggcaattgctcattctttagccttctagccagaggatagtgtctggttcccagggtggctcagtacagtatttaattcagagagcccaaacctatgccattagcattttattctttaaaaaaaaaaaaagaggatgacccttggtaatttataagcagcttcagcatagtctggcacgagggggtgattgaggaagcgttttgttttttgaaacttggattcagtgaac

SEQ ID NO: 159038 - DNA, 426 bp, Homo sapiens
cacgtgtctgtaacaccagctactcgggaggctgaggcaggagaatcgcatgaacctgggaggcggagggtgcagtgagctgagatcgcgccactgcactccagcctgggtgacagagcaagaccctgtctcaaaaaaattagataaccacgtaaaccacataaagcactttgacagtgcctggcacatagcaaatgttcagtagcagtaagtgactgtaactattggtagccatgttaaagagggtggctttgtcctcatctttaagcctccacactcagtaaagaaattgatacatagtaggtgctcagtcaatctttgtttaattgaatgaatcatgatacgtgtcataggagcagtaccaacacagcattctgatggccagcatttatgaagttaatttctggttgtggaaattaaaaaaaa

SEQ ID NO: 159039 - DNA, 406 bp, Homo sapiens
agctttgttccactctgtgcagtaatggtccctttattttgctttggagtactcttcccaccccctactccaagtgtaggcacataatttagacctgattcatcagagcactgtgctcccttgaccacagtgaccaggtcagagatgacaagaacacgtaacagcaatttcctgtgcttctggagccaccaggaggaaggcatgacctttcccatgggactttcacctgctggccaacatcttgctacatctagctactaccatttaaaacccaaaaatgaagccaacatgagggggagccaagagatggagggagaccaaagcttggtgacatttgagcccctggattaaaccaggcctgaagctagaattaccttagtcttctaagttacatgagccaatggat

SEQ ID NO: 159040 - DNA, 457 bp, Homo sapiens
cctcagcctcctgagtagctggctggctaatttttaaattttttatagagacagagtctcactgtgttgcccaggctagtcttgaactcctggcctcaaacgatcctcccacctcaacctcccaaagtgctgggattaaggcatgagccaccacgcctggccacatttttagtattcttgatacatattgccaatctgctttctggaaaggttataaaggtatttcttgttatatcagttaggattaggtttgattataagataacagtgccctataagataggaatgtattttttctctcatgtaaaatcatctaggagtaggcagtcaaaagttggtatagtgagtctgcaaagtcagggatccaggctccttctgtcttactgttttgccatccttatcttaccacatcatggcccgaggcatttgccattatggcttccctccagtcaataga

SEQ ID NO: 159041 - DNA, 4078 bp, Homo sapiens
  misc_feature (2774)..(2774): n is a, c, g, or t
  misc_feature (3622)..(3622): n is a, c, g, or t
  misc_feature (3773)..(3773): n is a, c, g, or t
taaagggctaaagctattggcattggcagctgtctccaggcgtcgtccgcggagcctgaccctgcgccaggacggaggaggctgtgcccatgtaactgtcctgaagtactgcggtggccccctcccccgcggctgggagggcaggcaggacgaggttggctttcctcgcacggtctctgggcgtgggcccccgccgcagctccgcggagcctcggtgtctcctgcaacagggggcggggggaacagcggcgagcagccctgggctgcggcttcctccccacgcccgagtctcctgcgcaccgccgccgaggacgcgcgcccgagcctagtccccacgccgcggcgcgcccgggctccctgctgatcccagaacaatcaaccatgacgaccgaatctggatcagactcggaatccaagccggaccaggaggccgagccccaggaggcggcgggggcgcaggggcgcgcgggggcgcccgtgccggagccgcccaaggaggagcagcagcaggccctggagcagttcgccgccgctgcagcgcacagcaccccggtgcggagggaggtcactgacaaggaacaggagtttgctgccagggctgcaaaacagctcgaatatcagcaattagaagacgataaactttctcagaaatcatctagcagtaaactctctcggtctccattaaagattgtcaaaaagcctaaaagcatgcagtgcaaagtgatacttctcgatggatcagaatatacctgtgatgtagagaaacgctccagaggacaagtgctgtttgataaagtgtgtgaacacttgaacttgctagagaaagactactttgggcttacgtatcgagatgctgaaaaccagaagaattggttggaccctgctaaggaaataaaaaaacaggttcgaagtggtgcttggcacttttcatttaatgtgaaattttatccaccagaccctgcccaactatctgaagatatcaccaggtactacctctgcttgcagttgcgagatgacatcgtgtccggaaggctgccctgctcctttgttaccctggccttgctgggctcctacactgtccagtcagagctcggagactatgacccagatgaatgtgggagcgattacattagtgagttccgctttgcaccaaaccacactaaagaactggaagacaaagtgatcgagctgcacaagagccacagaggaatgacgccagcagaagcagagatgcatttcttggaaaatgccaaaaaattatcaatgtatggggtagatttacatcatgctaaggactcagaaggggtagaaattatgttaggagtttgtgcaagtggtctgttgatatatcgcgaccggctgcgaataaacagatttgcctggcccaaggttctaaagatttcatacaaacggaacaacttttacattaagatccggccgggagagtttgaacaatttgaaagcaccattgggtttaagctgccaaaccatcgagctgccaagcgtttatggaaagtatgtgttgagcatcatacatttttcagactactgttaccagaagcacctcccaagaaattcctaaccttgggttccaagtttcgttatagtggcaggacacaagcgcaaacgagaagagccagtgcgttgatagatcgcccagcaccttactttgaacgctcatccagcaaacgttataccatgtctcgcagcttggatggagcatcagtgaatgaaaaccatgaaatatacatgaaggattctatgtctgctgcagaggttggtactggccagtacgccacaacaaaaggcatctctcagaccaacttgatcaccactgtgactccggagaagaaggctgaggaggagcgggacgaggaagaggacaaacggaggaagggggaagaagtcacgcccatctcggccatccggcacgagggaaagactgacagtgagcgcacggacaccgcagccgacggggagaccaccgccactgaggagctagaaaaaactcaagatgacctgatgaaacatcaaaccaacattagcgagctgaaaagaaccttcttagaaacctcaacagacactgccgtaacgaatgaatgggagaagaggctttccacctcccccgtgcgactggccgccaggcaggaggatgcccccatgatcgaaccacttgtccctgaagagaaaatggaaaccaagacggagtccagtggaatagagacggaacccaccgtgcaccacctgccgcttagcactgagaaggtggtgcaggagaccgtgttggtggaggagcggcgtgtggtgcacgcgagtggggatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaagaagtgccagtagttcacaccgaaaccaaaaccatcacatatgaatcatcacaggtcgatccaggcacagatctggagccaggcgtgctgatgagtgcacagacgatcacatctgaaaccaccagtaccaccaccactacncacatcaccaaaactgtgaaagggggcatttcagagacaagaattgagaagcgaatagtcatcacgggggatgcagacattgaccatgaccaggcgctggctcaggcaattaaagaggccaaagagcagcaccctgacatgtcagtgaccaaagtagtggtccataaagagacagagatcacaccagaagatggagaggattgaccagaggaataacttagcttgcacatgaatgcagtcatgcaaaccgttaggaaaaccagagcctatatggagttccctcttctaacccaactgacttgtatctgtccgtggaaaatttcagtccagaagaattgaccttgaccattaataaagacactggcagagagatcttcccataataaagcaatctgattcagcatcactaaaccgataatgcatgaagcaacgataaaattacaaaagagcagcatttttaattttcacaaaatgtctcagttttcagctatacctgcacgttcataaccaacaatataaaccgtggtctcatgtaacacataaacaattcatgcctttcatagtttattattattaaagtctaaacaaaattgcaatttcttaggtaaccttatatttacaataaatgaagattaccctcaaatgctagaagctgtctaggtccgtccggtgtgtcagattttcctcagattagatgtgccaataaccaagtttattcagtaaacaacttgtacttgtttcatctggttttattactctcacccataaacagtaatgactctctgaccctctggaaatatgtaatgcttccaatcttgctttgtgtatctcatttaatttgttccggntaaggtagtactgattttagcatattaatgcgatttcttccttgttgtttgctttggtctgtgttcaatccagagagcttaaattgtcattattttgggaagaaaacctgtatttttgttagtttacaatattatgaaatttcacttcagnagaaactgctgggcttcctgtggctttgttttcttagttactttttccgtgccgtgtattttttaattgatttttcttcttttacttgaaaagaaagtgttttattttcaaatctggtccatatttacattctagttcagagccaagccttaaactgtacagaatttccactgtaattaaaactatttagtgttagttataaatagccttcaaaaagagagattctccattacacgatcacctgcatcacagcccatggtgaatgtatgtttctgcatagcgaaataaaaatggcaaatgcactg

SEQ ID NO: 159042 - DNA, 3368 bp, Homo sapiens
  misc_feature (2774)..(2774): n is a, c, g, or t
taaagggctaaagctattggcattggcagctgtctccaggcgtcgtccgcggagcctgaccctgcgccaggacggaggaggctgtgcccatgtaactgtcctgaagtactgcggtggccccctcccccgcggctgggagggcaggcaggacgaggttggctttcctcgcacggtctctgggcgtgggcccccgccgcagctccgcggagcctcggtgtctcctgcaacagggggcggggggaacagcggcgagcagccctgggctgcggcttcctccccacgcccgagtctcctgcgcaccgccgccgaggacgcgcgcccgagcctagtccccacgccgcggcgcgcccgggctccctgctgatcccagaacaatcaaccatgacgaccgaatctggatcagactcggaatccaagccggaccaggaggccgagccccaggaggcggcgggggcgcaggggcgcgcgggggcgcccgtgccggagccgcccaaggaggagcagcagcaggccctggagcagttcgccgccgctgcagcgcacagcaccccggtgcggagggaggtcactgacaaggaacaggagtttgctgccagggctgcaaaacagctcgaatatcagcaattagaagacgataaactttctcagaaatcatctagcagtaaactctctcggtctccattaaagattgtcaaaaagcctaaaagcatgcagtgcaaagtgatacttctcgatggatcagaatatacctgtgatgtagagaaacgctccagaggacaagtgctgtttgataaagtgtgtgaacacttgaacttgctagagaaagactactttgggcttacgtatcgagatgctgaaaaccagaagaattggttggaccctgctaaggaaataaaaaaacaggttcgaagtggtgcttggcacttttcatttaatgtgaaattttatccaccagaccctgcccaactatctgaagatatcaccaggtactacctctgcttgcagttgcgagatgacatcgtgtccggaaggctgccctgctcctttgttaccctggccttgctgggctcctacactgtccagtcagagctcggagactatgacccagatgaatgtgggagcgattacattagtgagttccgctttgcaccaaaccacactaaagaactggaagacaaagtgatcgagctgcacaagagccacagaggaatgacgccagcagaagcagagatgcatttcttggaaaatgccaaaaaattatcaatgtatggggtagatttacatcatgctaaggactcagaaggggtagaaattatgttaggagtttgtgcaagtggtctgttgatatatcgcgaccggctgcgaataaacagatttgcctggcccaaggttctaaagatttcatacaaacggaacaacttttacattaagatccggccgggagagtttgaacaatttgaaagcaccattgggtttaagctgccaaaccatcgagctgccaagcgtttatggaaagtatgtgttgagcatcatacatttttcagactactgttaccagaagcacctcccaagaaattcctaaccttgggttccaagtttcgttatagtggcaggacacaagcgcaaacgagaagagccagtgcgttgatagatcgcccagcaccttactttgaacgctcatccagcaaacgttataccatgtctcgcagcttggatggagcatcagtgaatgaaaaccatgaaatatacatgaaggattctatgtctgctgcagaggttggtactggccagtacgccacaacaaaaggcatctctcagaccaacttgatcaccactgtgactccggagaagaaggctgaggaggagcgggacgaggaagaggacaaacggaggaagggggaagaagtcacgcccatctcggccatccggcacgagggaaagactgacagtgagcgcacggacaccgcagccgacggggagaccaccgccactgaggagctagaaaaaactcaagatgacctgatgaaacatcaaaccaacattagcgagctgaaaagaaccttcttagaaacctcaacagacactgccgtaacgaatgaatgggagaagaggctttccacctcccccgtgcgactggccgccaggcaggaggatgcccccatgatcgaaccacttgtccctgaagagaaaatggaaaccaagacggagtccagtggaatagagacggaacccaccgtgcaccacctgccgcttagcactgagaaggtggtgcaggagaccgtgttggtggaggagcggcgtgtggtgcacgcgagtggggatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaagaagtgccagtagttcacaccgaaaccaaaaccatcacatatgaatcatcacaggtcgatccaggcacagatctggagccaggcgtgctgatgagtgcacagacgatcacatctgaaaccaccagtaccaccaccactacncacatcaccaaaactgtgaaagggggcatttcagagacaagaattgagaagcgaatagtcatcacgggggatgcagacattgaccatgaccaggcgctggctcaggcaattaaagaggccaaagagcagcaccctgacatgtcagtgaccaaagtagtggtccataaagagacagagatcacaccagaagatggagaggattgaccagaggaataacttagcttgcacatgaatgcagtcatgcaaaccgttaggaaaaccagagcctatatggagttccctcttctaacccaactgacttgtatctgtccgtggaaaatttcagtccagaagaattgaccttgaccattaataaagacactggcagagagatcttcccataataaagcaatctgattcagcatcactaaaccgataatgcatgaagcaacgataaaattacaaaagagcagcatttttaattttcacaaaatgtctcagttttcagctatacctgcacgttcataaccaacaatataaaccgtggtctcatgtaacacataaacaattcatgcctttcatagtttattattattaaagtctaaacaaaattgc

SEQ ID NO: 159043 - DNA, 3994 bp, Homo sapiens
  misc_feature (2690)..(2690): n is a, c, g, or t
  misc_feature (3538)..(3538): n is a, c, g, or t
  misc_feature (3689)..(3689): n is a, c, g, or t
agaccatctgaagcatcttgctggctttaaaactttgcctgatcaatcaatgagactcctttctcaagttgaactgcattgcgagtaatatcagcataaaaaatgaagaaccacagaatggctgcagatgttccttgtcttttccatgactgacatttttcataacaatcaaccatgacgaccgaatctggatcagactcggaatccaagccggaccaggaggccgagccccaggaggcggcgggggcgcaggggcgcgcgggggcgcccgtgccggagccgcccaaggaggagcagcagcaggccctggagcagttcgccgccgctgcagcgcacagcaccccggtgcggagggaggtcactgacaaggaacaggagtttgctgccagggctgcaaaacagctcgaatatcagcaattagaagacgataaactttctcagaaatcatctagcagtaaactctctcggtctccattaaagattgtcaaaaagcctaaaagcatgcagtgcaaagtgatacttctcgatggatcagaatatacctgtgatgtagagaaacgctccagaggacaagtgctgtttgataaagtgtgtgaacacttgaacttgctagagaaagactactttgggcttacgtatcgagatgctgaaaaccagaagaattggttggaccctgctaaggaaataaaaaaacaggttcgaagtggtgcttggcacttttcatttaatgtgaaattttatccaccagaccctgcccaactatctgaagatatcaccaggtactacctctgcttgcagttgcgagatgacatcgtgtccggaaggctgccctgctcctttgttaccctggccttgctgggctcctacactgtccagtcagagctcggagactatgacccagatgaatgtgggagcgattacattagtgagttccgctttgcaccaaaccacactaaagaactggaagacaaagtgatcgagctgcacaagagccacagaggaatgacgccagcagaagcagagatgcatttcttggaaaatgccaaaaaattatcaatgtatggggtagatttacatcatgctaaggactcagaaggggtagaaattatgttaggagtttgtgcaagtggtctgttgatatatcgcgaccggctgcgaataaacagatttgcctggcccaaggttctaaagatttcatacaaacggaacaacttttacattaagatccggccgggagagtttgaacaatttgaaagcaccattgggtttaagctgccaaaccatcgagctgccaagcgtttatggaaagtatgtgttgagcatcatacatttttcagactactgttaccagaagcacctcccaagaaattcctaaccttgggttccaagtttcgttatagtggcaggacacaagcgcaaacgagaagagccagtgcgttgatagatcgcccagcaccttactttgaacgctcatccagcaaacgttataccatgtctcgcagcttggatggagcatcagtgaatgaaaaccatgaaatatacatgaaggattctatgtctgctgcagaggttggtactggccagtacgccacaacaaaaggcatctctcagaccaacttgatcaccactgtgactccggagaagaaggctgaggaggagcgggacgaggaagaggacaaacggaggaagggggaagaagtcacgcccatctcggccatccggcacgagggaaagactgacagtgagcgcacggacaccgcagccgacggggagaccaccgccactgaggagctagaaaaaactcaagatgacctgatgaaacatcaaaccaacattagcgagctgaaaagaaccttcttagaaacctcaacagacactgccgtaacgaatgaatgggagaagaggctttccacctcccccgtgcgactggccgccaggcaggaggatgcccccatgatcgaaccacttgtccctgaagagactaagcagtcttctggggaaaagctcatggatggctctgaaatcttcagtttattagagtctgcgcgaaaaccaacagaattcataggaggggttacttctacttctcaaagctgggttcagaaaatggaaaccaagacggagtccagtggaatagagacggaacccaccgtgcaccacctgccgcttagcactgagaaggtggtgcaggagaccgtgttggtggaggagcggcgtgtggtgcacgcgagtggggatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaagaagtgccagtagttcacaccgaaaccaaaaccatcacatatgaatcatcacaggtcgatccaggcacagatctggagccaggcgtgctgatgagtgcacagacgatcacatctgaaaccaccagtaccaccaccactacncacatcaccaaaactgtgaaagggggcatttcagagacaagaattgagaagcgaatagtcatcacgggggatgcagacattgaccatgaccaggcgctggctcaggcaattaaagaggccaaagagcagcaccctgacatgtcagtgaccaaagtagtggtccataaagagacagagatcacaccagaagatggagaggattgaccagaggaataacttagcttgcacatgaatgcagtcatgcaaaccgttaggaaaaccagagcctatatggagttccctcttctaacccaactgacttgtatctgtccgtggaaaatttcagtccagaagaattgaccttgaccattaataaagacactggcagagagatcttcccataataaagcaatctgattcagcatcactaaaccgataatgcatgaagcaacgataaaattacaaaagagcagcatttttaattttcacaaaatgtctcagttttcagctatacctgcacgttcataaccaacaatataaaccgtggtctcatgtaacacataaacaattcatgcctttcatagtttattattattaaagtctaaacaaaattgcaatttcttaggtaaccttatatttacaataaatgaagattaccctcaaatgctagaagctgtctaggtccgtccggtgtgtcagattttcctcagattagatgtgccaataaccaagtttattcagtaaacaacttgtacttgtttcatctggttttattactctcacccataaacagtaatgactctctgaccctctggaaatatgtaatgcttccaatcttgctttgtgtatctcatttaatttgttccggntaaggtagtactgattttagcatattaatgcgatttcttccttgttgtttgctttggtctgtgttcaatccagagagcttaaattgtcattattttgggaagaaaacctgtatttttgttagtttacaatattatgaaatttcacttcagnagaaactgctgggcttcctgtggctttgttttcttagttactttttccgtgccgtgtattttttaattgatttttcttcttttacttgaaaagaaagtgttttattttcaaatctggtccatatttacattctagttcagagccaagccttaaactgtacagaatttccactgtaattaaaactatttagtgttagttataaatagccttcaaaaagagagattctccattacacgatcacctgcatcacagcccatggtgaatgtatgtttctgcatagcgaaataaaaatggcaaatgcactg

SEQ ID NO: 159044 - DNA, 1260 bp, Homo sapiens
agaccatctgaagcatcttgctggctttaaaactttgcctgatcaatcaatgagactcctttctcaagttgaactgcattgcgagtaatatcagcataaaaaatgaagaaccacagaatggctgcagatgttccttgtcttttccatgactgacatttttcataacaatcaaccatgacgaccgaatctggatcagactcggaatccaagccggaccaggaggccgagccccaggaggcggcgggggcgcaggggcgcgcgggggcgcccgtgccggagccgcccaaggaggagcagcagcaggccctggagcagttcgccgccgctgcagcgcacagcaccccggtgcggagggaggtcactgacaaggaacaggagtttgctgccagggctgcaaaacagctcgaatatcagcaattagaagacgataaactttctcagaaatcatctagcagtaaactctctcggtctccattaaagattgtcaaaaagcctaaaagcatgcagtgcaaagtgatacttctcgatggatcagaatatacctgtgatgtagagaaacgctccagaggacaagtgctgtttgataaagtgtgtgaacacttgaacttgctagagaaagactactttgggcttacgtatcgagatgctgaaaaccagaagaattggttggaccctgctaaggaaataaaaaaacaggttcgaagtggtgcttggcacttttcatttaatgtgaaattttatccaccagaccctgcccaactatctgaagatatcaccaggtactacctctgcttgcagttgcgagatgacatcgtgtccggaaggctgccctgctcctttgttaccctggccttgctgggctcctacactgtccagtcagagctcggagactatgacccagatgaatgtgggagcgattacattagtgagttccgctttgcaccaaaccacactaaagaactggaagacaaagtgatcgagctgcacaagagccacagaggaatgacgccagcagaagcagagatgcatttcttggaaaatgccaaaaaattatcaatgtatggggtagatttacatcatgctaagccaaactccatcatttgaagaagcaaatttactgaaacaaattggaactaatctccggttatgagcgagatgcctcgcttctgttgacggtgtgaaagaccctgagctttacaatccatttaaaaattctgatctggaatcctgtatgaagaataaatacccatattacacaaa

SEQ ID NO: 159045 - DNA, 1116 bp, Homo sapiens
agaccatctgaagcatcttgctggctttaaaactttgcctgatcaatcaatgagactcctttctcaagttgaactgcattgcgagtaatatcagcataaaaaatgaagaaccacagaatggctgcagatgttccttgtcttttccatgactgacatttttcataacaatcaaccatgacgaccgaatctggatcagactcggaatccaagccggaccaggaggccgagccccaggaggcggcgggggcgcaggggcgcgcgggggcgcccgtgccggagccgcccaaggaggagcagcagcaggccctggagcagttcgccgccgctgcagcgcacagcaccccggtgcggagggaggtcactgacaaggaacaggagtttgctgccagggctgcaaaacagctcgaatatcagcaattagaagacgataaactttctcagaaatcatctagcagtaaactctctcggtctccattaaagattgtcaaaaagcctaaaagcatgcagtgcaaagtgatacttctcgatggatcagaatatacctgtgatgtagagaaacgctccagaggacaagtgctgtttgataaagtgtgtgaacacttgaacttgctagagaaagactactttgggcttacgtatcgagatgctgaaaaccagaagaattggttggaccctgctaaggaaataaaaaaacaggttcgaagtggtgcttggcacttttcatttaatgtgaaattttatccaccagaccctgcccaactatctgaagatatcaccaggtactacctctgcttgcagttgcgagatgacatcgtgtccggaaggctgccctgctcctttgttaccctggccttgctgggctcctacactgtccagtcagagctcggagactatgacccagatgaatgtgggagcgattacattagtgagttccgctttgcaccattcgaaattgtttgaggggtttgggtttatttttgttggttttttctctcttttttttgcttacatgggcatccttcagcttttaataatctgaaaaactctatttacccattgtcaatgtgtataaattaatctgagtcaattttatacaataaaaggtgaacttttaaa

SEQ ID NO: 159046 - DNA, 2443 bp, Homo sapiens
  misc_feature (1139)..(1139): n is a, c, g, or t
  misc_feature (1987)..(1987): n is a, c, g, or t
  misc_feature (2138)..(2138): n is a, c, g, or t
agtggggatgacttctcagcttctgatttgttattcgctcctagatatagatcccttttcctgtgtgtatatttattttaattctctcaggatacatgtgaattgtactctttatagtttgccttctaaaattcttttggtatccatgtttgtgtgaactagatttttttttctgtttcctttccatgggaaaatcacattttcaccagagtgtttgtggtagtgccatgagccttgatcaaaattttgttttattttgactactaataagattgacattacttttaaagcaaacaaaagagctgaaaggaacacaaatgtaaaacattgactgttggatactttatgttctgaatataggagctagaaaaaactcaagatgacctgatgaaacatcaaaccaacattagcgagctgaaaagaaccttcttagaaacctcaacagacactgccgtaacgaatgaatgggagaagaggctttccacctcccccgtgcgactggccgccaggcaggaggatgcccccatgatcgaaccacttgtccctgaagagaaaatggaaaccaagacggagtccagtggaatagagacggaacccaccgtgcaccacctgccgcttagcactgagaaggtggtgcaggagaccgtgttggtggaggagcggcgtgtggtgcacgcgagtggggatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaagaagtgccagtagttcacaccgaaaccaaaaccatcacatatgaatcatcacaggtcgatccaggcacagatctggagccaggcgtgctgatgagtgcacagacgatcacatctgaaaccaccagtaccaccaccactacncacatcaccaaaactgtgaaagggggcatttcagagacaagaattgagaagcgaatagtcatcacgggggatgcagacattgaccatgaccaggcgctggctcaggcaattaaagaggccaaagagcagcaccctgacatgtcagtgaccaaagtagtggtccataaagagacagagatcacaccagaagatggagaggattgaccagaggaataacttagcttgcacatgaatgcagtcatgcaaaccgttaggaaaaccagagcctatatggagttccctcttctaacccaactgacttgtatctgtccgtggaaaatttcagtccagaagaattgaccttgaccattaataaagacactggcagagagatcttcccataataaagcaatctgattcagcatcactaaaccgataatgcatgaagcaacgataaaattacaaaagagcagcatttttaattttcacaaaatgtctcagttttcagctatacctgcacgttcataaccaacaatataaaccgtggtctcatgtaacacataaacaattcatgcctttcatagtttattattattaaagtctaaacaaaattgcaatttcttaggtaaccttatatttacaataaatgaagattaccctcaaatgctagaagctgtctaggtccgtccggtgtgtcagattttcctcagattagatgtgccaataaccaagtttattcagtaaacaacttgtacttgtttcatctggttttattactctcacccataaacagtaatgactctctgaccctctggaaatatgtaatgcttccaatcttgctttgtgtatctcatttaatttgttccggntaaggtagtactgattttagcatattaatgcgatttcttccttgttgtttgctttggtctgtgttcaatccagagagcttaaattgtcattattttgggaagaaaacctgtatttttgttagtttacaatattatgaaatttcacttcagnagaaactgctgggcttcctgtggctttgttttcttagttactttttccgtgccgtgtattttttaattgatttttcttcttttacttgaaaagaaagtgttttattttcaaatctggtccatatttacattctagttcagagccaagccttaaactgtacagaatttccactgtaattaaaactatttagtgttagttataaatagccttcaaaaagagagattctccattacacgatcacctgcatcacagcccatggtgaatgtatgtttctgcatagcgaaataaaaatggcaaatgcactg

SEQ ID NO: 159047 - DNA, 4744 bp, Homo sapiens
  misc_feature (3440)..(3440): n is a, c, g, or t
  misc_feature (4288)..(4288): n is a, c, g, or t
  misc_feature (4439)..(4439): n is a, c, g, or t
taaagggctaaagctattggcattggcagctgtctccaggcgtcgtccgcggagcctgaccctgcgccaggacggaggaggctgtgcccatgtaactgtcctgaagtactgcggtggccccctcccccgcggctgggagggcaggcaggacgaggttggctttcctcgcacggtctctgggcgtgggcccccgccgcagctccgcggagcctcggtgtctcctgcaacagggggcggggggaacagcggcgagcagccctgggctgcggcttcctccccacgcccgagtctcctgcgcaccgccgccgaggacgcgcgcccgagcctagtccccacgccgcggcgcgcccgggctccctgctgatcccagaacaatcaaccatgacgaccgaatctggatcagactcggaatccaagccggaccaggaggccgagccccaggaggcggcgggggcgcaggggcgcgcgggggcgcccgtgccggagccgcccaaggaggagcagcagcaggccctggagcagttcgccgccgctgcagcgcacagcaccccggtgcggagggaggtcactgacaaggaacaggagtttgctgccagggctgcaaaacagctcgaatatcagcaattagaagacgataaactttctcagaaatcatctagcagtaaactctctcggtctccattaaagattgtcaaaaagcctaaaagcatgcagtgcaaagtgatacttctcgatggatcagaatatacctgtgatgtagagaaacgctccagaggacaagtgctgtttgataaagtgtgtgaacacttgaacttgctagagaaagactactttgggcttacgtatcgagatgctgaaaaccagaagaattggttggaccctgctaaggaaataaaaaaacaggttcgaagtggtgcttggcacttttcatttaatgtgaaattttatccaccagaccctgcccaactatctgaagatatcaccaggtactacctctgcttgcagttgcgagatgacatcgtgtccggaaggctgccctgctcctttgttaccctggccttgctgggctcctacactgtccagtcagagctcggagactatgacccagatgaatgtgggagcgattacattagtgagttccgctttgcaccaaaccacactaaagaactggaagacaaagtgatcgagctgcacaagagccacagaggaatgacgccagcagaagcagagatgcatttcttggaaaatgccaaaaaattatcaatgtatggggtagatttacatcatgctaaggactcagaaggggtagaaattatgttaggagtttgtgcaagtggtctgttgatatatcgcgaccggctgcgaataaacagatttgcctggcccaaggttctaaagatttcatacaaacggaacaacttttacattaagatccggccgggagagtttgaacaatttgaaagcaccattgggtttaagctgccaaaccatcgagctgccaagcgtttatggaaagtatgtgttgagcatcatacatttttcagactactgttaccagaagcacctcccaagaaattcctaaccttgggttccaagtttcgttatagtggcaggacacaagcgcaaacgagaagagccagtgcgttgatagatcgcccagcaccttactttgaacgctcatccagcaaacgttataccatgtctcgcagcttggatggagaggttggtactggccagtacgccacaacaaaaggcatctctcagaccaacttgatcaccactgtgactccggagaagaaggctgaggaggagcgggacgaggaagaggacaaacggaggaagggggaagaagtcacgcccatctcggccatccggcacgagggaaagtcacctgggcttggcactgactcatgtcccttgtcacccccatccacccattgtgcccccacatctcccacagagctccgtaggaggtgtaaggagaatgactgcaaactgccaggttatgagccgtccagagctgagcacctgcctggagagcccgccttggactctgatggcccagggaggccttacctaggggatcaagatgtggcttttagctacagacagcaaactggcaaggggaccaccctgttctccttctccttgcagctccctgagtcattcccctccctcctagatgatgatggatacctctctttccccaacctttctgaaaccaacctcctgccccagagcttgcagcattacctcccgatccgctcaccgtcccttgtgccctgtttcctcttcatctttttctttctgctgtctgcctccttctcagtgccatacgctctcactctctccttccctctggctctgtgcctctgctacctggagcccaaggcggcctccttgagcgcctccctagacaatgacccgagtgacagttcagaggaagagactgacagtgagcgcacggacaccgcagccgacggggagaccaccgccactgagtcggaccaggaggaagatgcagagctcaaggcacaggagctagaaaaaactcaagatgacctgatgaaacatcaaaccaacattagcgagctgaaaagaaccttcttagaaacctcaacagacactgccgtaacgaatgaatgggagaagaggctttccacctcccccgtgcgactggccgccaggcaggaggatgcccccatgatcgaaccacttgtccctgaagagactaagcagtcttctggggaaaagctcatggatggctctgaaatcttcagtttattagagtctgcgcgaaaaccaacagaattcataggaggggttacttctacttctcaaagctgggttcagaaaatggaaaccaagacggagtccagtggaatagagacggaacccaccgtgcaccacctgccgcttagcactgagaaggtggtgcaggagaccgtgttggtggaggagcggcgtgtggtgcacgcgagtggggatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaagaagtgccagtagttcacaccgaaaccaaaaccatcacatatgaatcatcacaggtcgatccaggcacagatctggagccaggcgtgctgatgagtgcacagacgatcacatctgaaaccaccagtaccaccaccactacncacatcaccaaaactgtgaaagggggcatttcagagacaagaattgagaagcgaatagtcatcacgggggatgcagacattgaccatgaccaggcgctggctcaggcaattaaagaggccaaagagcagcaccctgacatgtcagtgaccaaagtagtggtccataaagagacagagatcacaccagaagatggagaggattgaccagaggaataacttagcttgcacatgaatgcagtcatgcaaaccgttaggaaaaccagagcctatatggagttccctcttctaacccaactgacttgtatctgtccgtggaaaatttcagtccagaagaattgaccttgaccattaataaagacactggcagagagatcttcccataataaagcaatctgattcagcatcactaaaccgataatgcatgaagcaacgataaaattacaaaagagcagcatttttaattttcacaaaatgtctcagttttcagctatacctgcacgttcataaccaacaatataaaccgtggtctcatgtaacacataaacaattcatgcctttcatagtttattattattaaagtctaaacaaaattgcaatttcttaggtaaccttatatttacaataaatgaagattaccctcaaatgctagaagctgtctaggtccgtccggtgtgtcagattttcctcagattagatgtgccaataaccaagtttattcagtaaacaacttgtacttgtttcatctggttttattactctcacccataaacagtaatgactctctgaccctctggaaatatgtaatgcttccaatcttgctttgtgtatctcatttaatttgttccggntaaggtagtactgattttagcatattaatgcgatttcttccttgttgtttgctttggtctgtgttcaatccagagagcttaaattgtcattattttgggaagaaaacctgtatttttgttagtttacaatattatgaaatttcacttcagnagaaactgctgggcttcctgtggctttgttttcttagttactttttccgtgccgtgtattttttaattgatttttcttcttttacttgaaaagaaagtgttttattttcaaatctggtccatatttacattctagttcagagccaagccttaaactgtacagaatttccactgtaattaaaactatttagtgttagttataaatagccttcaaaaagagagattctccattacacgatcacctgcatcacagcccatggtgaatgtatgtttctgcatagcgaaataaaaatggcaaatgcactg

SEQ ID NO: 159048 - DNA, 2143 bp, Homo sapiens
  misc_feature (1687)..(1687): n is a, c, g, or t
  misc_feature (1838)..(1838): n is a, c, g, or t
agcggaagcgcgctgcaggtggcaacttggaggtgccgccaccgcagctgcgggaggagcccgggtctggcggccccttccagcctccaggagctctttcccgccgccgagcccgagactggacctcggagaattcgaaggaaagagcccctgcggagggacctgtgagcagccctacctctctctgcccttgcgctactttttttctccaaggaaggttgtgcctgcgggctgcgaacaagctccgggaggggccccaaaggaaggcttcggtgactcagactcggaatccaagccggaccaggaggccgagccccaggaggcggcgggggcgcaggggcgcgcgggggcgcccgtgccggagccgcccaaggaggagcagcagcaggccctggagcagttcgccgccgctgcagcgcacagcaccccggtgcggagggaggtcactgacaaggaacaggagtttgctgccagggctgcaaaacagctcgaatatcagcaattagaagacgataaactttctcagaaatcatctagcagtaaactctctcggtctccattaaagattgtcaaaaagcctaaaagcatgcagtgcaaagtgatacttctcgatggatcagaatatacctgtgatgtagagaaacgctccagaggacaagtgctgtttgataaagtgtgtgaacacttgaacttgctagagaaagactactttgggcttacgtatcgagatgctgaaaaccagaagaattggttggaccctgctaaggaaataaaaaaacaggttcgaagtggtgcttggcacttttcatttaatgtgaaattttatccaccagaccctgcccaactatctgaagatatcaccaggtactacctctgcttgcagttgcgagatgacatcgtgtccggaaggctgccctgctcctttgttaccctggccttgctgggctcctaaagaggccaaagagcagcaccctgacatgtcagtgaccaaagtagtggtccataaagagacagagatcacaccagaagatggagaggattgaccagaggaataacttagcttgcacatgaatgcagtcatgcaaaccgttaggaaaaccagagcctatatggagttccctcttctaacccaactgacttgtatctgtccgtggaaaatttcagtccagaagaattgaccttgaccattaataaagacactggcagagagatcttcccataataaagcaatctgattcagcatcactaaaccgataatgcatgaagcaacgataaaattacaaaagagcagcatttttaattttcacaaaatgtctcagttttcagctatacctgcacgttcataaccaacaatataaaccgtggtctcatgtaacacataaacaattcatgcctttcatagtttattattattaaagtctaaacaaaattgcaatttcttaggtaaccttatatttacaataaatgaagattaccctcaaatgctagaagctgtctaggtccgtccggtgtgtcagattttcctcagattagatgtgccaataaccaagtttattcagtaaacaacttgtacttgtttcatctggttttattactctcacccataaacagtaatgactctctgaccctctggaaatatgtaatgcttccaatcttgctttgtgtatctcatttaatttgttccggntaaggtagtactgattttagcatattaatgcgatttcttccttgttgtttgctttggtctgtgttcaatccagagagcttaaattgtcattattttgggaagaaaacctgtatttttgttagtttacaatattatgaaatttcacttcagnagaaactgctgggcttcctgtggctttgttttcttagttactttttccgtgccgtgtattttttaattgatttttcttcttttacttgaaaagaaagtgttttattttcaaatctggtccatatttacattctagttcagagccaagccttaaactgtacagaatttccactgtaattaaaactatttagtgttagttataaatagccttcaaaaagagagattctccattacacgatcacctgcatcacagcccatggtgaatgtatgtttctgcatagcgaaataaaaatggcaaatgcactg

SEQ ID NO: 159049 - DNA, 2215 bp, Homo sapiens
  misc_feature (911)..(911): n is a, c, g, or t
  misc_feature (1759)..(1759): n is a, c, g, or t
  misc_feature (1910)..(1910): n is a, c, g, or t
ccgtctctgctttaccaaacaagagcacctggttttctattttatttcccattcttttcgtttccaaactctgagattccttcgttcttcctcctccctgtctcctctgcctacgattttgtctaacaagctgtgaatgtttatgtgcctgagtttgtgtctctcttttgtgcttgactctgcctctctttgttcactcagactaagcagtcttctggggaaaagctcatggatggctctgaaatcttcagtttattagagtctgcgcgaaaaccaacagaattcataggaggggttacttctacttctcaaagctgggttcagaaaatggaaaccaagacggagtccagtggaatagagacggaacccaccgtgcaccacctgccgcttagcactgagaaggtggtgcaggagaccgtgttggtggaggagcggcgtgtggtgcacgcgagtggggatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaagaagtgccagtagttcacaccgaaaccaaaaccatcacatatgaatcatcacaggtcgatccaggcacagatctggagccaggcgtgctgatgagtgcacagacgatcacatctgaaaccaccagtaccaccaccactacncacatcaccaaaactgtgaaagggggcatttcagagacaagaattgagaagcgaatagtcatcacgggggatgcagacattgaccatgaccaggcgctggctcaggcaattaaagaggccaaagagcagcaccctgacatgtcagtgaccaaagtagtggtccataaagagacagagatcacaccagaagatggagaggattgaccagaggaataacttagcttgcacatgaatgcagtcatgcaaaccgttaggaaaaccagagcctatatggagttccctcttctaacccaactgacttgtatctgtccgtggaaaatttcagtccagaagaattgaccttgaccattaataaagacactggcagagagatcttcccataataaagcaatctgattcagcatcactaaaccgataatgcatgaagcaacgataaaattacaaaagagcagcatttttaattttcacaaaatgtctcagttttcagctatacctgcacgttcataaccaacaatataaaccgtggtctcatgtaacacataaacaattcatgcctttcatagtttattattattaaagtctaaacaaaattgcaatttcttaggtaaccttatatttacaataaatgaagattaccctcaaatgctagaagctgtctaggtccgtccggtgtgtcagattttcctcagattagatgtgccaataaccaagtttattcagtaaacaacttgtacttgtttcatctggttttattactctcacccataaacagtaatgactctctgaccctctggaaatatgtaatgcttccaatcttgctttgtgtatctcatttaatttgttccggntaaggtagtactgattttagcatattaatgcgatttcttccttgttgtttgctttggtctgtgttcaatccagagagcttaaattgtcattattttgggaagaaaacctgtatttttgttagtttacaatattatgaaatttcacttcagnagaaactgctgggcttcctgtggctttgttttcttagttactttttccgtgccgtgtattttttaattgatttttcttcttttacttgaaaagaaagtgttttattttcaaatctggtccatatttacattctagttcagagccaagccttaaactgtacagaatttccactgtaattaaaactatttagtgttagttataaatagccttcaaaaagagagattctccattacacgatcacctgcatcacagcccatggtgaatgtatgtttctgcatagcgaaataaaaatggcaaatgcactg

SEQ ID NO: 159050 - DNA, 2493 bp, Homo sapiens
  misc_feature (1189)..(1189): n is a, c, g, or t
  misc_feature (2037)..(2037): n is a, c, g, or t
  misc_feature (2188)..(2188): n is a, c, g, or t
actgtgtaattccttcccctaaggagaggtcattgcttcctcctctgaacttcagcagtacctcacttgacccttaccaatttcagcctcctatcacaagtacctgtactgacatacaagcatcgtcaccctactggaagacaagcgccttaggagaaggtccaggtatgccggcatactctggcccttctgttgctttgcttgaacttgtgttcttgtgagaaggtagtgtgacacagagaaatcacagagaaagaaaatgacctgtctgacctgtgccagagcgtgtttaaccagatggtttactttctgtccctgccttcctcctggaacctgatcacttctgtggtcaacagactgacagtgagcgcacggacaccgcagccgacggggagaccaccgccactgaggagctagaaaaaactcaagatgacctgatgaaacatcaaaccaacattagcgagctgaaaagaaccttcttagaaacctcaacagacactgccgtaacgaatgaatgggagaagaggctttccacctcccccgtgcgactggccgccaggcaggaggatgcccccatgatcgaaccacttgtccctgaagagaaaatggaaaccaagacggagtccagtggaatagagacggaacccaccgtgcaccacctgccgcttagcactgagaaggtggtgcaggagaccgtgttggtggaggagcggcgtgtggtgcacgcgagtggggatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaagaagtgccagtagttcacaccgaaaccaaaaccatcacatatgaatcatcacaggtcgatccaggcacagatctggagccaggcgtgctgatgagtgcacagacgatcacatctgaaaccaccagtaccaccaccactacncacatcaccaaaactgtgaaagggggcatttcagagacaagaattgagaagcgaatagtcatcacgggggatgcagacattgaccatgaccaggcgctggctcaggcaattaaagaggccaaagagcagcaccctgacatgtcagtgaccaaagtagtggtccataaagagacagagatcacaccagaagatggagaggattgaccagaggaataacttagcttgcacatgaatgcagtcatgcaaaccgttaggaaaaccagagcctatatggagttccctcttctaacccaactgacttgtatctgtccgtggaaaatttcagtccagaagaattgaccttgaccattaataaagacactggcagagagatcttcccataataaagcaatctgattcagcatcactaaaccgataatgcatgaagcaacgataaaattacaaaagagcagcatttttaattttcacaaaatgtctcagttttcagctatacctgcacgttcataaccaacaatataaaccgtggtctcatgtaacacataaacaattcatgcctttcatagtttattattattaaagtctaaacaaaattgcaatttcttaggtaaccttatatttacaataaatgaagattaccctcaaatgctagaagctgtctaggtccgtccggtgtgtcagattttcctcagattagatgtgccaataaccaagtttattcagtaaacaacttgtacttgtttcatctggttttattactctcacccataaacagtaatgactctctgaccctctggaaatatgtaatgcttccaatcttgctttgtgtatctcatttaatttgttccggntaaggtagtactgattttagcatattaatgcgatttcttccttgttgtttgctttggtctgtgttcaatccagagagcttaaattgtcattattttgggaagaaaacctgtatttttgttagtttacaatattatgaaatttcacttcagnagaaactgctgggcttcctgtggctttgttttcttagttactttttccgtgccgtgtattttttaattgatttttcttcttttacttgaaaagaaagtgttttattttcaaatctggtccatatttacattctagttcagagccaagccttaaactgtacagaatttccactgtaattaaaactatttagtgttagttataaatagccttcaaaaagagagattctccattacacgatcacctgcatcacagcccatggtgaatgtatgtttctgcatagcgaaataaaaatggcaaatgcactg

SEQ ID NO: 159051 - DNA, 562 bp, Homo sapiens
ccactaccatgctcagttaacttgtttattttttgtagagaagaggtctctatgttgcccaggatgatctcaaactcctgggcttaagctatcctcccacattggccttccaaagtggtgggattacaggtgtggactgccacacctggccaaagttttttattttagtaaattgcaaatatcttttgcattaacatttttgtcttcttgtcctccacacttgaggagttcttctattttgtaattaaaatgtcttgtatatctgtactttcttgcctgtttccattgccactaatgtaattcaaaccaacatcacttccgacaagacaattaaggtagctttctaactagtttctccatcttcagctttcccaaattccaaattcgttttgccagtacaccacatcaattgttttttcttcttcttcttcttttttttttttttttttttttttggaaacgggtttttgcttggacccccgggccgaataccgggggcttgatcagggttccctggagccttgacttcgggggcgcaggtgatcctctcgctttagcttct

SEQ ID NO: 159052 - DNA, 492 bp, Homo sapiens
ctgacatttcccatggcagttaacatttttccactttatcaaatacacatttatttgtcaaatatttgctgggtaccactctgtgctaggtattggggatacagtcatttgcatcacaaagtccctgctcagtgtaataagcactcattgagcacctacctatgtgtgaggaactgtgctagggggtatcagaaacacacaaaataggccgggcactgtggctcatgcctgtaatcccagcactttgggaggccaaggtgggcagatcacctggggtcaggagtttgagaccagcctgaccaacatgatgaaaccccatcactactaaaaatacaaaaaaattagccaggtgtagtggcacatgcctgtagtcccagctacttgggaggctgaggcaggagaatggtgtgaaccctggaggcggagttgcagtgagccgagaatgcgccactgcactccagcctggggaacagagactctgtctaaaaaaaa

SEQ ID NO: 159053 - DNA, 291 bp, Homo sapiens
caggagtaggggatcccaaacattttctgtttaacctgtcacttccagagttagtcgtcttttcactgaatctcagggctattcactcaatctaaatttattactgagcctacagggagcccattgccagtgtgacccatgccccctctcaggtaaaaggtcttttgggcttctcatatcaagggaataaataaaatttgcagatgtatccctgaacaggtgaggaagccaaaatccagggagtttaaactgtacctcaggcaaggtagcaaagccaagggacagcagtct

SEQ ID NO: 159054 - DNA, 581 bp, Homo sapiens
  misc_feature (513)..(513): n is a, c, g, or t
  misc_feature (540)..(540): n is a, c, g, or t
  misc_feature (545)..(545): n is a, c, g, or t
  misc_feature (548)..(548): n is a, c, g, or t
gtgaggacctgagatttggaggggccaggggtggaatgataatgatttggctgtgtccctattcaaatctcaactgaattatatgtcccagaattctcacgtgttgtgggagggacttacggggaggtaactgaatcataagggccggtctttcccatgctattcttgtgatagtaagtctcgggagatctgatgggtttatcaggggtttccgcctttgcttcttcctcattctttcttgctgccacattgtaagcagtgccttttgcctctgccatgattatgagacctcccagccatgtggaactgtaagtcaaattaaacatcctgttcttccaaataaaaaaaaaacaaaaacatgttgctcctaatcctgagcagagttttactttcctgaaggtaaaatctcctggctccggccgggcgcggtggctcaggcctgtaatcccaacactttgaaaggctgaggcgggtggattgcctgaagtcaggagtttgagaccagccgggcanacagtgacactcatctctatgaaaatntttanaantgacaggatcccggagacggtacgagtcgatcg

SEQ ID NO: 159055 - DNA, 236 bp, Homo sapiens
ggctaatttttgtatttttagtagagacggggtttccccagtcacatggtaattctatgcttaacttttcgaggaagttctgaactgtttcctgaagtggctataccattttacatttccagcagcaatgtaggagggatccaatttctctatatcctcaccaatatttattattagctgactttttgattacatgtgtcctagtggagtgaagtaatagctcattgtggttttga

SEQ ID NO: 159056 - DNA, 189 bp, Homo sapiens
tagagcttggtcaagatgtcctaatggtctaaaatgtcaaaagaaaactagatgaggaaaaagtaatagaaaataactctattataagcttccttatagttcagattcatctctttcttgtaagaaccacccaccagttcctactcagagactcaaggatactcctgttcctcagttggttcaagataa

SEQ ID NO: 159057 - DNA, 401 bp, Homo sapiens
cgggtagatcacctgaggtcaggagttcaagaccagcctggccaacatggcgaaaccccgtctctactaaaaatacaataattagttgggcatgatggcgggtgcccgtaatcccagctactcgggaagccgaggctggagaactgcttgaacccgggaggccgaggttgcggtgagccgagattgcgcacttacccttgccttttccttgaggatgttttgccatttagcatgaggaagtcaggcgggactgacttccactgggccaagttcacagaggttcagccaggcagctgggacttgacgaaacaggagaggagggcactgacctcccaaatctacgtgcaccctcccttagaggcatctgccaactcaagctgctcactatctgcaagaccccc

SEQ ID NO: 159058 - DNA, 281 bp, Homo sapiens
acctggaaaaatatagagacagaagatgtaaatgaaagactatttcccaggtatatggaaacagcaggaaaatgtaatgcatcttggagaaatcataagggtctgagtgaaaactctttagttaagtgaagcaaaaggagcaccagtgaaaagtggtggcactagtgattccagcagataggcaaggagatctgaaaatataatttctcctacttaaaccgttttttaaaattctttctgtttcactgtaaaacttaaatccaagtaccggtgatcgtaag

SEQ ID NO: 159059 - DNA, 321 bp, Homo sapiens
ccacctgggcctctcaaagtgctgggattacaggcatgagccaccatgcccagcctctccatcagactttggatctggaagatagtaagaaaaaaagcaaagtaacttagttctgtcctttcctagaggacgtaagcagtcttggcctcttcatgatggtccactttgttaccgaattattgggtacaaaagtgaggtctgcaacaggctttggatgtttcaaggtgtgtctggctgtggtttgctttctgagtgccagctttaatgtcctcttattttctggcaagggttgatggatgtggcactgaatattttctgaat

SEQ ID NO: 159060 - DNA, 530 bp, Homo sapiens
gggcagctgtcagggaaatgatgtcagcggaaatgatgggggcaggatggagaggaggtggactccaaccctgggggagggagaggagcggcggcctctgggggaaggcaggagggtgtggcagtctggggatctgccctacaaacaggggctgtgcggggtctgatggagaggaactcgagccggggcaggggcagagggcagagttcctgctgagggtggtggagctgtgtgcagagacatgcccgtggcgccagcggggggcacagggcagccaggagtggggagaaggttgaatgtcaggctccagagttccaggcagaggcgggaaccatgagggcagtttcctcaccaccaggaaggggctctacagctcccatcaagaagcccgctgtagcctgaggtcagctgctggccaggacctcaaccacagcctcactcagacacctcttgcaaggagccatcccggcttccactatagggagagcaacagaggctccatccacctgcaggctggtcagccgcggagc

SEQ ID NO: 159061 - DNA, 256 bp, Homo sapiens
acgggcagtctctggtataatgtgcacatgaatacgaagggggtaagaagaacgccctgggcatctctctttgtgggagagcgagacagctagctcctcatcctctcctggagagggtaaacccgcccctgaagtggtcaccccagtacccagccttctcagtctcctcccccactccttttgcattaccgccgtcctttactgtgccggagccttaggatctacaatatggctcatttcagaaaagcttattttg

SEQ ID NO: 159062 - DNA, 146 bp, Homo sapiens
gtattagacttcagagtgagaaagaacttcactatcaaatctcttttcctattcataaattaattttgggatggggcacagaaacaaagaccagtggacataaatctgagtctcagtctaactggcgttttctgaactacaccatt

SEQ ID NO: 159063 - DNA, 420 bp, Homo sapiens
tctaccaaaattacaaaaattagctgggcgtggttgcctgcctgtattcccagctactctggagcctgaggagggaggatcacttgagcgtgggaggcagaggttgcagtgagcctcgatcgcaccactgagctacagcctgggtgacagagccaggccctatctcaaaaagaaaaaaactatctctttcaatggatctcatagtgctaaggatctgtgcaagctttagagatttctggaaatgataacaacatagctggggaaaaataagagagaaactggaggaagaggtaagcagacatggctaattaaggaaagttgagggcatgatgggtgaacctatgaaatttaggacaagaccccagtaagacaatgagttcccaggacttgcccattgactttcagccctatgagatgtga

SEQ ID NO: 159064 - DNA, 394 bp, Homo sapiens
ccagcccaccagatcttaaacaacataatttccactgcattctataggacaaagcaagtgacttggtcagcccaaattcaaagggatggagaaataggggcatacacacagggatggaatttacagcaaaggggaaatttcagcaaaggggcatacacacagggattgaagaaatttgtgaccattgatattaaacaatctttgccttggcgtctgctttgggacacagggacagctctaaattaagacattagctgaatcagcaatgaagaaaagaagaaaaaggctaccttctagaggtgtgttgatattaaataagaaaatacatttgaaagatacttaactgaggcctggcacgatggctcatggctgtaatccaatctttgggaggcta

SEQ ID NO: 159065 - DNA, 144 bp, Homo sapiens
accacactcattacttcctaaggttcctgggcatgagtcttctgagtgcctgggccagagctgcagctgttgactcaagacaaggtaaaaagagcaagagcacctcacaggagaggacacccacacaaccaagaaacatacata

SEQ ID NO: 159066 - DNA, 493 bp, Homo sapiens
ccatgcccagaactgcgagctcctgagaccagttgcagaaaccagcatgttttactggctcccaggcggttctgatggaggatgtcccaggaggggactctgagatgggctatttgtaatctacggcaactgcctcacaacagagtgtgttcgtggagaagaggaaactgggcaccgagggctcagaagcagatggcagataatcaggaatatgtgaaaaattatggcacctccatatataataaaatattacagacatttctaagggaaaaggtaggcttctgagaaatgacacagagattgcctatgacattaagtgtacaaaaccagggaacgttaacagtacacacagaacaagcaatcacatcttgtgacatacatgttacaaacatacacatgtataacatatatccctgtgtgcatatgtgcacaactgatggctggcagatggatccctaatccattgtcatctgttagccctgagcaggtggga

SEQ ID NO: 159067 - DNA, 551 bp, Homo sapiens
agaaaaattccgaaaaaacaataacaataatgatgttcaaccacatacaaacatttattatacagctctgataattaaaacagcatggcagtagaactagaatagacagacgtgtccacggaaaataagaaaacatctgaaaacaaaataaatactcaaattcatttattcaaacatttattgagtgcctgctatgtacgggcactgtggatggttacttgatggcaaaaccaaaaagtcaacgtcagaccaaaggatgaagtattcaataactggctatctgtgtggggaaaaagatatttttctcacattttacactcaaatacatctcaaatacttaattatatacaactcctagcactactagaataaaacaggtgaatatttacatataatttcatgatgggaaatatgtgagttcgaaacaatcattgtgaaatatgttaatttaaatgttaacagggtgtaaactactgactagctaaataatggatggtcatgtagtcattaaattgttgatgaagaaatatctttttttttttttttttttt

SEQ ID NO: 159068 - DNA, 494 bp, Homo sapiens
agagaaagctgaggcaggaaggagcttctgttccccaggaaccagagagagcccagaggaaaagaatcagggggaggaggaaaggagaggtgaggtcagatatggaagcaaagccaggccacgtcttggtagagtttgggttgtcttttatgtggaggattcagtccacctgactctggagctcatattgttctcatcaccctgtgctaccctcagttacaagtctgaatgatcccacaaacatacacagggcactcaccaaatgaggtcctgagcaggtccttgttagagccactttccaaggctcctgacctgtgatcccagatcctcaataatcaaagaaattagtcttcagatgcttgactcaggaatggggataccatttatctaaggtcaggccccagagctcaaggacccaggtcacagtgttcagtaaatattcactcccctctccttcctgtggtggtaggatgttggccagaccaggtgatttg

SEQ ID NO: 159069 - DNA, 433 bp, Homo sapiens
aaaaaaagaatgaaaacatctgtcacatcatgtcactctctgcttcagatcctccactggcttcccatttcatgagtaaaatccagtgtatttaaggagcttgtaaggctgtataatgtttgcctattcacctagctttaccattctgtttttccccctccctttgtctctgccaccctcacttgttcctcagatatgacatctgcatcacagccttttactttctattctctggctggaatgctgttttttcttaaacctttgtctttctgattgattgattgattgagatagggtctcactctgttgcccaggctggagtacaatgacacagtctcggctcactgcttgagcctgggaggcgtgggttgcagtgagctgagatctgctactgcattgcaacctgggtgatagagcgagactctgtctcagg

SEQ ID NO: 159070 - DNA, 1275 bp, Homo sapiens
  misc_feature (1)..(4): n is a, c, g, or t
  misc_feature (1188)..(1188): n is a, c, g, or t
nnnngggaaggctgcctaagccagagagcttcacagggagccttgatgtctgagtaagaattaaccaggtgaagcagaaggggaaataggctctaggaacagagagctttgagcacaaaggcaggcagagtgtgaggagaggaggccttacttccttgtgactgcagcatgaagtttgttcatatatcacgtagcaattactagccttgtctggctgacatatacctgagggagtgtggaaagtgccgaatgcctgaagataaatcaactcttcctctgggagggcacggataaacaacttcatcgatgtgcttcaggttaccatttgaaaaggcagtagagatatgtataaaggcttccagctttggcatctgactagccgtaagagcttctgggtggcagtgatgttaagttgcacagcatgtctacagaagattaagcagaaggaaatacagtgagataagtcagcatcatgccttgctataactgcacctactcccataactggcatacctatcagattttggtggctgcaccaaaacaccaggaagaaaaggatggggcacggctgcacagttatgtgatacttggaatgtcttatgtattgatgatgtgtttgtgtacataaaccctattcactgatgcactgtatggcatatttagaggtcacttggctctaatcaactggaaaaagaatcacaatcctctgaatttacaaaggtgcttctataagcagccattaaaagaacaaaaacatgtaaattaagcatctaactgaagaaattggaaaatataaataaactggagagaagcaacagtggatttttaaatgagcaatataagttgttataaagttccaggccagacatgaaaattgatgtcaaaatctgaaattgcaactactggaatacaaagctatatagacagtatgtgataacaatgaaatacttcattctaggaatacatggtttatcgaataccaggaaacttattaatttaatttaactcaaaaagagaaaaactatataataatctgtatgtattttgaaaagtttaagacgatgtttagttttcatttccaatttcattaaatgaattcactagaataggaataaaatgattaaacaatatgtatttaatttgctagccaatgtcattcttaatggtgaaaagctaggaatactgctngtaaagccagggctagaaataatgcctgcagtcacaactactacttaacattgttctgaggtcctagccttgtaagtaattagaaag

SEQ ID NO: 159071 - DNA, 415 bp, Homo sapiens
ggagcaactcatcgagcagggacagctggctgtatttctttcattcattcaacaaacatgcattttgtgactgatcagcgtgttgcacagagtcttaaaagtaatggcccctgccctccagccccctgtggtgagaagactgatccattagtgaacaatcacgacaccatgtcacctggactgcacaagagagaggcgcaaaggctgtgggaggccatgggagaagcccacctcagtctcatgaaatcagagaagcctccctgcaggaggatttctctaagccaagtactaaagtacaaataaagaggcagccacatacagcagagaggggggctgagcagccaatagtaatgaccccctttcattgagttcctactgtacgccaagcactaggctaagcagtatttacagtcgt

SEQ ID NO: 159072 - DNA, 539 bp, Homo sapiens
atttcacctactaaaaacacatggcctataaacccactcattcttaatggaaaacccattagttaatttgaacaataaagtagcattagagtaccttgttaatgaaatggaaattagggatcaattgctacctcagacaaaatgtggtaagaattaaaatggtatttccagtctaacatcacagcaactcagtaactagcaaagatttttacttgaaatcacccccacaatgaacaggagatctgattcccatggatgacaatgtacagtttctatttttatccttgtaaatggaagggcagatcattttgccaatccccaaagattccatgtttcattcataaaactgaatgaaaagagactaataaattctttaacagttaatacttattaatgtgtttaaaaactagctgagttttacaattagtgttttacaaaatggaagttcaaaatttaagagaaaataagtgatgagaagaaatagtagttgtcaatgctgtagaaagcagtaccttaaaaaatgaaacaaagataccaac

SEQ ID NO: 159073 - DNA, 454 bp, Homo sapiens
tcccacaatacttgcagtcatatcagttacaaccgctgggtgtgtattggttcaaaaggacctacctacaaggttatatcaatccattgtccaatttgagagattttttctgaatccagttaaaataatttttggctacacctggggacacttcccaggacaacaatgacttgtagtctagtgcccaagaaagccaaaaaggcccggcaaccttggttgccaccagatccccaacagacagattctaagggagaagagaagttcatcaactaacactcacagtgtgtctgcatttttccttcataattatgtgagtttcacttaatggggctgtcactgtagctcattttaattgctataaatcaatgaggtaaatcttttgcatatatatcaaatattaccatcctgatgttagagattttctttccaaggcaaatagaactttcaccaaaaa

SEQ ID NO: 159074 - DNA, 332 bp, Homo sapiens
gtcattttgacattaactttgtagttttccatgacgtccgcgccctcaaatgacaagctattgcaggttcattctgtgccccaggcctgaatcacccatttctctaaggaatcttatcctttaatgggaaatggaattttaaggcaataatctcagatttcaaaactttcaaagatttcataagatttttatgaaatgtttagagttagaaggggctttggagatagtcttgtgcacccagaaagcagtggtggccggttaggcacagagctggttggtcacagagctaagagttaacatggccagctgacttccggcgccaggttccttct

SEQ ID NO: 159075 - DNA, 348 bp, Homo sapiens
aaattagccaggcgtggtggcgcatgcctgtaatcccagctactcaagaggctgaggtaggagaatcgcttgaacccaggaggtggaggttgcggtgagccaagatcgcgccattgcactccagcctaggcaacaagagcgaaactctgtcaaaaaaaaaaggtacactccatgatgactcttgcattggagctggccagtgtgctctgctgtaccttggcatgctgttttcttaggtagagactgaacttaccactgcaacaggaaggcagctctccctcatatttgccctcactactgcaacagctgccgtcgacgcggccgcgaatttagtagtagtagtcgacc

SEQ ID NO: 159076 - DNA, 632 bp, Homo sapiens
aatgacctataaaaaccctcacagggtgtttgttatcctctctgactttactccctacaactgtccccgtcccctaccgcctctgttccatccactccagtttccctgctgttctttcacatgtcaggcatgttcctgacatgcctggacatacacatctgttgttttttctgcttaaaatatactttctccatgagtcacatggattattactttgctctgaaaggtaatgataaaaggtgacctctaaacaaagctatcacctttgtgaagtcttcttcaactaccctataaaaaaatgaactccactcatgccccgtactacacagccccttttcctgctttatttcacccccatagcacttattcctatctgatatacttctcgtatgccttctcttcccccatcccttttggcatgtaagctcctagaaggctaagattttgtctgttttgccatatccacagtgggtagtgtcttgtagacaataggtatttgatcaatatttaccaaacatatacatgagactgcctacaccacattaacatcaaacactgcttagaccttagcaccataggccttctgtcaaactgactcccactaacctcctgtacagtattatccttgactc

SEQ ID NO: 159077 - DNA, 681 bp, Homo sapiens
catgtctataatcccagcactttgggaggctgagaccaggcaggcagatcatttgagttcaggaatttgagattagcctggctaaaatggtgaaactccacctctactaaaactacaaaaattagccaggtgtggtggtgtgtgcctgtaatcccagctactagagaatcacttgaacctgagaggcggaggttgcagtgagctgagattgcaccactgctctccagcctgggtgacagagcaaaactctgtctaaaacaaacaaacaaaaaaatcaagttgtaaattcagtctctttgaccttaagctaacttaaaaaaaggctggccatggtggctcacacctgtaattgtagcactttgggaggccaaggtgggtggatcacttgaggtcagaagtttgagaccagcctggccaacaaggtgaaaccccgtctctactaagaatacaaaaattagccggaaatcacttgaacccaggaggtggtggttgcagtgagctgagattgtgccactgcactccagcaacagagcgagactgtctcaaaaaaaagaaaaattaatggtggatgcagtggctcacacctgtaattccagcactttgataggatgaggtgggcagatcacttgagctcaggagtttgagaccagtctggacaacatagtgagacctcgtctctac

SEQ ID NO: 159078 - DNA, 523 bp, Homo sapiens
attcatggaagaagggggactgaaactaggctataagaaggacaaagggaacaacagcatgcacaaaagcaaagtagtgagtatggcaaaaactaccgtatttgagaggccggcaagaatcccaactaagagtgagaaataaagctgaataggtagaatggaaccttcttaaaagccagactgaagcatacaaattcaatccagttggcaaagagaatccattatgggttctccagcaggggaactgacaagatgaaaccagtactttaaataaattacactgtcagtagttacagaagataaaatgaataagaaaggttgctcagggcaaccaaataaaaacttaataatccagacctacaaccattcattcattgagaagacagactgctaggtaacaacactggcctagaattcacacaaactgggcctaaattcctgctctgtcccctactacctgagcctcaattttctcactgttaaattcaggcatcagcactcagactgtcacagtacttgtcaa

SEQ ID NO: 159079 - DNA, 485 bp, Homo sapiens
tacatctgcctatcctctatgtataaacatttagtgaacattttttaaagtaatcacgaggagtgtggcaatattgaccaagcagccaagagactcaaaggaattagcatttgctgagcatcccctattttacatttgtcatgcactgttaggcacttttaacatgtttgaccacttagtcttccccaccatcctattaaacattaatcttaatttacagatgaggaagctgaggttcaggaggtttaagtagtgagttcataaaagaactaaaattcaaaattcaggactacctaacataaagcgcatgctctctccacataatctcaaaaaagcttataaaaaagacaaacggtataaaatgtactacactggggaggggcattatttcaggaagtaagagaaatcatcacccccagtaattaagtaagagaacaccttaacaatatcttactctcacaaaaaagcaaaatctagatgggttc

SEQ ID NO: 159080 - DNA, 210 bp, Homo sapiens
tatatatgtatatgtatttagcatgtatgcacgtgtatatgtatacacatatatacatatgtatgtataatacatattcacacatgtatgcatgtatatacacatgtatacattagtatatgtatatacacatgtatgtgtattatacatgtatatatgtacatacatatcagtctactgatttgaatattaatgtcatcaagaaataac

SEQ ID NO: 159081 - DNA, 259 bp, Homo sapiens
aaaaacctttgtgcttgacgggtgtagcaaagtgaaatgtctgaaatgttctttacaatgaactaaacttgctacctttcagaccacactacatccacttatgatttccagaaaatacatacctcctttgcacgcacttcaattacacaaagacaaattaatttgatacttccaaccttctcttacacacacactacaattctgaaaggaaactgtcaaattaagactgagacaaacatattctgctctatcatcttaa

SEQ ID NO: 159082 - DNA, 415 bp, Homo sapiens
ttcttaattacttcatattctgtcatcgctatcctggtcacctatctctggatatgaagtggttgctcagcatcctccaaatgcagcacctggaattcactcaaggtggatatgcccagttcagtgtggaaataggcatgcttgttagctgaagggcatataaagtaaggacccatgggacctagtggctgaacattggaagccaagaatcaaagatggctctcgggcatgagcctgggagctctgaggtttacagatttgtacctgggaggactgaggaagagagaagagaaggaagcttggggagtgggaagccaagaatcccacagtggaagacctcaagactggagccgttctcccagcttccaaggagcagctcattccccgctctataagctgtcacagggcgtgggag

SEQ ID NO: 159083 - DNA, 667 bp, Homo sapiens
tatagctgttcccgaggagtgattcgacggtgtcctgggcttctgggctggggcaccaggtgaggagaccatcctgaggctatggtaaatcaagctgggttttctctctcccatgggcattccacactgtctctttctccgttataggtgggaggctcatgcaagcccatttttaaacatttgtgcaatgaacttagtcaggatgaaagaaaaaaagaatattattgttcttatccctgtagcataagcagaatggggcttccgctggctttgttcatgctggagggtccctccttcctgcaagccatcccatccccatagaggtagcaaaacaggaagacaatgggctgggaggagaggttgaatagggtaagtggtcctgtcctgaattgtgaccctgcatgagtgaatgagcttcaagtttaagctggatggagtcctcatagcaccccatctaccaccctggtggggtggaggatggttctgctgtgtgggtctccttaagcacttcgttaagcaccccaatacaaattatccgtctactcagagttcccttggaccttccctcatcaacatgcctgacaagtagtgcaaacactaatagcgcagtatcactattactagtctagtcaaagccaaagaaagtcaatttgatttgggaaaggta

SEQ ID NO: 159084 - DNA, 548 bp, Homo sapiens
tcttagcaacctcttcacctgagtcatttaacttctctgacccttcatgtccttgtctgttaaatgaggtcagtaattgctgctcactcactaagagtcagaaggaatcatggatgcaaaaaccacactgcaaaccgtaaaacaccaagcagctgtggaaaacagtatggcggttcctgaaaaaataaaacacagaatgaccatctgatccagcaattccacttctggctatacacccaaaagaactggaggcacgggctcagacattgtacacccatgttcacagcagtacaattcacaacagccaagaggtggaagcaacctgtgtccattaacacacgaatgaataaacaaaaattagccaggtgtggtggcacacacctgtgatcccagctactggggaggctgaggcaggggaatcacttgaacctgggaggtggaggctgcagtgagcggagatcgtgccactgcactccagcctgggtgacagaatgagactccgtctcaaaaaaacacgtttccttctcctcagtgtcagtgtcacattc

SEQ ID NO: 159085 - DNA, 562 bp, Homo sapiens
ttacaacagctccagttacaacagctacagtgaaaagaatctcaggagaagactcaggaataaaaacagagaaagagattacaggctaaaattactagaaatcctcagaaaacaaagaaggaaaaagaaaccaggaaaaccatcagcccaattaattaaatcaaggagtgaccgggagatccagtttactaaaagaatggaaatttcttgaatttgaagagttgaggacgaacaatcaggaatagtctagagcaattgcccagtgtccaaagaacaggagcataaagaagagctggcaagagtgtctccagatggtgacaagtttgcagacttttactagactactttgaggccaacaagccaaccctggccctctacttatggagaaggcctacacaggattctgggatacagatggaaggatgacatcttttcaggttctctctttacagatgtgattgtccttccaattcctgagttctaactccaggcttgtgttttgaagggctcctctgagccacatggaagatcctcgggtaccccaatggagccctggaactat

SEQ ID NO: 159086 - DNA, 439 bp, Homo sapiens
ggatattgcgcaagactggggcgttggaaaccctgtaggtctggggaatgaaaaaggaagtgggactttgggaagtggttgctccttagtcttggcgggggttgggaatgggaaataagctggggaaaatttttatcttgggtaaggtacacctcgaagaataatcacttaattctgaaatctgattatgagaaggatacacagttaatgcctgtaaaatgaatgggcagcaaacattggctagtttttattttttgtttaaaaagtacagtagtttttatggtggaggtgatatgacttagtagtgaatactttttcacgttttaaagagactggtctagtaaagctttagcgttaaatttttaacagcttataaaataggcccttgaccatacacagtattatactagcatcgttgagctttgtgattcccgcctcc

SEQ ID NO: 159087 - DNA, 427 bp, Homo sapiens
tcctgacctcaagtgatccacccactttggcctcccaaagtgctgggattacaggcatgaactaccacgccctgtccctcctaagctttttgtagacacattgctgttgcctgagcctgaagagccttttctcctccctcctcctcacctggccaatcccatttgtgcattcagaactggacttcctcctccgggaagcctcccttgaccttccctgctcccacttgcaagttcactggcgaaatcccagaaccctttatccctttgctctctgagctcttaccacatgatttcgttcccttgtgaacatgattttgttcccttgtgggtttaaacaccatctgcagtcccatttcctgataccctgcctggcatgcagacagagtgaatgaatcctcccttccttttaaataaacactaatacttt

SEQ ID NO: 159088 - DNA, 443 bp, Homo sapiens
cgactctagaggtccaccgcagcacactgcaacagccaaaaactggaaacaacctagatattcttttatggataaatggttaaataaactatggtacatccataccatagaataccactcagcaacaaaaagaacaaactattgataacacacagcagcctggatcaatctacagagttatactgaatgaaaggccaatccccaaaggtatgattccatttatataaaattcttcaaatgacaaaagtatagcaatggaaaacagatgagtggtgattggggttaaggagggttaagatgggagggaattggttatggctgtaaaagggcaacatacaggattcccgtggtgatggaaatgctcagcatattaactgtaccaatctgaaacccctgatcgtgatattacagtatagtgttgcagtgtgctaccactaaaggta

SEQ ID NO: 159089 - DNA, 286 bp, Homo sapiens
ttccgtctctcccccagttatccacctcatttttaatacatccttgctgtttacttttccttttaatatttataaacaagcagagttggttttattaaccctattttaaagacaagaaaacagaaacaggacgactggcatacaatttgagaaatcaggatgtaaatccaactgcttcccttctttctttaatagtcttctggcattccatggcaaagaacttgaaacagcacaactgcaagccaatatgaacactacaggcattcagattcttttctaagagaca

SEQ ID NO: 159090 - DNA, 276 bp, Homo sapiens
ctagaacaattttttttttcaattttctatttagaaccctgactttagctagttccatgtccttttcttttgccaatattctgcatactctacgggacatgatcttctgtgattctacattgtgggttatagttcctttctccacttatttatattctcatctaagtaagcagtgctcacatttgcttactcctgagtgtgctatcttttctttctctagatttgtttaatgactgtaaggttattctacgcttgtaatctgcttttggaagtact

SEQ ID NO: 159091 - DNA, 652 bp, Homo sapiens
atcatggtgttctgcatggaatctgattttgcttggcattggtctggtctgtgctgtggcatgccggatagcagaggcctgggagggagttcagaggcctgggttctagtcctggctgtgttactaatgcatggcatgactgtgggcaagccagctttttggggcctcacttttctcatctgtaaaaggagaggctgtgactaagtaaacttccaggtcattctcagctctaaatatctgcaagttcgagttttagctgtatttttcttttttcccccaaaagattatgacacctgtaagacaggttagttttagattttttctttagcatctgggttatgaaaaacaaaatccattttgacgtttttgcattccatcaaatttctacctgatttatgctgttttacgtgtgtctgaaaagaggattacttacacacagccaatcgcctttctccattttaccaaaggcatcttggggtctgtggagtcactgagagaaggcatggatgtgcttgacagtgggaaaatgtggttaaattactctcttggctcatcccaccttttccttctctcctttctcagtaactgtttatggggcatctccccggggaggctcagaactgagcaacccttcgaggacctctgtgccttg

SEQ ID NO: 159092 - DNA, 150 bp, Homo sapiens
cattctctcatgagtagcaaagggagaggccccagagatggggtgcttggtgcctttgtgagtgtagtttgtcattaactgtaggaaggcatggagcaggggccactcctcttagttctacgagcagcatagaccagtgatggcttggcc

SEQ ID NO: 159093 - DNA, 308 bp, Homo sapiens
tgcagatgaatgacatgtatccaacctaaatgggaatgataggctcattgcccctccacactatcctcccttgcagaagaaaccaatcaacctcctgtcactaccactgggattcagctaggtgtgatttccttaccaggcttctatccactgcctaggcacacagcctctattaaagatagttagcaaggaatgaataaacaattctttagcctaaggaattctaggtctgagaccagcaacttttctagctttgttacactaagtagctagtcaggtataagcagagcaggtgaggctctccccac

SEQ ID NO: 159094 - DNA, 558 bp, Homo sapiens
ctctctccctctcccccaaccccctttctctcttagacctttaagtattttagttttcagtaatgttatttttcttaacaggttaaaagggtaaagagggaaacacagataaataagggtggaggctgaaaacaactgtttagtgactgccctctgttttgtgtttccattactcaagaaatttaatcgaaatacgagaatgaacagtaatgcatattttttgtttatttatttggttttgctttttaaaaagtgcagtgtgatatacttaactggtagatcatttttggcttttgttgcaactgtgggctggagggtatatcaggatgtcatctgagacccagccgtctgatgaaaagaaatggaatcgagcaggctagtatactgggtacagggttctttttgcttgatggggaagataaaggtccactcaccctgcattgcctgaattacattcttcttcactttgtctctgccatggataaggtctcattataacctcttgctgaacttgtacttgtcctaagactggtagtagttaaatcctgaactaccttt

SEQ ID NO: 159095 - DNA, 101 bp, Homo sapiens
tgtgaaagatacagctggatattgtagtctgaaaatcacgtacagatcaatgtttctcaggcgtaatttttggtttatctctctctgaatcccccaggcta

SEQ ID NO: 159096 - DNA, 218 bp, Homo sapiens
ttggtgtcaggggctctgggtaacgggtcaaagccgccagcattccagccccgagcccgcaacggtaaaaactgcgagatagggtacttgaagcccgccccctgcttcccaggtcctctcaccattgcctcttcagaccacccgggggtggcattcatcccttcaccctgctccagggacccctgtgtggtgggaactggtggacacttccttccggg

SEQ ID NO: 159097 - DNA, 500 bp, Homo sapiens
cactgctagctacatactcagaagaaaggaaatcagtatgtcaaagagatatctgcactcccatgtttattgcagtactattcacaatagacaagatttgtaagcaaactaaatgtccatcaaaagatgaataaagaaaatatagtacatatatacaatggaatactattcagccataaaaaagaatgagatcctgtcatttgcaaaaacatggacggaactagaggtcattatgttaaatgaaataagccaggcacagaaagataaattgcatatgttctcatctatttgtgggtgctaaaaaaaaatgaactcatgaagatagagagtagcagaatggttaccagagactgggaagggtagtggagagtggctagggggcgatggttaactggtgaaaaatataattagaataaatcagaaatatttttaaattgttgagtttattgctaggcaaagggtaaaatacagtaaaaaaaaaaaaaggttagctgttaggt

SEQ ID NO: 159098 - DNA, 431 bp, Homo sapiens
tcacagatgagggttgggtagctggatccaggtcacacagctcctgagtgacagagcagggatgccgggagcgggggcggcggggggttgggagatgaactatctggcacttaagcattggcactagagattgaggctgtgtttgctatgaagtggaatttcagtcaccttgctccaaaaaaatcaatcaaacatgctgtttgttctacacaatgctatcatgtagaacaaacagcagcttgattgatggaagcttctgtttctcagctggttattttgccatcttgagtgaagaccctgctcccgagcccggctgtgatgatgacttggcagctgctctgctccggctctctcagtcctgaacaggaaggctgtttcacggcctcggcgagcacgtcggaaagggaggggacagacacaggcagcggccg

SEQ ID NO: 159099 - DNA, 287 bp, Homo sapiens
tccatttctttgggggtgtttaagcaattagaagaaccataaagaaatgcaaggaagtcattgtgacaaaaaacaggatggtgtttcttcttagaggggagggaggaattatgctccctgaaggtttgaaaggctcctgcagggtcccatttcctgctcttggtgatggcttcatgggattcacttttcagtagtccttagctatatgttttaaaaccttttagatatacatcttacaatacaaaagaacaaaaaatccaagtttgcttccctccatccctgtcaat

SEQ ID NO: 159100 - DNA, 427 bp, Homo sapiens
actgtttactgaggatggctttcgtgttactggcgttttaaacaaaagaagtcagtaaatgtctcaggataggatcataggcaccatctgttgaagtggtagttttgtcaggagttaactgccagctccacctgtacgtggacgtcactgctggtacatattagccagaatttactgtgatataaactcattctcttacttaaaccattgtctgcctctcaagccaacctgtcttggtaactttgtacatagtaccacttgcaaatgacctaaccacaggaagcttttcagatgcagaaattatggcagcaatcatacagcagttttcttaatgaaatggtaccaaagccatacttggcatgatgttgaaatccacagctgatttgcttttcatgggtgccaaatgctctatactatggtaagaaat

SEQ ID NO: 159101 - DNA, 596 bp, Homo sapiens
aaagtgtgtggttacacaggatcttccgttttccaaagcccagaagcttgtcagcctgtcccacaggcctccctgactctgtcccttgaagacttggctccacccccaccactgatgctgtcccttggacttagtcttccatccatctgtctgtctctcccttgtgtgtctggaatttccacttcagtaccttcaccttcttttatgcctcttagccaatgctgccaaccttgactcccaaggccctggagggcaagaccctagcattggtagattttctttagggcatctggcaccaaggacacctttcagtcaaggtggacaagtggaggaaagccaggagctgggatggttagtcgaacaagtgttgagggactgagatgtactttccctcctcccagaaacttagccacgtagatggtatttgtatacccaacaactgaagtgaattatgatggggacacagtggctgtgagactcttggacagttgggagtttctctttggttggctgagtctctgccctggtgtcgatgtatcttggaagaggtgggttttgtgggattaaagagtggaggtctgtgggtgacaggacat

SEQ ID NO: 159102 - DNA, 385 bp, Homo sapiens
cttacagctaacattatacttcatggcgagaaactagatgtttcctttctaagataaggaacaaagcaaagatgtcccctctaccactcctgttcgacattgtacaagtccttactaatgcaataagaaaataaaaggtatacaaattgggaaggaagaaatataactgtcttttttcacaaaaaacatgattgtctatgtagaaaatataaaaaaaaaaaatcaacaaatacccacccccaaaaccaaacaactcttgaaaccaatgaagaaggttgcaggatataacataatagataaaagtcaaatgccttcctatataccagcaatgagcagttggaatttgaaattaaaaacacaccggccgggcgcggtggctcacgcc

SEQ ID NO: 159103 - DNA, 215 bp, Homo sapiens
cctggcttgctcaggtctggaggagcttttttgttttgttttgttttttaactaaataaaaaagctcctccagactgttgtaagcctttaatttctagagttctgacaaagttgattttgatggttttgccagcattctcactgcttaaggagcagattttggaactcctttgcagtctcagaagtgcttcttcccattagacctgagcaaacaa

SEQ ID NO: 159104 - DNA, 452 bp, Homo sapiens
ctttttcctttaataaactgccttcccatcccaccaacagattaccccagaaaaaaaggaaacattcttaattcctgagtaaatatatggttccagtaaattcattaatttctcaggactggagctccttttttaaaaaaatatttgccctggcaccaaaaaaaaaagtgataatattagcttcccttttgtgcagtcatgtgttaaaatgcaaaaacaagtgtccccttcaccagaccctaactaattaaaagaactgtgatcattctaaaagtaacaaaagggctcacacttttacatagacttttaatttcatctcaaagaaccttatggggacaggagccatgcaccaattcttaataaacaattttgaaaagtatacttgcagcataggaagctaattataacacagagaaaccaaaaacatctgtttcgattttaaactaaagtct

SEQ ID NO: 159105 - DNA, 426 bp, Homo sapiens
ctgataggttgccccattgagtatgatgactagagtgggaatgagtgtggtttcgaagagaatatagaatatgattatgttttgtggcagtgaatgttataatcaaaaaaatttgtaacctataatatctgtaaaagacttcactgtttgtgttcttaaaacaacaacaggccaggcgcgcgtggctcatgcctgtaatcccagcactttgggaggccaaggcgggcagatcacctgaggtcagcagttcgagaccagcctggccaacatggtgaaacaccgtctctatgttactgcattaatggatatgttattatattcatgacaattaatttcatttaaaaaaatcaaattgttgtgatagaaaccattgaaattggtttcctttggaatttcttttgagaagtgtgtcagaacatagacatc

SEQ ID NO: 159106 - DNA, 303 bp, Homo sapiens
tcatttggtttatgaaacagcactcaagtgactgaagcagaaacctgaccacgtgtaaagactgaatggctcaatctgcttcccaggcccagagggtgttttctgtggcctggcccaggcctatggtgaagccggtgctagggggtcgcctatgtgggagccagctctgcctcctgccccgaagctccagagacttctcctacaactgactctctggacacgccctcttgcttgcactagtatctcttacctgccacctgccctcctccacacaccccgatttcagggaagctcagctgctga

SEQ ID NO: 159107 - DNA, 437 bp, Homo sapiens
taaggtatatgtttaacgttctaggaccacagtaaaacatgaacgaaaaggaccgatgttgaaagaccagggagtggagaaacaacaaaaaaagcaaaagagaggaagctaggagctgcttctgaatccctgaacagctccccgcaagttacttttcatattttgtagctgatcaaaacagtctactttcccctttccttataactgatacaatccattacaaacctttggaattcattttttcccaaatctagttggattcaggttctccagcgacaccttaactttggatcgtggaggaaggtgcatttcggaggatcagtccagtactagaaaaactatatacgaggccaggcgcagtggtggctcacgcctgtaatcccagcactttgggaggccgaggcaaatgggtcacttgaggtcaggaattgagacca

SEQ ID NO: 159108 - DNA, 197 bp, Homo sapiens
gtgagcactctggttgcaaagtcattgaagtgtgatggctaaaagctcagactcttaagttagattgtctgggtttgagtttgggttttaccattgtgtgactttaggaacattactcttagcttcatttttctgcctcggcctcccaaagtgctgggattacaggcatgagccactgcttccaaccaagagtgtcg

SEQ ID NO: 159109 - DNA, 659 bp, Homo sapiens
tagtgatctaagatggggtgtgggggtatagtactcagacttatgccctaaaataacatgtatataaaacccctgacgtatcgtgtgggtgtgtacgtgtgagtgtgtgttggtatacgtcgggcaattaaagcttgtcttctggaacttagtgaattcttttctctttttcctccagaagacaaagtcaggatggcatcattgtctactcttctgctcttggctatttgcgtaacagacagagtaattctttcaaaatctgaatgtgattgtgatactcttctgctcaaaactgcccagtagcttcccatcacacttagaaaaattcggggtcctcactgtggccaacataatgttccatgacctggtcatggcttccacttcagcccccatcagcaacgcctcactccctcattctactttcgggcacctctccaggccaactgttatgaaaatgcattgttgttttaaaaaacactgtgagagatggccgggcgcagtggcttacttgaggtcaggagtttgagaccagcctggccaacatggtgagaccccagtctctttgaaaaatacaaaacatgagccagatgtggtggcatatacctgtagtcccagctactcagaaggctgaggcagaagaacgcttaaaccaggagatg

SEQ ID NO: 159110 - DNA, 467 bp, Homo sapiens
aggtaaccaggaggccaagcaagggcaaaggattttgaaggaggtggagtcagcaactgtggcaaatgtagctggcaggtccagaaggaagatggagagctggcctctggtctggtaacaaggagctccctgaggaacatgaagagcacaccctcggtacaaagatgagggccaggccaggcacggtggctcacgtctgtaatcccaccactttcggaggaaaaggtgggtggatcgcttgaggtcagaagtttgagaccagcgtggccaacatggggaaaccccatctctaataaaaatacaaaaattagccaggtgtggtgcgcgtcctatagtcccagctacttgggaggctgaggcaggagaatggtttggacccgggaagcggaggttgcagtgagccaagatcacgccattgcccttcagtctgggcaacagactctgtctcaaaaataaaaaaaaagaaa

SEQ ID NO: 159111 - DNA, 232 bp, Homo sapiens
caaccggtactgttgccattcctgactacattgcacagtgagtctgctgacgtctaagactgaaggggcttcccagatacgtgagggaagtctttcagtaatatatatgtgtatatatatatagttgtaagtggcacaagtatcccctctaatttctattactatgttacaatttaaatgtggttaatcctgtaacaatagccttaaattttgttcacagcttataattgtg

SEQ ID NO: 159112 - DNA, 311 bp, Homo sapiens
tattttgtttagtagagatggggtttcgccatgttggccaggctggtctacgaactcctgacctcaggtaatccacctaccttggcctcccaaagtgctggaattacaggcatgagccaccgcgcccagccagaaataggttcttaagcacctgtttcacatggccacattttaataaatttacttactatgaatattggagactccccactatatcacaagttaaaatttaagttttactatttagatgtagttttttcctcttaatttactctacattgaaggtttttatttcttagtatctgaacact

SEQ ID NO: 159113 - DNA, 419 bp, Homo sapiens
actgtcttcccaagtggctgcaccattttgtgttcccaccagcaatgaatgggcgttcctgtggcttcacgtcctcaccagcatttggtggtgttcgtgttttggattttggccagctgataggtgtgtagtggtatattgttttaatttgctatttcctactgacatatgatgctgagccccttttcatggcttatttaccatctgcgtatcttctttggtgaggtatctgctcagaatgtttgcctatttttaaattggttgtcccttttctttttgttgagttgtaagagttgtttgtaaattttggctcgtaatcctttcatggatatctcatttctagttattttctccaggtttggggcttgttcttcttattctcttgacagtgccttcacagagcagtttttaatcttaat

SEQ ID NO: 159114 - DNA, 605 bp, Homo sapiens
cctccccagctctgtgagctttgacaaaggaagcttgggcaaagtaccttgcctctctgcacctgtttcctcctccataaaatcaacataatacttgtaccaacctcacagcgctgttgtgaagattaaatgaggtaacacaggaaaaagcacttagaacaatgccagcccacacaggtgctaggctgcataagtcattattaactacatgtccacccaaaatgtccttctatttttgggtcctgcatcactgatgagtttcggtgacggagattagaatacaaaaaaaaacagttcttcatctgccccgggcagtaattaccatggtggcatttactcttgcttcttccttcataatacctcattttctcattcgtctttttaggaataaaacagaagctactgacaacacgtactagtgactacttccattcctctaaataataattttcccatgcaattgtttaatcatattgatatggaactcgcctagcttttagttagccggtaatttgttaacagtgtgctcttgcatgactgcatatttgttcttaacgataagctttaaagtgcttctggctgcagtggcttacgcctgtaatccc

SEQ ID NO: 159115 - DNA, 305 bp, Homo sapiens
tgtgcttgaaatactcccagcccagaaaaaaatccaaattaagtcctgcctgtggcctgcaaggctgtaccatgagctgcttctctgacctcagtacacagctctacccagaccatggatgcctaggtgtgccatgacctgactgtcaggactaagccaacttcaatgtgacttgattctgttgacctaaaaggaagaagctggggcaaaattaacataaatagggagtgttttggggccaagcttgaggattgcaacccgggagcatagtttcaagttaccctgaatatacactccaattagcg

SEQ ID NO: 159116 - DNA, 424 bp, Homo sapiens
atgttttcccagggatcagggtcacacaaaggacaatggaaccacagaggactcattaagcaggagaaatgtggctgctaccatggacaccatgggtgggagggctgcgttcctcttgcttccaatcttctaccagtgcctcccatcagctgaagccagttgtgggtaactggaaatcatagcctgcagggacagcctccttggaaaaggaagagaaactagtggatctgacggtgagaaccgagcaccaacatatgccatgctccaatcacatgcttgggatcacgtgccccactccaatgacgtgcttggaatctatccataaactccttggtgctgtgggaggtgattcatctgaggctggaaggatgcactcatcttgctcattgcagtgggttgaatgatggcccccaaaatatatgtc

SEQ ID NO: 159117 - DNA, 340 bp, Homo sapiens
gcggcccctactactactactacaaattcgcggccgcgtcgacgtttaagggttggggtgcagggagctcattctcacagcaaggaagcttagctgggagcgtggtcatttgtgtattcattcagcaagtacttccatgccttgcagtatttgtgttcttaggatatatcagtaaataatagcctatgctgtaatgctgaggttatagttaatagataagcataacaggtaaactctatggcaatgttagaatgtggtaaacactggaaaaaggaaaaagtaggacgagcaatgtaaggggattgggagtattagaggatgggagtggtttacaagttta

SEQ ID NO: 159118 - DNA, 235 bp, Homo sapiens
ccctgaaaagatgtccctgtcctcatccctggaacctgtgaatgcggctttatatggcaaaaaggtaagggtgtttgcaggtgtgattaaatcaacagttgcactggagaggtcagcgaggattatcagagggaccctgagtgcaacggtgaggattatccggggggcctgagagtaacagtgaggattatccaggtgccctgagtgtaacggtgaggattatccaggggggccc

SEQ ID NO: 159119 - DNA, 381 bp, Homo sapiens
cccgtgttagagcggactgttgccgtgagctgtgctgtaggtcacagacacagcttggatcccacgctgctgtggctctggcataggccggcggctatagttctgattcaacccctagcctgggaacctccatataccacaggaagcggccctagaaaaggcaaaaagacaaaaaataatcaatgaagtgtaaataaaaaatatagttagaccagataagattggtacaatttgagaaacctggtatacatgtttctcaaatttccttgcccacagacgtttattaagaggacctactaatttcctaggactctgcagaatggcctcaaaaatgttgccttagacagcaagcatcctcccttgctagaccactatggtgtg

SEQ ID NO: 159120 - DNA, 186 bp, Homo sapiens
atgttgcccaggctggtctcctgggctcaagtgatgcactgcacctgacttagctttccaaagtgctgggattccaggtgtgagccaccacacccagcctattttgttctttttctaatctgtcaagttcttttttcttcttcttttgattttttgtaatttccacttttctgtccaaaattttaa

SEQ ID NO: 159121 - DNA, 431 bp, Homo sapiens
taaaaatgtacccatgaattgtgacagatgaacacatcccaggtccccaataacaacgtcttgaaatgactgtgtggtctcacccgcatcttgtttacacgaacactacttaagaggcctctgagaatactgctgtaacagaatctatgggagtcatgaatcgctgttcagaaataagtgctgcacacaattctgatgcctgcaggtctgcaccagggcaccaggatgccggctggggaggggcctgctgcaggctgccccacagctctggcagaagggacaggagaagaaccctcaaggacccgggtgagccgttctctgctgccatcctgggatgggaatatggaggcggcagccagtcagcattgagcctcacaacctgaggaaaggcaggcccgggggagggctgggcctgcaaagtgtcctgccca

SEQ ID NO: 159122 - DNA, 186 bp, Homo sapiens
catagaggaggaaccattgcctgattttccaggtgaaggcagtgtgtgggtaagatatttgggacatgtgaagtttgatatgcctccaggatagctctacttgcatgacgacccggccttttaaacttaactgggcagaacagaacctgttcttctcctaggccccctatttcaataagtgatacc

SEQ ID NO: 159123 - DNA, 106 bp, Homo sapiens
tagtattaacaggctgaatatggtgtttttttcccctcacaggatctaggtgtggtgatgaacaggaataagtctaattaaattgtgtatgctataacagtctgct

SEQ ID NO: 159124 - DNA, 550 bp, Homo sapiens
aagtgtttcccaaggaatccggatacattcattcatgtatttatgttttcatatatcatatgtcatgttttataaattaaggacagatttaaagctacagttttcatcttctttttaaaatttattttagattttattcatgttctatgaataagccaaaagtatcattagaaagctcttcaggctgggtacggtggcttatgcttgtaatcccagcactttcggaggccaaggcaggcggatcacctgaagtcaggagtgatctgcccggccaacacggtaaaaccctgtctctactaaaatacaaaaattagctgggtgtggtggcacgcgcctatagtcccagatactccggagattggggccgaagaatcgcttggacgcaggaggcagagtttgcagtgagctgagattgcgccattgcactccagcctaggtaacaagagcgaaactcttgtctggaaaaaaaaatccaaataaaacaggtgaaacatttaaaataaccaaattagatcattataaaagaaacctacacagaccaagggaaaca

SEQ ID NO: 159125 - DNA, 190 bp, Homo sapiens
aataacgtcactcgtgctcacactgattcaaggcactcatacacatttacacaaatgctcacaatcgcacacttacacttgtgctgccacccatacttcctcacactcatcaagcctcactgacttacacttcatctcattggcacacccagtaatcccctcacactcacactcatgcctccctcgtgct

SEQ ID NO: 159126 - DNA, 241 bp, Homo sapiens
tatttcttccctctttccccttcttccttctttccccttcttccttctttcctttctcttccaataattttactagaatgtcttggtattggatatttggactccattttccaaggtgtttagataatctttcaatatgtcgtttcaagtatatgcttatttcaggaaacctttcctgaattatacatcttgtttgtttggatctattccttttgattttctttttttttttttttttttt

SEQ ID NO: 159127 - DNA, 2927 bp, Homo sapiens
  misc_feature (153)..(153): n is a, c, g, or t
  misc_feature (247)..(247): n is a, c, g, or t
  misc_feature (2118)..(2118): n is a, c, g, or t
  misc_feature (2121)..(2121): n is a, c, g, or t
  misc_feature (2162)..(2162): n is a, c, g, or t
  misc_feature (2304)..(2304): n is a, c, g, or t
  misc_feature (2625)..(2625): n is a, c, g, or t
taaggaaaactcctttttgcgggtaccattattacctactagtttacatatgaggacattgctgcttggagaaattaaatcatttacccaagttcacaggtcaataacaacagaccctaacccatgagccagtgctcttaataccagtgatcntaaccactgtgtagtctttgctatgttccattaattgtccagggatattattataggtacagtttgtcttttgggagaggtaccagaatttctntcttaagtattgcttaaaccttaccagtcaacagcctttctttgcagaatgaggaaagcatttagtgcccatactgttttcgcagacttaatggagcaggattttgtacatttctttgtggaagctgttcagagaggtgtgtgtaaggggaaaggaagcagtgggaatccttcaccctggtcaggggataaagatctcctgatagactaggaggtgtctgtcagtcactaagattgaaatcttagaaggagtctatttctgtgctggggttccgtccccaaggctggcaacattcacattcctcggcagggaagcgttgtttagaggcatcaacccgtgaagggttccatgaggcctggcactatctgatgtgtggtgtgtatgaatgaagcctctttcctcaaagctgaaatcagtttgagaaaactggaagaatgagtcatttgaggttcttctctctgaacgtgtctacacttgtctctggctgattctatacttgcatagttgtaagtatactgtatagattctatacttgcaaatgttgaaatttcactatgatcttgagtagggtgaaagagaaagacatgatatccaaacccctctccccctgccccattctggtgagtattcaagtttaataaaaatatatgaaaaaggccagattcttttagaagggctttgcttctatctgttgcaacctgtgtctgaacaggtagggcacgctggacgtggatgagcttcctttaaagaaccatgctgctagcgtgaacctcatccacacgctcccttagtgggtcctctcagtttctgtctggtaactggacataggcctcgatggtttcatctgtccagaagggaaaagtacaatggaatgggagcaggttggtatgcagacctgtggaactaggccactgacctacttccttccagctggagtgatgccctttcagatctgactccagccatgtggcacctggttgccaatcactgcccagattggcaggttcctccctgactcaggccattcatctaagtggatgtgactgtttgtaagctcgttggggtgcctcataaactagcttgagaatgtgtaaggcagaggggcctggaaacatagtggctaaatttaaacagtcattcttgctgtatgtgtagacataggtgtagacagaggtattcaggccacaactacatgctaacttgtatggtattctaaataaggtatttggatgatcactggcatttatttactgaggtttcctatgcagagcccagattcctgacttcttgtaacaaaccaaaagatgtagtaacaccagcccctctcccatgctggggtcaagtgcccatttagatggggcttgtcaaagctgtctgttagggatgcattcccacccactccctagtgtttgagtccctgcctgcttcatccattgaatccattgaagcaactgcctggcccctatgggcatttgagtttgcaaccctgatggaaagcgtgtcctgaaatagatgtactggtatacacaagtatgtagacataatctgtattgacacttactcctgctgaggaatgtgcagccagatttctggaaagtgccagtttttaaaatcccttcaatgatttaaacctgctggaagctgtgcatcccatctaaacaatgggatccatagagaaacatactcattggagaattacgaggcatataattttgtctttaaattcttatgagtgaattgtaagaacatgacttcataggaacctctgagacattacagtgttttaataacactttgctgctacatgcagtggttcatttttacttttattaattttttttttcagtgtgtggcagcaggtgccctgggcnccnagccctatctctagcttcatcctcctctgcctctgggaagncgcctggctccctccctccttagggcagaggctccagggggcatgtcttgtctgcgaagagtttacgaggtttcacccactccttcattcttgaacatgctttttctctgcttattaccctccctgtttcctcctgggctgncaacaacatattatattacctccatctgcaaccagagctgctaccaccactgtgcccgagcctgaattttcatagttatattaaaaaaaatcaagggtgcccacaagtgacagcagcttttatggaagccagtcttagcaagatggcagagcacccatttctccatgaggcccaggcttctcagagaagggcaagaactgtcttctgctttggccatcgtgatgacacattgaatgcctgaattcattcactcactcactcactcactcactcactcactcactcactcacctatgagttgttttcaatagatacttgtangtgttaaaagacacacataggccgggcacggtggctcacacctgtaattcccagcactttgggaggccaaggtgggcggatcacctgacggcaggagtttgagaccagactggccaatatggtgaaaccccatctctactaaaaatacaaaattagctggggttgggtcacgtgcctgtaatccgcagctacttgggaggccgaggcaggagaatcacttgaacccaggaggcgggggttgcagtgagctgagattgcgccactgcactccagcctgggcaacaagagtgaaactccatctc

SEQ ID NO: 159128 - DNA, 1170 bp, Homo sapiens
agagatgggatcttgcttggttgcccaggctggtcttgaacttctgggctcaagcgatctgcccttcttggccttccaaagaagggattacaggtgcgagccaccatgaccagccaatgacatgtttttaatgtaaaaattctacactaccacacccagtccagccgtatgttcatcttttacgaaaatggctcagtgagcttcactgtggccattctgcccttccaggtggaacctgatttatttaccatcattccaggatgggaaatctgaactctatcagtcagctctgcagccaggaagcgtctgccgagccacctaacaggcttaacagaccacacctgaccagccgaggagcccccaccaggagaggagccggttgaaatgtatggtctcccttagaaaaagccttgaaaacatcttttcatgtctgagaaatctcaccaacaaatttctccttttcatcaccaacagggattttgtagtccacttccttgttccggaagaagtggaatggctggaaagtatcaaaaatgaagtcccccaggtactcatccatgtagatggtcaggatgcggcgatcaaagctgtcgatggcccgtcctccatacatgacctgaaattagagggcctgagagccagccaggagctcagaacctactgtgtgcaccctgggggcccggggccagaggctcacccagggtcaagagactccagcagcctggctgctgcaaggcttgaacctgttgacttgcataacctttcgggccactgttcacacaattgatctgtggctttgctggcttcccaagggatagggcccaaagcagtaagaagccctcaggaagtgttgggagctcctgtgcagcaggcaaagtcccccaaacacatcaaacaaacagctgaagaagccagcagctgcttctgtctttggaattgatgtcactgcctgagccgtgtgcagaccaccggggatgcttcctgtgagctctgtatacagcaacagctgaggcaaggggctagaggatgccttgcctggatccccagccatggatccagctcagggaacctccatgtgaacagagctcacttaggacaaagaacaaccaggtgagagcagagagaattgtcacagaaacccaaggggtatgctctgatagggatcctcta

SEQ ID NO: 159129 - DNA, 510 bp, Homo sapiens
cgggtggatctccctccttcccgcgaatcccttatggagcatggaaggataaaatataaagagtagataacaaataggcagatgccaagaagataagattaatcgtgagtcgtaagcaaaccagttcaatgcatacgtcagggtgttgataattcttaaggcaggtgatgagttcaccacagataactcttggggcactctgcttcatgtttccttgggtttagaagacacttctaaaattgagtgaccatgcctcatgaccttatatttgatgagccttccttttaggatcagttttatgccctgacagcaagcatgtgtttagtctcgctgtcatttactgttttggtctcacgtggaagcccacctgcgataaaatgggatccaagaaggactgctgtctgctttttgacttgagatccttctaggctgcagatagatgtgttgatggaatttgttgccacattagcatggcctgatagtgttaggtgaaacatacgacaacgaaaa

SEQ ID NO: 159130 - DNA, 354 bp, Homo sapiens
cgggtggatctccctccttcccgcgaatcccttatggagcatggaaggataaaatataaagagtagataacaaataggcagatgccaagaagataagattaatcgtgagtcgtaagcaaaccagttcaatgcatacgtcagggtgttgataattcttaaggcaggtgatgagttcaccacagataactcttggggcactctgcttcatgtttccttgggtttagaagacacttctaaaattgagtgaccatgcctcatgaccttatatttgatgagccttccttttaggatcagttttatgccctgacagcaagcatgtgtttagtctcgctacccgctagggcccgcagagga

SEQ ID NO: 159131 - DNA, 202 bp, Homo sapiens
acaaaactcatctatctttcatggtaatagtaaatatatatatacatagaggacttggatagaaaatttatggtacattcatatgatagaatatatgacagtcattaagaaagattttgatatataagaaatgatgtagaaagaagtccaatataaataaatagaaaaatatttcaagaataatacatattatcccaattgt

SEQ ID NO: 159132 - DNA, 382 bp, Homo sapiens
tgtctaataaaatctctcctcataattagtatctgactccttttctaccactggctggcatctagaggcaggtagaggcacaaaatggcatttgttttttagttgtcccatttcatgactttatggatcatcccctctttgagccttcatgacctaagttctgagacttaggaaactgtatacttcctaagattctcttctgcagaagttataatagatttcagatggaagatgtttgggatctcaacaggacaaagaggacacatcattttaaggcaataataacaagccattcttcatccttaattgacaacttaatttagattttagacgagtcccttttagtgatgtcctattttaatttcaaccccaaatgctgata

SEQ ID NO: 159133 - DNA, 197 bp, Homo sapiens
gaggtactggtggtaagaggtataaactggaatttataattgaatctactttctttgtatctgaaagaaaaatattttggttaattatgggcatataatttagctaaaaaattaccttaaatgttaagtggtccttaaggcatttataacagaactttttcagaccctagaagtctaaactgggaaattatttaaaa

SEQ ID NO: 159134 - DNA, 241 bp, Homo sapiens
agaagattcaaagcataaagatgtaaaatttccccaaatgtatttataaatatacagaaatattcaaagtcccatagatgttttctatggaagagcacaagcagatggtttatagggaaaagtgtatgttcagaataatacaatttttcaacaggagaaaactgaataaggattacgctctaacagatattcagtaacctaccctgattaaagaagtgtggtatggatacagaaaatgaca

SEQ ID NO: 159135 - DNA, 394 bp, Homo sapiens
gctgtaacatgactttaaaaggacacacagtcctctttctgtattatttcaaagttttggatattttttcttaacagcagacagaggcagtcggggtgaaactgtgggattctagccagagagctcaacacagagatggtgaagacagagttggtacagcagggcttttactgtccaagaccactgccccggccgtgcttccagcccaacctcatctactgggccaacccctccctccatctagaattccactctggttattaagaccacctgggcactggagtcccagggggctgggatgcccaaggcctcacctggtgctccccgtagtgtccagtcttcccgaggacatgcaggctggtgtgtacatgtatgtgtgtagtgaggattcttg

SEQ ID NO: 159136 - DNA, 306 bp, Homo sapiens
gtacggtcacgtatggtgcaagtatgggcatgtgtgatgcaagggaggctgctgggcagctgcctgtgcaggcaccggggacaggaaggtggatagggcataatttgtgggggaaaaggcatgtaaacatgtattacaacataagagagtacgtgtagcgggaatgtaaatttgtacaaccttctagaaaagtcatttggcaatacagatcaggaacttcccagatgttcccaaatatcttcggaaacaattatcccatttctgggaatctaacttaagagagtaaccagaacaagggagaacaag

SEQ ID NO: 159137 - DNA, 478 bp, Homo sapiens
gggctgctttaaatgactgtgaatttctaacaagtttcctgatacggccttctttttccaaaattttgtcgctatcattttatcatgtaggttttcttatcaatatgtcaagttttctacaatacaacactagaagacactgacttggggaaaattagtaaattctacaacagtgactgtctccatccagaaaatacattgtttcatctcgtttattcagatctcactttatgtccttcattaagattccagtagctcaccaatatttgttatatttatttctaggtagtctttttagagaaacatttagtagtatatatcagaatttaaactgcacatagcctttgcctcggtaattccatttttaagaatctgatatacagtaatatatgtgtacagatataaaaaggctactattccaagaacaaaatcctggaaacaaatgtctatcaagaaagcaaagataatctaaacagca

SEQ ID NO: 159138 - DNA, 596 bp, Homo sapiens
tgtagggacagggtcttactatgttgcccaggctggtctcgaactcctgggttcaagtaattctcctgtctcagcctctcaaagcactggggattagaggcatgagctaccgcgcctggctgaaaaatttctttaaatgtctctcaaatagattataactagttttgtttatacaatcctatataataatgtatgtaaactatgtaacgtatctaataatgcatttttaaaatttttataaagtaatcatatgcagaaattaaaatactccagtgtgtctctgcttgggaaaatcgagcccatttatagagagccagtttactgcctgtttctgttacttatcacatttgccctttagatgatccttctgagttcttcttactctttaatgttctcccaattaattttcaacttattttctgagtatatagacaaagatatttctatcctctctttttgattgtgtaaacattgtttttacttcttgtcaatagtagagaaacctctgaaataattagcatattctttctatagattttgccagtatgcattgattatttcaggcttatttgcatttcctgtatggggacaggatg

SEQ ID NO: 159139 - DNA, 932 bp, Homo sapiens
gcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccttagtcacacagtatttgaatgccactggcaatcgctggtgcagctggagttgtctcaggcaaggctcctgacttcttcttgccggtcacttctgcgactctacagtgatgtctttcacctgcgggaccctgtttcaggtaccgggatgagatggcttgatgagtgccttctggaagcctagggggcccgcgctgggaagagcgtccgatcccggttgtgcactcgtggacggccggagaccggccccttctttcggcgagagcggaggggcatggggcccccggcggctatccggagagttgtagctgggc

SEQ ID NO: 159140 - DNA, 1050 bp, Homo sapiens
  misc_feature (961)..(961): n is a, c, g, or t
  misc_feature (980)..(980): n is a, c, g, or t
  misc_feature (986)..(987): n is a, c, g, or t
  misc_feature (1003)..(1003): n is a, c, g, or t
  misc_feature (1008)..(1008): n is a, c, g, or t
  misc_feature (1013)..(1013): n is a, c, g, or t
  misc_feature (1020)..(1021): n is a, c, g, or t
  misc_feature (1025)..(1025): n is a, c, g, or t
cccacccttaggcgctgggagaagggagggtggggaggtcagggcctctcagaggggcctcacttgttaacccagcccccatttcaggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccttagtcacacagtatttgaatgccactggcaatcgctggtgcagctggagttgtctcaggcaaggctcctgacttccttcttgccggctcaacttctccgactctaccagctgatgctcttcaccctgccagggacccctgttttcagctacggggatgagattggcctggatgcagctgcccttcctggacagctatggaggctccagtcatgctgtgggatgagtccagcttccctgacatccagggctgtaagtgccaacatgactgtgaagggccagagtgaagacctggtcctcctttcttgtccggcggtgagtgaccagcggagtaggagcgctcctactggntggggcttcccgcgtctcngtgggnntggatcttttctattncggcntgggnacgatgnngttnctgggggctcactgggggtggggcc

SEQ ID NO: 159141 - DNA, 869 bp, Homo sapiens
cccacccttaggcgctgggagaagggagggtggggaggtcagggcctctcagaggggcctcacttgttaacccagcccccatttcaggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccttagtcacacagtatttgaatgccactggcaatcgctggtgcagctggagttgtctcaggcaaggctcctgacttccttcttgccggctcaacttctccgactctaccagctgatgctcttcaccctgccagggacccctgttttcagctacggggatgagattggcctggatgcagctgcccttcctggacaggctggagtgcagtggcatgatcttggttcattgcagctccgctcccaggcgaagtgatcatcca

SEQ ID NO: 159142 - DNA, 1167 bp, Homo sapiens
  misc_feature (1078)..(1078): n is a, c, g, or t
  misc_feature (1097)..(1097): n is a, c, g, or t
  misc_feature (1103)..(1104): n is a, c, g, or t
  misc_feature (1120)..(1120): n is a, c, g, or t
  misc_feature (1125)..(1125): n is a, c, g, or t
  misc_feature (1130)..(1130): n is a, c, g, or t
  misc_feature (1137)..(1138): n is a, c, g, or t
  misc_feature (1142)..(1142): n is a, c, g, or t
gcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccttagtcacacagtatttgaatgccactggcaatcgctggtgcagctggagtgtgagtaccatgctggtgggaaagggggcagatgggagaagaaagggttgtggggagacagaggcagaggtgggttatggggctcactggagtgtctctccctgtagttgtctcaggcaaggctcctgacttccttcttgccggctcaacttctccgactctaccagctgatgctcttcaccctgccagggacccctgttttcagctacggggatgagattggcctggatgcagctgcccttcctggacagctatggaggctccagtcatgctgtgggatgagtccagcttccctgacatccagggctgtaagtgccaacatgactgtgaagggccagagtgaagacctggtcctcctttcttgtccggcggtgagtgaccagcggagtaggagcgctcctactggntggggcttcccgcgtctcngtgggnntggatcttttctattncggcntgggnacgatgnngttnctgggggctcactgggggtggggcc

SEQ ID NO: 159143 - DNA, 141 bp, Homo sapiens
aggccccagagaactactgacagtttctgaggcaagctgatctatttcaggaagtgctacaccaggaagataaacagggtggtattctgtagatagatgacggtagagccagggagaccagatgaggagcacctgccataa

SEQ ID NO: 159144 - DNA, 753 bp, Homo sapiens
aggtccaacagataggtatggttgccaaaaaccagacaaaggaggtcactgtgcccacctgaagtgggacattggaaagttgccaagtagatgctgtggaaggcagcacaagatcaagggtagctgaacacctcagcacataaagaatctttccaggaaccatgagaagaaggaagagcttgaacagaagtggtgaggtccatgcagtcggaagggctttggtgtggaaggagctggggctcatgcaataattcagcagtctctgggacaggatatgtgctcaaggtatatgaatgggcatgttgagttatgaccatccttcccatcgtggctatgcttatatgacttcgggggcaaagctaggtccaaaatatggatgtgccagagaataggctttggataatttatagaacgtcttctcagctggcgctttgcagtgatgcgctgggctgcctctttgggagggaaagggcttatggattagacagccctctgagggctcacagagaggggcttctatggtgggaagtgcccttcacactgagaatcgtgattccaaatgaagggtgtctaagtaatgatgatgactccatgttggatggttaagcatctgccactgtgggtcacctcgcccatgtatcagggaggatcaaagaggaccctcgatcatggccacacagctagcaagaggaaggcaggactggcccagggattctgattccacatcaacagagtttttaacatccccagagt

SEQ ID NO: 159145 - DNA, 331 bp, Homo sapiens
ggttacatggctagtcaatcctggagcagccctcaaacccaggcaggctggcccgtgaccacgtggtcatagtgctggattacagatgggcagatggaggctctaacaggtccttcccaggaggtggcaggaccaggactggagccctcatctttaccactgtgtccagtaaacatcacaggcacggccatggaaggcagcgggggtgtgctgggcacttctccaggtgtgaatctagcctggctacactgaggacagggcgtgtaagccaggagttgaaggatgagtgggaacctgcaaccgtggggtggaagagcctcctgggaggagg

SEQ ID NO: 159146 - DNA, 461 bp, Homo sapiens
gtattccgtggtgcacataacatatactacattttctttatccactcgttggttgatgggcattgaggtcggttccacatttttgcagttgcgaactgtgctgctataaacgtgtgtgcttgtgtctttttcatagaatgacttctttccctttgggtaggaaccccgtagtgggattgctggatcaagtggtagatctacttttagttctttaaggaatctccacactgttttccatagtggttgtactagtttacattctcaccagcagcgttggaagtgttcccttttcaccacaaccatgccaacatctatttttttttatttttaaaattgtggccattcttacaagagtaaggtggcatctcattgtggttttaattttcatttcccttgggcaagttttaaacagtcacacatctcagtgtcctcatctgtcaaatggggtgatatggtttggc

SEQ ID NO: 159147 - DNA, 286 bp, Homo sapiens
tgggatggaaacactaaaatatgatcgataacagttatacagcttagagtctttatttactacctcctaattaatttcatttggataaggatccaaatttctgtttcaatttacttttcttccagcatttgcttatattagtacttggcaaaaggtagtttgtagaaaataaatgtgttttactgaaatagtaatgcttatcttggcaaacccttttctcaggaggaaggcaaagctaacagcaattgcatttacccgtggacactgatctaaatggacatatttc

SEQ ID NO: 159148 - DNA, 263 bp, Homo sapiens
tgctgggattacaggagtaagccaccacgcccggcccagatttgtacttttgaaagctctcactggccacagggtgaagaatgggttggaagaggagatcggaggctgtggtaaaagttcaggagagagtatttcttagagcagcctcctgagcacattcattgactccctctggacggcagcttttattgagcacctactctgttccaggccgtgtgctctgtgttagctgggagattatcaaattctcttcctgagctggg

SEQ ID NO: 159149 - DNA, 571 bp, Homo sapiens
tcagcagctccctgtttgcagaacataaagacttaactcctgcctggtttttaggggtcccaataatgggattctgcccaacccatccagttctgggtacaagtactgcctgccttacaatctccattcaggtaaggccagggctcctaagagcaggtttggggtccccagcaaagaggagtggctacaaatccatgcgtgactttgtgttggtgaaaaacctgggccccgttgccaggcccctttctggaccccacctgaatcatgtgtactgggcttcctcctgggcactgcctccaatgcagggttgtctattcctgctcatgtcatgcgacgaaaaggaaatgttggacatacatttccctagcagaatccctctttccctgtcctcgattttcattgatcccatgttatttctgaacattcatgagtcacgcatcagatacatttaatatcagatcctaatttaaaaagtaaatgctactcttccaaaagtacacatgatgtggtcactatactgggtcataaagatgtatgggttttcagttagttagacttagaccgttttgga

SEQ ID NO: 159150 - DNA, 637 bp, Homo sapiens
tcaaaaatttaaaaagcatataattaaataagtcttaaaatgggaaccaaaagggaaattctaaactgggcagtgaataacattgtgtaacaagttgtggaaagaaaccaaagcagtactcaaagaaaaaatgatagcatgttagcctgaagtagatttattagagagcatgaaaaactggaacctcttagctttagacaaggactctcagaatagaagaaacttggattaacagcagctcatatagaagagaaacatggagattttagctgacaagcccaatatgcactccaagtgggatatggctgctacacagtatgattccaggttgcatcaacagaagtataagctctagatccaaggaggtaatagtctccttcctctttgaccaaacaaacagtctttgcgtgggactccaaccagttgactcatgtgccaaggcaggccaaacttataatttcctgagtcagggagaatacctgaaataactacagttgtgtagtctgaataagagaagtatccgagtttggagggagatggtcactacctccaagaggcagaaacagactcagaaagtggaagctcctagaaagctaatttgggctgggcacggtggctcacacctgtaataccagca

SEQ ID NO: 159151 - DNA, 454 bp, Homo sapiens
ctctacgaggatcccctccataatgtgtgccatcgaatatctcatgcaatttatagaatactctatggattttatttaccttatctttgagtttgttgattttttttttccttctgcctgctcaagcatgccattgaaccccctcttatgaacaagtaatttcagcttgtattagtttggcagagctaccgtaacaaaatactacaggctgggtggcttaaacaatggaaatgtattttctcacagttctggaagtgggcagtctgtgatcaagatgttagcaggtttgggttcttctgtggccttcttcctcagcttgcagacagcctccttctcactgggcccatacagagtcttttcttcgtggttgtgcatccctagtgtctctgtgtgtgtccaaatctcaccttatagggacacccatcatactgtgttagggcacatctaaatggac

SEQ ID NO: 159152 - DNA, 355 bp, Homo sapiens
ggattacaggcatgagccactgcacccagccgaacatctgtttttcttaaaatgtgactcatgagaggtctaagggaaagatggggtcttaggggagggagagtttggaaaccactgacccctgcagctctgctctctgctttggcttttcctgttggtgtcaatggtgttgtcaccaatgacagagctggggctctcaagccagatagccctgggcttgcagcctgactcctccactgcccctcagtgtgacctggacttttttagctcacctctctaagccagcctctatttcctcatctgtaaaaggggaataataatgggacttgtaagtagttaggaggatttaatgaga

SEQ ID NO: 159153 - DNA, 358 bp, Homo sapiens
ggtgtcaggtctagcacgctcactgaagattggattcacctgctgggtgatcggatgaaggtagttctcctgctcaactctttgagcttagctgctcccacataggtacacgtagagcggatccctcctagtatgtctcggatggtatgttccacatcccctttaaaaggaacttccactgtctttccctctgaggctcttaaagtaggaaaaactttattatcttctccttctggattccttaagcccggcctggcatgtcagggcaagtgatatatgggaaaactctttacatgcaattttgctatgaaccaaaaactgctttaaaaataaagtcgatggccacgcgcggtggctc

SEQ ID NO: 159154 - DNA, 173 bp, Homo sapiens
aggacaagcaaatgcccaagaaaagatatctaaccaatacaggcagtaagcatctaggtcccagcaagggaatacaaagacaggaccccatttctagctggaatggtctcctcatagaatctcagctctttttaaaaacaacaacatagaactggtttttgttgagccaccca

SEQ ID NO: 159155 - DNA, 297 bp, Homo sapiens
aagaaatgtagcaaagccttcagtcatccccgctccatgtgaagacatcaaagaacacatattggagagaaatcctataactgtaaaaaatgtggcaaagccttcagtcaacacagttcccttagaagacatgaaagaactcatactggagagaaacccaatgaatgtcaaaaatgggataaaggcttcagtcggttcagttacctccaaacacatgagagaactcatactggagagaaaccttatgaatataaaaaatgtggctgggcgcagtggctcacacctgtaatcccagca

SEQ ID NO: 159156 - DNA, 632 bp, Homo sapiens
tgggagagcacagaacccaattgcccactcccagtgagcacttttcatcttatgattcagcccctctgcccataagcaccacagaatccaagctttaccagataccatggcacatggacctttcctctttaggtgaatttcaaaattgccactgtcaacttgggacaaaatagcaaattgtcacagccagacatattaacttggggaatggaggaaatcattttaacacaatagaaaagtagactgaataagtaagaataaatacagatgggagaggtctgcagaatgcccggagtctggagcatttcttgtacctacagaagtgatatgtgaagacatcagacccatgttgttgaagcaaaactggatgggaatagttactccctacatttgcccacagacccctcaggcaacaggttttcttttggggacatttattctccttcttcattttttgaagggtgcccttgttagtcatttaagtcagttgtgatctggtaaaaggaacacataggaccaatgaagagaccctttatcctccaggacagtgtgaagggaaagactcaccttagttgatccaccggggagaggaggagcaggacataaagcctttgtgctggtttaagccaagt

SEQ ID NO: 159157 - DNA, 387 bp, Homo sapiens
  misc_feature (21)..(21): n is a, c, g, or t
catcagtttacacaatatcantagtaagtcagctcagctaatcttccatcttaattcatcaaagagtttcatcgttctttaagaagaaatgctaaagaacagacttttacattgtcattggtttcattaaacaaaaaaaaggcgtggccagttgcagtctcatgcctgtaatcatcacatttcatcttcacaaatctcctttaggggttgagtccttatgatatattctgattagatttttactttgtttagttttatgaatgttttctaatttatttttattaattttattaaccacaattatcttttttgtttgtttgtttttttaagggatcatctctttttggagagggaattttttttttctttttatggtgtaaactgatt

SEQ ID NO: 159158 - DNA, 719 bp, Homo sapiens
  misc_feature (21)..(21): n is a, c, g, or t
catcagtttacacaatatcantagtaagtcagctcagctaatcttccatcttaattcatcaaagagtttcatcgttctttaagaagaaatgctaaagaacagacttttacattgtcattggtttcattaaacaaaaaaaaggcgtggccagttgcagtctcatgcctgtaatcccagcactctggaaggctgaggctggtggactgcttgagtccaggaattagagaccagcctgggcaacatggtgaaaccccatttctacaaaaaataagaaaattagccaggcatgatggcacgagcctatagtcccagctacttgggaggctgaactgggattacagacgtgcaccacgctcaactaatttttgcattttttgtagagatgcggttttgttatgttgctcaggctggtcctggactcctaggtgcaagcaatccatctgcctcggcctcccaaagtgctggcattaattacaggaataagccaccatgcctggacaaaatcatcacatttcatcttcacaaatctcctttaggggttgagtccttatgatatattctgattagatttttactttgtttagttttatgaatgttttctaatttatttttattaattttattaaccacaattatcttttttgtttgtttgtttttttaagggatcatctctttttggagagggaattttttttttctttttatggtgtaaactgatt

SEQ ID NO: 159159 - DNA, 255 bp, Homo sapiens
ggcctacaaatagcactacatttcttagcctactccacggcttttgatagaagattcagagaaaagcaggagctagtggatgcaggtcctcctatatctggctgagctgaaggagagctagcacctgtgtgctgagccactctcctccgccaggtactgtcctgaggagatagacaaacgtggcactgatcctgtcatagggaacacccatcttttcagcttttcaggtcataaagctatgttccatattcagaa

SEQ ID NO: 159160 - DNA, 398 bp, Homo sapiens
cctgcttattaacccagtgtggttatgactcagaagatgttatctgttaaaagtctatagaaaaaaaaaaaagcctccgtatggataacttaattttctccagcccttcaaagaacagtcttactcctaaaataagttctgggttaagataatagcaaaagagctgattgattctaacaacgagcaggtctggcctgactaaatagaacttacattaatttaaaaattccaagttgaacttgatttttttagaaagactgttcttgcaacatataaattaacctcattaatttatagttacattgtgtccagtacccaagggttagattcatggtttccatatgcgttcagagaaaactattttaatgtatatatttaggttttttacacacctgaga

SEQ ID NO: 159161 - DNA, 564 bp, Homo sapiens
gaaataagaggcaggaagttgatgctttttgtctacattctgtcctcttatccagagatgaagttctatatcctccccaaagccttccctgttgatttctccctacaagtattcctatagtccttgcagttgcagtttgtactacacaaattaagaaataattatatcctaatgtgtcatatgatatcataatgtgtcatatgatgaccttcatataagaatgcccttgtttctccagctatacattatagatttcctgaagacaggcaccatgctgtattttttctttccccgtgccacatggtgggaagtacataacaagtgtccaacaaatgctacatgttatctttttaatatcctctcttcccttcctcaataccagtggccaaatatgaacatgaaggatcaggaacccccaggatctgtccacctgattggtctgggaaccaaagacataggattgccattgtcacttaagagggaccatgtagctcaggagggttctgtgtcttcagatgctcgaaatcctttgagacagctttagataaaccttccagttgtcaa

SEQ ID NO: 159162 - DNA, 338 bp, Homo sapiens
cccagctacttgggaggctgaggcagcagaattgcttgaagctgggaggcgaaggttccagtgagccaagatcgcatcactgcactccagcctgggcgacagagcaagactctctctcaaaataaataaataaataaaaataaacaatcaaaatttgtctaacatattttactccgattgcacataggatggcagtcataaggcctaaggttattttgatgaagatgagacccaagaaaagatagtaattttcttgtgtttctgaaaaccacttcagcatgagcctgtctaaaaggtttagatgacaaatttagaaagctgagagtagccggctgtgg

SEQ ID NO: 159163 - DNA, 296 bp, Homo sapiens
cctaaaggcagttgccaatctgtacaagttgggctttggttttggtggaccattggggtgaagaggacagaaatcaagtcctagagttcatctaaagtgacagtcaaaaagaataacctcagttttagatgggaccccagtgactctatcgttaggttaagggtgaaacaactgaactgtctacacactcccatatccatgtgattgcagggaaggttgaatggagcaggaggaggaaaaggaaattaagaaaaataaacctttcaagttgtgaccacagttttagccttcacagt

SEQ ID NO: 159164 - DNA, 256 bp, Homo sapiens
gagtaactatttctatagggcataaaaatctcaggattcatttgggtttgaaactgacatggccagacaaccttcaacatttttcatctgggacttcccctcgatcattctaagcactgacctatctttacacactgactgtatctttacacactgatcgtacctttacatactgattgtatcttttggcttctcttctaggattgctgagtatgtgcaagagacatttattgaagagcagctttgcttttacttc

SEQ ID NO: 159165 - DNA, 185 bp, Homo sapiens
agttacttttacctgtgtgtcttcctcgatgaactgtgtgggcccttgtggggagaaggcagtgtctcatccatctttatagccttactgtccctaagactatccctgggaagccaaggaaacagtttcatctcgcctatttgccaggcattctggcaggcactctacatacatcaacttattcc

SEQ ID NO: 159166 - DNA, 388 bp, Homo sapiens
gagagtggggggctctgctttcacagccacgggcagagccctccttggcctgccgcttcttactgctattgctttggaagagcaggagcaaaattcctgccttgggctggctttcttttctgctcagaggtatgtggggatattatccagcaggccagacgtctagcccctttaatgacaataatgataatttacatttatacaaggcctttcattgggggattttaattgtatcacaaacaataattaattcccctttgcaagtctggcagtcagctaagcaggagcccctttactctgcaggtgaagggtgctttcctgggcctgcaacatgctgggggtctcccacctacctgacacctacccaccctcaaggcctggcctaagc

SEQ ID NO: 159167 - DNA, 570 bp, Homo sapiens
gaatatgcaggctggggcccctgtgtgcagcctctgtgaccagcccagttccttacttccacacagctccctcctaggaagcatcttgccctcagaccacctgagcacccacttcccactgcgctgaaagctgagatggtggtgttccgagcacagctggacctgagtgagctcccccgtgccccatgaggattatgcatctgctgtgcaggaaatcccagagaacacaggggtgagcaaggcaggcctgtccaccacctgcagtgctctgtgccaggcagcagggagtgcagcaactggcctctcatgctttggggcaggaaggagaaagcctcaagccacacctatagaccaggagcctcactgcatggaggggtcactgcacaggtttcaggaactctgctcagatagtggcatcttagaaactctgggaatggctatataccaccacaacttgttttcctcagcatttatccagagaaaggtatttttctataactgaggatagtagttttatccctgtctcgtaattgttttcccactatttcagtttcacttagatttcgtaat

SEQ ID NO: 159168 - DNA, 281 bp, Homo sapiens
tagacgttttactgatctagctagtccccaattgtttgccatgctgtaccacagggatgcagtaaggcctctccctgtccacatccttgtgcacttctggagggtctcctcaaggatatattctcatatccctgtaaccctctatctaccacatggccctgctggctcgcttcaaaagccctcttctaaagctactcatatttacttgctataatatttgcactctgtcttatgaaactgtatgttttgtaaggttcatgttcaccactgtattctcagat

SEQ ID NO: 159169 - DNA, 695 bp, Homo sapiens
tctagctcggtaccccacaccacctagagtctacatattatcccttcatccctgattcagatcttagtgaccaaaaacaggaagaaagcagttactcgaatttcacccaattttaaagggtgaaattaagtacatccctggctcatctactctcaagggtatcatgcctactggaaaatggaccaaaaacctggatgaactaagttagtcttttttttccccatcaggcaacttagttgtctgtcagatacaactggatagttacccaaaactagcaccccttaagagaacactcttcttataacatctggcttatttttggctaaagggcagcactgggcttcatgggaaaacctaataacaagaggcttaaacctatttgaccacagataaaatacaccttttgtaaactgtttaccagattcataaaactgctgtgcaatcataaggcaaaggaaaggtttataagggcttcatttagaatatacaaatttaataaaaagaatcaaaggaaatatgggactgagacaccccaaaggggtaaatgttaatttagtaagctatttagaaccacagactgctgacacagcattaaaataccatgtgacatgaacatctcctaaggtccctcagcctgtcaatgtgatctaccacagggactgacctcaatactaaaaaggcagatggctgaataa

SEQ ID NO: 159170 - DNA, 263 bp, Homo sapiens
gcctgtaatttgaattactcaagggaaatgtgctatacaaaccaaagctatcaccatgccacagtgactgcttgctctacaggaggaggacttcacccatatgaatggggtgacacatatgtgtgcttgagtcccttccctctggctaatctgagacaactcaacctctccctctttccccaatttcttctcgtttgctatgttgattggattgttttctcaagactcttggttgtaaaaatgaaaacgaaaataggcagtta

SEQ ID NO: 159171 - DNA, 279 bp, Homo sapiens
atatattaagactaccaaaaaaaactgctgataatcaaaaagagaacatataattccatttatgcaaaagtacatatggctgtttacatatggacagagagatatggaaggatgctcccaaaatactaatagtattatctctaatagtaggacttttaggtaatttttacataatttgttaacccttttttatagtttgaattttttatgaccatgaattatttacataaccagaaaaagaaaacattaaaatattttcactttgggaaaaaaaaaaag

SEQ ID NO: 159172 - DNA, 364 bp, Homo sapiens
tggggggagaatggggtccggccagccagcggacgcggtccaggccagccgccggcacccacagcgaggcacaggtaagatgccaaggctgagttgtcatggaaacagaacacaatggggaaatgagcgtggggggagctaattattcaaggacagaaaaacggtatcgacgtccaaaacaaaaccaggaagaacaaatgaaataacaaagcaaaagcaatttaaaaaaagaaagagagaatctaaaaaacaaacaaacgaaaaaactccctccaaaacaaaacacaacacccaaaagcaagaagaaaaaaaaaaaaatcatggaatgggtgtggggctgaaaatcggggtctgaaaggaggag

SEQ ID NO: 159173 - DNA, 205 bp, Homo sapiens
cagaggtacctgtgcaggcgagtccaatgcccagctctttaataaacacgccttgcggtgctggaagagactcaaagtccatccaagacagattctgtcttcccactaaactggaagctccttaaggaccgggatgtggcagttttgctctcagctatgtgcccagtgctcagcacagggcccggcctgcctgggcactcagaag

SEQ ID NO: 159174 - DNA, 196 bp, Homo sapiens
cagagcaggtgtctctccggagcagttgagtagaacagctggcgtcacctcttcatgttgacgaggggagatgagtggcccaggcagttcctagagcgggggagatggagtgggccgtatcccacccagcaggagcgcttgcttctgaagctcccgtgcgtctgtgacagaggcttgaacccccggcttgttctct

SEQ ID NO: 159175 - DNA, 514 bp, Homo sapiens
cataataacataatatcagcctaatcaggaactgcatttttaaagcatcccctaacacacacacaaacacacacacacacacaaccaaaagccccttaaatcactgtacacatatagccacaaaaaatcatcctgcatccttttgcatcatccaatgtatttacttagaaatcttcccaccagggactccagggcctctctgaaatgcaatactctcttattcatttgaaaaatctaacctcaaaataatttatgaaattcattccacctttgcagcataaaggagaaaattctttatgagaaagcgctccagcaaagaacataccagtggtcagctgaaatacgaacacccaaaattagtggtatagagtctttgaaagtcaagacattccgttaaagccactatgaatatattctaaacaagcattttaatgtgaggtctcaaccacctaatcacctatgtccgtgtgcggtgacacacattaacatgatttttagagggaaaagtgaaaaa

SEQ ID NO: 159176 - DNA, 310 bp, Homo sapiens
gcatattgctcccatcaggaagaaaatgtgccacattatgataatggactaaatggctcactatataaaaagtgctgataaataaacaagaaagacattactttaaatagaaaaatgagcaaatgactttaagagatgggtcagacaaataaggatagaaaaatatgtgtgctcttataaataacgagagcaatatagtttaaaagcacaataagattactttccaaactggtaactttttctccctaaatactgggaagtataagataagaacagggcaagagtgctgctgatggagtgcagactgtag

SEQ ID NO: 159177 - DNA, 499 bp, Homo sapiens
gaaagttaaaattgtgaggtctatataagaaatgacactgcagataatccatcaagtcaatatatttcaccagagaaaaaggaaataagacgttacaggatggaaatgtaatttaatagctgaatgaatacttatctgcctatttcatccttaagaagaaaaagaaaagtgaaggcaacccaggtggttacattataatgaagttgaaattctgccacccatgaaaactgcaattgggattccacttttggatttggccagccagaaacagatgtgtgttccaacaagaatcacaggctgcatctcctggacaagagctctttagagtgcagcaggagtttcaactggtttcaactccaaagaaaggactagactaaactgagtataattgttccaagtgtttagaattcccaagttggactggggctaaatgtgtggttctcattttatggccttgaaaaagaagacagtgtgattcttccttgttctgttaaaaaaa

SEQ ID NO: 159178 - DNA, 529 bp, Homo sapiens
gcttgcatcatgtagtgacatcagtatgtacaaggacgatttgtaggatttttcaaaacgcctgttctaggataacttgttatgcatctgcaatatgccagctgcttttgaataagaggtttcagtaatactaagtttctgtgtccagatcttgggcccagttgaaacagtacagctgattggtcacatttaaaacatatttatggagaaagataaaaggccaatgtgtccgacttgcaaaagacaattagagtagaaagaagactggaacagtaaaagccagggcatttttaaatcttggttttctgaactttaacgtgccagaggaaaaaaattttttttcaattttaagggggaaggagatggccttaaaataaaggattgttcagagcctaaactgtgcttaatggaatagagctaggtatatcatctaaatcttgaatttgactaatataaattcagctttcttttaaagaaaaaactcgtaagcagaagtttgtgtattctacagaacctcttcactagctcg

SEQ ID NO: 159179 - DNA, 203 bp, Homo sapiens
ctagtgtcatcctcacatcagctcttctgtcccatcatcaacccccaatgcctctgaaatattacctctattctgaactttttctaagtaataaaacctaagttgatagtattccttggtcacccacctgtctgttctccagcgtaacatacacatacccattcctgttcctctgtatatgacattcccccagttctcctttt

SEQ ID NO: 159180 - DNA, 246 bp, Homo sapiens
tgtggcgtctcgaggatcccgcataggtgtgctcatctttacaaaacccttgtgaggtaggtactcttactattcccacctcacaggtgaggaacacaggtaaagacatggttgagtaaattactcaaattcacccagctaataaatggcagatacagaatgtgaagccaagctgactgcagagctcatgcttagaaaccactatcctggtctgcttcttgcactgagggccaccattactgtcac

SEQ ID NO: 159181 - DNA, 202 bp, Homo sapiens
ggatgactgggaccctctccagggtccgtcccatgccttcaatcctcccatgtaggcctcagtctttccatcgataaaaccagaaagtggagacaaacctaaaggctttttcagcttggatgcacaaggacccaagaatgtgtcctcatagccatgtgctaagaagccacctagcatctgtgtgagcagaagtcactggtga

SEQ ID NO: 159182 - DNA, 352 bp, Homo sapiens
cagcatttgcatataaaaatttaaaaacttaaaaagaaaattcaatacaatctcacaatgtggccagaaacgattccatgatttctcaaagcagttaaatacttttccaagacggagaatgcaaccaggctgctgggtacctctccagcttcttagcgtgctaagctgaacagacagcagaaaactctcagaacactaggaaggctcagttccaaaatgcagaggatgaatctcccaagatgaaagccattgcgtgacaatgatttaagtgctgaagggaaagatctgacagctcttctgcttcaggtgacaatgcccttcaggatgctccctgtccagtgccaggctcttg

SEQ ID NO: 159183 - DNA, 446 bp, Homo sapiens
gagaacaccttttaagaaaaaggaagtacattcgcccttggtctgtggtgaaatgtaatcccgttggggtgcaggagggcatccgtataagagaataagaaacagggcgcctgccaggctgtgtgccgtgtggcaggtgagatcctggctctgagctcatctcgaagggccttgggcctgtatgtattttgagcattgtgcagtaaggggtggggcatgggaggccaggactctggaagccgaaggaggagcattacttagctaatctgggatggagatgaagcgcatgctgctattctgaagtagggaagcgtgcctggaatcggtcctctgcggggcctgatgagagggatgctctcgtttactgaacgcccgtggtgtggccagctctctgctgggcacgccgtggggtgctgcctgcaagattgctcgtgcttcagcagccc

SEQ ID NO: 159184 - DNA, 576 bp, Homo sapiens
tgcttgagcccagaaattcagaaccaacctgggcaacatagagaaactccatctctactaaagaagttttttttaattacctgggcatggtggcgcatgcctgtagtcccacctactcaggaggctgaggcgggaggattgcttgagtccgggagatggaggctgcagtgagctgtgatcgtgccactacagcccagcctgggcagcagagcaaaaacctgtctggttggggggaaagctgcttctaaatagaaataggcattttagaatcaccttccccttcccgcaaaaaaacaacaacaaaaaagccagaatgctgtctgtgtatgaacaaatcttcaatcctgggttgagattatgattcaaaacagtttgaacattttgaattttcttaaggtgcttttttacagatccatgacaattactaaaaccttccccaaataaaaaggacgtgaaaaggtaaactctgtaatggacagtttaaaattggaaatgttgttagtaaatggattttgtcaggtatatgatgttatctcatgtgtcttaaaaagaggggtgactctgatgtggggtcat

SEQ ID NO: 159185 - DNA, 396 bp, Homo sapiens
caccatatgcccatcagtccggattgactagccgaaacctgacagcatgaaacgactgctgcttctaaatagaaataggcattttagaatcaccttccccttcccgcaaaaaaacaacaacaaaaaagccagaatgctgtctgtgtatgaacaaatcttcaatcctgggttgagattatgattcaaaacagtttgaacattttgaattttcttaaggtgcttttttacagatccatgacaattactaaaaccttccccaaataaaaaggacgtgaaaaggtaaactctgtaatggacagtttaaaattggaaatgttgttagtaaatggattttgtcaggtatatgatgttatctcatgtgtcttaaaaagaggggtgactctgatgtggggtcat

SEQ ID NO: 159186 - DNA, 626 bp, Homo sapiens
gggggaattgggaggaattaggtagtaactgctaatggtaaggggtttatttctggtgtgatgaaaatgttctaaaatggtggtgatggttctacagttctgaatgtagcaaaatccactgaactgtacactttaaatgggtgaattgtatggtgtgcgaattatatctcactaaagctgttatatgttagagaaagggggaaggaatgaataaggaaaccaaagttgtcctgcatttccacagaaaggtaatcctgtctttgaaaatcttagcttttttctgcttctattttagttaagctttaggattcaagactcctcactggtaagtccccagttgtcttttctccatctctaatctttgtctttactaacaagggtgatctacctaagggagacagcattcactagttacaactcaatctctgaacaaaaaacaatatgcacactatgattacaatcatataaaaatacgtatgagaatgaatcaggcctggaaagaaatgaggaaaagtaaaaatagctacataagaataatgaggttggggtgacattctttttaaaacttagtgtattatcagcaaataaacttagaagaaaaaaataaccaaactgtctccctaaaa

SEQ ID NO: 159187 - DNA, 354 bp, Homo sapiens
tactcatatatccaacgctctcacactatttagaaactcacaaaacagaatttcaaacttgtgaactaaggaatgttgcctgaaaaatctagtaaacaccaaaatcttcagaacatcacattcctttatatatttaaccactccaaaagagtaagtagttttccaaagttatgactacagaaaaagcatagtcatctttagtgatcctagattccacagggcagcatcaatccaaatttacaagcacagggacaaaggatttcgccctacaggatgtggtttccctattatctaaactaggccatcaagtatcatcctgcaaggtaccatgccactcaatgtgagcagcgttgt

SEQ ID NO: 159188 - DNA, 432 bp, Homo sapiens
gggtgggagtacggaatatcaatgagggatatctcccctcagatgtagcagagaattgggaaacaacaaaacttacaatcaagctctgcaacctactagctgtgtggtctgaaggcagaagacaatctctcttagccaaatgtccttgtctgtaaagccagagagtatgttcagctcttagagcagttctgaggattaaatgaagtagtaggataatgtgtctgacacacaagcacccaatccctaaaccattctaccactaaagcacaacagttaagagtgtaatttttggagttatatgccttgttctgaaaactgttttcatcatttatcagctaagaattaaatgagataaagttacagaaatgttggcacataaatgctcaatgatgtaataatactaccaaaagcaaaaaataggcactaacaaaa

SEQ ID NO: 159189 - DNA, 615 bp, Homo sapiens
aaggaggaactttgctctcttctctcacagctgtgtgtgcataggaggtagttcggatgatgtgggtcccaccatgtattccttctctgttccatgtagagtaaaataaatgggagttctgtttaatgcatcacctcggttcatattgcatttgccaagaaagtgcaattttattgaacattaggattgaattcttaactgagtaatcaatttcagtagtaagttaaaatgccttctattaatggacaactgcaaccgttaatcagagttacagtagattaacagttgtcagcatttatgctaatagcacttataaaccgtgggctcatgatttgcactttataattccatatttctcaaaacagttggtaatactttttgcttgaaggtattgattcttttgtccctttgcttgctacttggagatgtagagaaagctaaatgacattttcacggtgatgacacaatatcaccttctgcttttgcacacttggctttgtgtcaaaatagatggaaagggttcatttgttctggtgctctactgtttaatttgatctggtgtgtgactaaagcaagacaaatagtatttttaatgaaaccatttaataacctctg

SEQ ID NO: 159190 - DNA, 170 bp, Homo sapiens
ggtctaacctctctaatgctcatgttagtatgatacaactccatgaagaggtaatcttcattattttcagtaaatttaatcattttccttccttaataccactgtatgaaactggcatctgggatatagtcactggccaggcaaagtggctcacgcctgtgatcccagca

SEQ ID NO: 159191 - DNA, 330 bp, Homo sapiens
catgaacagaccaataattagtaacaggatttaattagtaataaaacttttccaatcaaaaaacgttcagtacctgatggcttctccactgaattctaccaaacatttaaagaagaactaatatcgattctattcaaactatccctaaacattgtaaaggagcaaatacttccaaactcattctatgagtcccccactacaaggacacaataaaaaagggccaatatttctagtaaatatagatgtaaaaaaaaatcctcagcaaaatactaggactcaggtggtgtgactcaggtggtgtgactcaggtgatgtgactcaggtggtgtg

SEQ ID NO: 159192 - DNA, 586 bp, Homo sapiens
tatggtgcgagaacccggcggactgctgtgtccagagaatatgataccttccaccgcatctctcctctcctcttctatccttcctctcatgactgtcccgcttgcacctcattcatctgctgtggatctgacgcgggttttgctatcaaacacgtgttcaatcccaaccacgctactttctggcaaccatcaatggtgctggattggtgtgaagattcaattaagttagtgccaataccacattacctggttaaagcacaagcactaagtataagcactaaaccattcctctttgtacatctcttcatcaggaatattctctattccaatctctgacagagattgtaacgtacccacttcctactgaaaattcttattcattcttcaatagtgaagcactagatagtccctcttttcacatatatctttaggcactgatcaccccattttgtgtgcttcttatataagtgtgtacattcttcacatttaactttttttaaaaaatcacgtttattgagatataacttgcctacaaaaggcaacattttgaatgtaaattgtgattgattttgacaaatgtgtacat

SEQ ID NO: 159193 - DNA, 503 bp, Homo sapiens
tctctactcctattaaagggaaagcagtacccgaataataaactctacatcaaacttaaccatccctgaaacagtctgcactgcctaggtgaatctgttactaatttgtgtttcaaacaagatatgtacatgtttttcaaaatacaacccattcacagcattaaaacaacagatgatgttataggctgaattacatcccctcccccaacttcgtatgttgaagttctaacccccagaacctcaaaatgtgaccgtatttagtgacggggtctttaaaaaggtgattaaggctgggcgcagtggcttatgtctgtaatcccagcactttggaaggccaaggctggtggatcttctaaggtcaggggttcaagaccagcctggctaacatggcgaaagcttgtctctactaaaaatacaaaaattagctgggcacagtggcgagtgcctgtaatcccagctactcgggaggctgagggaggagacacgcttgaacccgggaggcg

SEQ ID NO: 159194 - DNA, 478 bp, Homo sapiens
ggtcgccattcaggtggctcccggagtccgctacctccgccacacccgccatgttgcccgagagcgcgcgagggaatgagacagatcggcgagggccccgaccccccgaagaacttgaacaccaagttgcagatgtacttccagagcccgaagaggtcgggaggcggcgagtgtgaggtccgccaggatcccaggagcccatcccgcttcctggtgttcttctacccggaggacgttcggcagaaggttctggagagaaaaaatcatgagttggtatggcaaggaaaaggaacattcaagttaactgtccagttacctgcaaccccagatgaaatcgatcatgtctttgaagaggaacttctaacaaaagaatccaagaccaaagaagatgttaaagaaccagatgtgtcagaagaattggatacaaaactccctcttgatggtggattagacaaaatggaagatatcccagaggaat

SEQ ID NO: 159195 - DNA, 363 bp, Homo sapiens
tatctctaacattagtattgttgtatttacctctatatcagtttttactgtatctgttttatagctatttatgttattttactatgatcctattgccaactagtttaattatttcttctgttttactcatgggaaatctgaaggcctagacttgaaagcagaagactcatttctatttgaatcttggttctgccctttaggggctgcatgaacttgggcaagtcacatagctacactgagcctcagctttcttatgtataaaatgaggacaataataatcgacctgcccatctcacaagttgctgtaagacaaaaataagatgcttgaaaagaacttcataactgctataatgttagatttta

SEQ ID NO: 159196 - DNA, 367 bp, Homo sapiens
gaattcatggcaggctaacaagttagcttcaaagtagagtaagatctcaaaccgttcagagttcttcagctgttctcaggttacataccctgaacatactcatctcttctgtctgaaatactctccttctacttctaggtcaatgatttcatgtttctttcagaaattcacttctgtgttgtattcccagaggtatgtgccctcccaacccaaaaacatcctttttattcctagaattatcaaattgtatatttgtgtttatgtgtttatctcccccatttgaaagcacagatatttgttttgttcacagctgtatattcagagcctagcccagtgcctgacacatatttgactgactagataaatg

SEQ ID NO: 159197 - DNA, 297 bp, Homo sapiens
atacaaaaatcaattccaggttgataaaagacctcaatgtaaaaggcagatctagagagctttccagctcgacacaggagaatcgtgtgctgcttgggggcagcaaaggggtttatgaacgagaaataaaaagcacaaactaggctgggcatggtggctgatgcctgtaatgggaaaccaaggcgggaggatcgcctcagctcaggagttcaagactagcctggacaacatggtgaaaccccatctctacaaaaaatacatgtgttggcacatgctagtagtcccaggcactcaggc

SEQ ID NO: 159198 - DNA, 208 bp, Homo sapiens
gattgcgagctcggtaccccacaccacctgagtcaagggtttgttacgtctcccagttcctcacagataacttcttggcagctgcttccttagtgtggcaaaagaacacagtgcctgtatttttcaaaaaggtaacaaacacttttccttttttattttttttcctcgagacagagtctcactctgtcacccaggctggagtgcagtg

SEQ ID NO: 159199 - DNA, 512 bp, Homo sapiens
gtgcagctgggttaatgggatagggtctcttttcacaggtatttccagttggctggagccgagggccttggagaactgactgccgtggtttgttttccttctttccggttcgaatgggattaatggcctctataaatgtaaaggaatgctttatttagaggcacccatttgtttctgaggcttcttgcttccgttgaatgcagggtttacttcccgggcctcatggtgaaaagtttgctctaagacaggcttgactcatcccctaaggctgatgctttgaaggcactgcggggtaccctgccctctctttataggattccctccccaactccagccagacattttcagagctggttgtctcttgtagagctgggacctacttctgcaacttgttctctttagttattctcaactgtccctcagagtgatcctgagatccaactcaagtcagatcatatctctctgcttaaaaccttcgaatggtttcccagagtcctgccaggctccacgaa

SEQ ID NO: 159200 - DNA, 412 bp, Homo sapiens
caaatgcggaccacacaggagccagagccctccggggaaatgccgcagcacatgagggccaggggccagggagggggctggggctctagagcgaatccatggctctagaaagagagcaagaagagctacctgttctctcagtcctttgcgttggccatttccacaaggaaggaaacacacagaacgtcttaatcatatttaatcacattgcgtgagggttaacagaaaagaggaccaaaaaataaatgaatgaaacccatcttaaacaatggatgttactgaatattagcaagctggcatctagcgacagtgatgtttgttactagtttcacgttggttccaccttcaaagtacctgaagataatttgaatcagtaattgtgaatcctatattgttaggccttatctaagga

SEQ ID NO: 159201 - DNA, 422 bp, Homo sapiens
gcctcaggctttcatctgtaccatggccacagtgcttcctttcttacggattgttttgggggcagccaagataaccctgtgaagtgtccagctcactgcaggcctccctcttcggtgatttggggtatggtgtgagaatctggaggaaaaaacactgggtggcagaggccccagagagcatcctctgcccatctcagccaggccaggaggaaaggcaaaggacactaataatttttaagttacctgcccccctcaacctctacatctttaattacaccccctccaaccataagccacacagtaagggaaacttctcctgctttattttttttaatttttattttttgagatgtagtttagctcttgttgcccaggctggagtgcaatggcacaatctcggctcactgcaacctccatctccc

SEQ ID NO: 159202 - DNA, 435 bp, Homo sapiens
tattcagaggatccccttatgtctgacccaccgtctccagacatgccgatcgctgggggacagacatctgcagatcagaataggcctggggacagcatgtgtggtggacctttggctggagggaatttggagcactttggagaactcagcaaggagttgtgtgtcttgggcacagagctggaggggagggacagacgcaccatccaaccttgcagcctttgttagatgttactgtctttattctgagaaaagtgtggaagagggggtggtacaacatttgaccatggaacctcataatcacattgccttttgggatcatactctgcccagtgaagaatagactcacggggtcgcagtggccataaggagatcatttagggcagggtccttggacttttgactcggagggtgccgtggaggtggagagaagttgcg

SEQ ID NO: 159203 - DNA, 436 bp, Homo sapiens
aagcaggttatagcaacattcctaggactaaatctctctctcaaaaaaaaaaaatcaaactacacaattagagcttctgctaaactacttctgaagaattgaaatatccactcattctcctatctaacctcatctcacctcattcacaacttgtgcatctagcacagtatctggtacataatacatattcaaaatctgttgaatgtactaatgaacatattggtttcatatttatttccttctttcttactaaacctttgtagcatcttctcataagtaaaactcaacaggatcctgtggacagggaagaacattgacagagtatgaacatgtggttatcacctttgtagaagatataatcatgcttttcaaagcagctctactattagaaaaattgccttggccaggtacagtggctcatgcctgtaatcccagc

SEQ ID NO: 159204 - DNA, 289 bp, Homo sapiens
ccccaaaggaaggctttgaatacaattattcctacattggttctggctctgtaactggagtttctatggagattggcgggagaaatcagagtcctagtcatattctaacatcaaggagcaagtctaggaatgggactgcgcagctcaccgtcttgctttttcattttgcttcttctaacatttttcatgatcccctaatccgtgtgacttttaaaaatatggtttggaagtgccacttttgaagcatgtgaatagaagagcatctcatcccctcactctccccggtaca

SEQ ID NO: 159205 - DNA, 506 bp, Homo sapiens
aaatcacttggaatagaataaagttcagaaaggtcaaggatagaagtcagaagatctgacaaacagtggtaaaactgtaattatcctaagccagaaaaaggtgaattgttttaaaattatagttattttttttaaattgtgacttatcctgggtaaacagcagcatggctctggtcttgagacaacaagccacatgcaaatagctataagcaagattatcagaaaacctgagtatttcattgttttgtcattaatctcaccatggatctcattctactttccctttagggttagcttccacaggcattagaaaatacagaacctgttgagggccaaaaaagtgatataaaaagattaataataataatacctttggaaaaaatcaaaagaagtgaggtttcccagtctaaaatgagaagaataaaggttaatgtagtaaacatgttcatgtattgaatattttacttagagaaaagtttgcagtcaccatccccctgtgaaaagta

SEQ ID NO: 159206 - DNA, 552 bp, Homo sapiens
ttactcaagtccaagtctttgtcttttcctctgctctttccatacctcctaggcaaggccaccagtcttatgaattcagccatcacccatctcatacacttcacagatttctatttccaagatggactcttctctgggaaccagcccaatatatattagcccatgtactcaatatcacttggatatatcaaagtcacttgaaactctataccaaaatcaaacttctggccttctgccagccttctctaacttagaaatggtaccatgattgatccagtggctcaagtcagagaccaatgagttctctttaatggcaccttctccctatcttttctccatccccttttatttcatgacaaattcctgttgattttgtttttatatatcactcaaatgtatgcagttatatctgaatgcattcattgaatatgctgccttttgaattcctgccttttgaattactcctccagtaattattcttacatccacacagtggataagaaaccagagctcactttgtgagtgctcagacgaaaggcacatgagggtggc

SEQ ID NO: 159207 - DNA, 356 bp, Homo sapiens
gctaggattacagacatgagccactgtacctagtcataaatagccattctaactggtgcaagatgatatttcattgtggtttggatttgcatcttcctgatgattagtaatgttgagctttttttcagcattttttcatatatctgttggccatttgtatgtcctcttttgagaaatgtctattcacatctttgcccactttttaatgggatttttttcctgttgtttccagttctttgtatattctggatactaatccctcagaagaatagtttgcaaatatattctcctattcagtaggttgttatttcactctgttgtttcctttgctgtgcagaagcttttttattttattt

SEQ ID NO: 159208 - DNA, 338 bp, Homo sapiens
gttgctgccctattggagtaagctgctcttagtggctgagtctcccaaaggcaactgtcaaaggcagaaagcacaattctgaaagtttcagggatgaggcgggccaggatgaagcagctaggtaatcgagggttagtgatgacagcagtaaactgtgacaatggttgagcacctagctactgcataggttcaagtcccagctttgccatttactaaccataagattgggtgactttgtagtttctctttgtttcctcatctgtaaaagggaggtaataattgtacctgctctatagaattaatgtaagaattaaatgagttcatacgtggaacaatgt

SEQ ID NO: 159209 - DNA, 318 bp, Homo sapiens
aaactgtcaccacttcctttcaccaggcagcttgagagtaatctttcagaagccaaatattggtaattcatctaactgaggctataaatcctgcatttttagtaaaaagaaatggtatttttatacgcgacttatataataataataggctgaactgtctggtgatgcggtggaccagactcttctcctaacatagctcacgtttcagtgatccatgtttcagttatgtggcagtggacccatgagatatctttcagagggactttctgatactactcataggaagtttgggttagagatagtgtttccctgtgtttc

SEQ ID NO: 159210 - DNA, 625 bp, Homo sapiens
ctgaggtggaaggatggcttgagcccaggaggtgaaagttgcagtgaactgagatcgcaccactgcaatccagcctgggtgacagagtgacaccctgtctcaaacaaagaaacaaagatttaatgtggccatgatagctgtctttgaatactatgaggcgagcatatgaagggaggtagccaacttgctctgcgtgttgacaaaaaaacaaaggagagcggctctgaacctattttggttctaggagctgcttgattcacagatcattctttgcttcattaaattctgtaatgcttttcttagaagtaagtaaacacaagtagaaattgcatggaaagaaaactgtggctcaatacaacataattctggcattcgaatctaaagtcatgagagtcacataatgcatttccccactgcccagtatctggaagggattcctgtactgagtgtgggctagaagatctcttcctttcaacccactaattctatgacactaaggaaaaggggaagataggagctagcgcagagaaaagagcagacagggactaggcctgaaacagaccagcacggaagtggtcatggaacccagaaatggaacaaggagctacgtcgcaggccacaaaag

SEQ ID NO: 159211 - DNA, 329 bp, Homo sapiens
ggtggagcaacagcaaacttggcactctctgggcagagacatccacctttgctggcccttggacattggtgctcctggttctcaggccttctgactcagactgggatttgcaccactgctttcctgggccaccaccttgcagatggccgactgcaggtcttcacgacctccatgatcatgggagccaatctcgcatgataaatccttttctcgctgggcactgtggctcacgccttgtaattccagcacttttgggaggctgaggggggaggatctcttgagcgagggagtttgaggccagcctggggcaacatagcaagaccaccatc

SEQ ID NO: 159212 - DNA, 118 bp, Homo sapiens
acctatgggaaagaagataagaccaaacatttgtaaactcttcataacttcctgagctacatgagaaaatcacattgttctttgggaattgtttgttctattttatacactgtactcc

SEQ ID NO: 159213 - DNA, 175 bp, Homo sapiens
atgtgacccttcttaattaactgcctccctctgatcctgttgcctgtgaagagggggttgagccaggataggaggtttggcttgctttagtttgagatgtgttgtttggcctggagaacttggagctctgtcttcatatactgaagtgatggctggttccacgtcccctccccct

SEQ ID NO: 159214 - DNA, 101 bp, Homo sapiens
gcctggaaaatagcacggtggctgggcatgtaactcaggacactgccagagggtggaatgaatgaggctggcacatagtggcatccagtcagtgtcaccag

SEQ ID NO: 159215 - DNA, 2309 bp, Homo sapiens
cttgagaatgtttctgcatgatttctctgggcttgctgtcttacctgagagcaggaagtcaaaaggagagtgatggagccacctgctgccctctactttgcagatattaaagaggagcctgaaactgttccttggacatcttatgaatgtcagaaaataccttttggagggttagaagatcaggggacatggttgttcacatttgctgccacggaacaccgccagtcttcacttggaaacagaatcacgccttgtgaagagatcatccctaagcaggagagaagctactaaaggattgtgtcctcctccaccttccctgtgctcggtctccacctgtctcccattctgtgacgatggttcaatggaagagactctgccagctgcattacttgtgggctctgggctgctatatgctgctggccactgtggctctgaaactttctttcaggttgaagtgtgactctgaccacttgggtctggagtccagggaatctcaaagccagtactgtaggaatatcttgtataatttcctgaaacttccagcaaagaggtctatcaactgttcaggggtcacccgaggggaccaagaggcagtgcttcaggctattctgaataacctggaggtcaagaagaagcgagagcctttcacagacacccactacctctccctcaccagagactgtgagcacttcaaggctgaaaggaagttcatacagttcccactgagcaaagaagaggtggagttccctattgcatactctatggtgattcatgagaagattgaaaactttgaaaggctactgcgagctgtgtatgcccctcagaacatatactgtgtccatgtggatgagaagtccccagaaactttcaaagaggcggtcaaagcaattatttcttgcttcccaaatgtcttcatagccagtaagctggttcgggtggtttatgcctcctggtccagggtgcaagctgacctcaactgcatggaagacttgctccagagctcagtgccgtggaaatacttcctgaatacatgtgggacggactttcctataaagagcaatgcagagatggtccaggctctcaagatgttgaatgggaggaatagcatggagtcagaggtacctcctaagcacaaagaaacccgctggaaatatcactttgaggtagtgagagacacattacacctaaccaacaagaagaaggatcctcccccttataatttaactatgtttacagggaatgcgtacattgtggcttcccgagatttcgtccaacatgttttgaagaaccctaaatcccaacaactgattgaatgggtaaaagacacttatagcccagatgaacacctctgggccacccttcagcgtgcacggtggatgcctggctctgttcccaaccaccccaagtacgacatctcagacatgacttctattgccaggctggtcaagtggcagggtcatgagggagacatcgataagggtgctccttatgctccctgctctggaatccaccagcgggctatctgcgtttatggggctggggacttgaattggatgcttcaaaaccatcacctgttggccaacaagtttgacccaaaggtagatgataatgctcttcagtgcttagaagaatacctacgttataaggccatctatgggactgaactttgagacacactatgagagcgttgctacctgtggggcaagagcatgtacaaacatgctcagaacttgctgggacagtgtgggtgggagaccagggctttgcaattcgtggcatcctttaggataagagggctgctattagattgtgggtaagtagatcttttgccttgcaaattgctgcctgggtgaatgctgcttgttctctcacccctaaccctagtagttcctccactaactttctcactaagtgagaatgagaactgctgtgatagggagagtgaaggagggatatgtggtagagcacttgatttcagttgaatgcctgctggtagcttttccattctgtggagctgccgttcctaataattccaggtttggtagcgtggaggagaactttgatggaaagagaaccttcccttctgtactgttaacttaaaaataaatagctcctgattcaaaaaaaaaaaaagggggggtctagagttcctgggggcaagttagcgtccagttttgtacaagggccaaagggaggatatagagatgggggttaaagtggagggaaagtagtgatttggaggaccttttggggggctttggcaccaaaggtagtagaataataggttggaaggctggggatggcgagat

SEQ ID NO: 159216 - DNA, 759 bp, Homo sapiens
gagcctcttctctctaagtcacgggaactgcccttgctacttgtgacctgccctttactcagcagtttttgttctgggaagccctgggattctgctaatacctatcactgtaggtgctgaagggaaacagatgaagaacatgacctcaaggagcttcctgtcaatgagaagaccaagctgacgcctggcaaaggtaaatgccaccataacaaattaagtaaaagtgtgcattagctaatttgtaaattcagcttaagatgaatcctgcttcttgggcccttctctgacgctggtgttgggactgtaggattcctcgagcctccgtcaaggttaacatcaaatcccactggcttctctcagcaccaccttgatgaccctagcttagtttctctgtttcccatgactggaactcttagacctttccacaaacatacaaggatttataattcaaagctcaagcgatgaagttgaagcttttggcccataggaagcctgaactagtgattaggagaaaaagattgaggagtctgagtgggaagagttagctatttgaaagacagcattatagtagtagtcattgtaggaaaactcaggactgggttggacttacttatattatgttgctttatattttggttactgagggaggtgaaggtcatcctttcagttcttgggatgtctaaatagcttcatgactcctgggctgttggataaatttgctttcagcatcatctggctgtaccttttgtccttagcagg

SEQ ID NO: 159217 - DNA, 2267 bp, Homo sapiens
gagcctcttctctctaagtcacgggaactgcccttgctacttgtgacctgccctttactcagcagtttttgttctgggaagccctgggattctgctaatacctatcactgtaggtgctgaagggaaacagatgaagaacatgacctcaaggagcttcctgtcaatgagaagaccaagctgacgcctggcaaagatattaaagaggagcctgaaactgttccttggacatcttatgaatgtcagaaaataccttttggagggttagaagatcaggggacatggttgttcacatttgctgccacggaacaccgccagtcttcacttggaaacagaatcacgccttgtgaagagatcatccctaagcaggagagaagctactaaaggattgtgtcctcctccaccttccctgtgctcggtctccacctgtctcccattctgtgacgatggttcaatggaagagactctgccagctgcattacttgtgggctctgggctgctatatgctgctggccactgtggctctgaaactttctttcaggttgaagtgtgactctgaccacttgggtctggagtccagggaatctcaaagccagtactgtaggaatatcttgtataatttcctgaaacttccagcaaagaggtctatcaactgttcaggggtcacccgaggggaccaagaggcagtgcttcaggctattctgaataacctggaggtcaagaagaagcgagagcctttcacagacacccactacctctccctcaccagagactgtgagcacttcaaggctgaaaggaagttcatacagttcccactgagcaaagaagaggtggagttccctattgcatactctatggtgattcatgagaagattgaaaactttgaaaggctactgcgagctgtgtatgcccctcagaacatatactgtgtccatgtggatgagaagtccccagaaactttcaaagaggcggtcaaagcaattatttcttgcttcccaaatgtcttcatagccagtaagctggttcgggtggtttatgcctcctggtccagggtgcaagctgacctcaactgcatggaagacttgctccagagctcagtgccgtggaaatacttcctgaatacatgtgggacggactttcctataaagagcaatgcagagatggtccaggctctcaagatgttgaatgggaggaatagcatggagtcagaggtacctcctaagcacaaagaaacccgctggaaatatcactttgaggtagtgagagacacattacacctaaccaacaagaagaaggatcctcccccttataatttaactatgtttacagggaatgcgtacattgtggcttcccgagatttcgtccaacatgttttgaagaaccctaaatcccaacaactgattgaatgggtaaaagacacttatagcccagatgaacacctctgggccacccttcagcgtgcacggtggatgcctggctctgttcccaaccaccccaagtacgacatctcagacatgacttctattgccaggctggtcaagtggcagggtcatgagggagacatcgataagggtgctccttatgctccctgctctggaatccaccagcgggctatctgcgtttatggggctggggacttgaattggatgcttcaaaaccatcacctgttggccaacaagtttgacccaaaggtagatgataatgctcttcagtgcttagaagaatacctacgttataaggccatctatgggactgaactttgagacacactatgagagcgttgctacctgtggggcaagagcatgtacaaacatgctcagaacttgctgggacagtgtgggtgggagaccagggctttgcaattcgtggcatcctttaggataagagggctgctattagattgtgggtaagtagatcttttgccttgcaaattgctgcctgggtgaatgctgcttgttctctcacccctaaccctagtagttcctccactaactttctcactaagtgagaatgagaactgctgtgatagggagagtgaaggagggatatgtggtagagcacttgatttcagttgaatgcctgctggtagcttttccattctgtggagctgccgttcctaataattccaggtttggtagcgtggaggagaactttgatggaaagagaaccttcccttctgtactgttaacttaaaaataaatagctcctgattcaaagtattacctctactttttgcctagtatgccagaaataatataaatctaaacaga

SEQ ID NO: 159218 - DNA, 2455 bp, Homo sapiens
tgcctctcaagggctggggctgcaaaacatctcagagtttgactctttgcttcgacactaccgtctgcaagttcttgtgctagccgctgtgggaaagacacagctgagtcagacatgatccctgccctcaaggagcttgtgacaccacagtgaagacaagtctattttggtgctgaagggaaacagatgaagaacatgacctcaaggagcttcctgtcaatgagaagaccaagctgacgcctggcaaagatattaaagaggagcctgaaactgttccttggacatcttatgaatgtcagaaaataccttttggagggttagaagatcaggggacatggttgttcacatttgctgccacggaacaccgccagtcttcacttggaaacagaatcacgccttgtgaagagatcatccctaagcaggagagaagctactaaaggattgtgtcctcctccaccttccctgtgctcggtctccacctgtctcccattctgtgacgatggttcaatggaagagactctgccagctgcattacttgtgggctctgggctgctatatgctgctggccactgtggctctgaaactttctttcaggttgaagtgtgactctgaccacttgggtctggagtccagggaatctcaaagccagtactgtaggaatatcttgtataatttcctgaaacttccagcaaagaggtctatcaactgttcaggggtcacccgaggggaccaagaggcagtgcttcaggctattctgaataacctggaggtcaagaagaagcgagagcctttcacagacacccactacctctccctcaccagagactgtgagcacttcaaggctgaaaggaagttcatacagttcccactgagcaaagaagaggtggagttccctattgcatactctatggtgattcatgagaagattgaaaactttgaaaggctactgcgagctgtgtatgcccctcagaacatatactgtgtccatgtggatgagaagtccccagaaactttcaaagaggcggtcaaagcaattatttcttgcttcccaaatgtcttcatagccagtaagctggttcgggtggtttatgcctcctggtccagggtgcaagctgacctcaactgcatggaagacttgctccagagctcagtgccgtggaaatacttcctgaatacatgtgggacggactttcctataaagagcaatgcagagatggtccaggctctcaagatgttgaatgggaggaatagcatggagtcagaggtacctcctaagcacaaagaaacccgctggaaatatcactttgaggtagtgagagacacattacacctaaccaacaagaagaaggatcctcccccttataatttaactatgtttacagggaatgcgtacattgtggcttcccgagatttcgtccaacatgttttgaagaaccctaaatcccaacaactgattgaatgggtaaaagacacttatagcccagatgaacacctctgggccacccttcagcgtgcacggtggatgcctggctctgttcccaaccaccccaagtacgacatctcagacatgacttctattgccaggctggtcaagtggcagggtcatgagggagacatcgataagggtgctccttatgctccctgctctggaatccaccagcgggctatctgcgtttatggggctggggacttgaattggatgcttcaaaaccatcacctgttggccaacaagtttgacccaaaggtagatgataatgctcttcagtgcttagaagaatacctacgttataaggccatctatgggactgaactttgagacacactatgagagcgttgctacctgtggggcaagagcatgtacaaacatgctcagaacttgctgggacagtgtgggtgggagaccagggctttgcaattcgtggcatcctttaggataagagggctgctattagattgtgggtaagtagatcttttgccttgcaaattgctgcctgggtgaatgctgcttgttctctcacccctaaccctagtagttcctccactaactttctcactaagtgagaatgagaactgctgtgatagggagagtgaaggagggatatgtggtagagcacttgatttcagttgaatgcctgctggtagcttttccattctgtggagctgccgttcctaataattccaggtttggtagcgtggaggagaactttgatggaaagagaaccttcccttctgtactgttaacttaaaaataaatagctcctgattcaaaaaaaaaaaaagggggggtctagagttcctgggggcaagttagcgtccagttttgtacaagggccaaagggaggatatagagatgggggttaaagtggagggaaagtagtgatttggaggaccttttggggggctttggcaccaaaggtagtagaataataggttggaaggctggggatggcgagat

SEQ ID NO: 159219 - DNA, 2222 bp, Homo sapiens
gagcctcttctctctaagtcacgggaactgcccttgctacttgtgacctgccctttactcagcagtttttgttctgggaagccctgggattctgctaatacctatcactgtaggtgctgaagggaaacagatgaagaacatgacctcaaggagcttcctgtcaatgagaagaccaagctgacgcctggcaaagatattaaagaggagcctgaaactgttccttggacatcttatgaatgtcagaaaataccttttggagggttagaagatcaggggacatggttgttcacatttgctgccacggaacaccgccagtcttcacttggaaacagaatcacgccttgtgaagagatcatccctaagcaggagagaagctactaaaggattgtgtcctcctccaccttccctgtgctcggtctccacctgtctcccattctgtgacgatggttcaatggaagagactctgccagctgcattacttgtgggctctgggctgctatatgctgctggccactgtggctctgaataacctggaggtcaagaagaagcgagagcctttcacagacacccactacctctccctcaccagagactgtgagcacttcaaggctgaaaggaagttcatacagttcccactgagcaaagaagaggtggagttccctattgcatactctatggtgattcatgagaagattgaaaactttgaaaggctactgcgagctgtgtatgcccctcagaacatatactgtgtccatgtggatgagaagtccccagaaactttcaaagaggcggtcaaagcaattatttcttgcttcccaaatgtcttcatagccagtaagctggttcgggtggtttatgcctcctggtccagggtgcaagctgacctcaactgcatggaagacttgctccagagctcagtgccgtggaaatacttcctgaatacatgtgggacggactttcctataaagagcaatgcagagatggtccaggctctcaagatgttgaatgggaggaatagcatggagtcagaggtacctcctaagcacaaagaaacccgctggaaatatcactttgaggtagtgagagacacattacacctaaccaacaagaagaaggatcctcccccttataatttaactatgtttacagggaatgcgtacattgtggcttcccgagatttcgtccaacatgttttgaagaaccctaaatcccaacaactgattgaatgggtaaaagacacttatagcccagatgaacacctctgggccacccttcagcgtgcacggtggatgcctggctctgttcccaaccaccccaagtacgacatctcagacatgacttctattgccaggctggtcaagtggcagggtcatgagggagacatcgataagggtgctccttatgctccctgctctggaatccaccagcgggctatctgcgtttatggggctggggacttgaattggatgcttcaaaaccatcacctgttggccaacaagtttgacccaaaggtagatgataatgctcttcagtgcttagaagaatacctacgttataaggccatctatgggactgaactttgagacacactatgagagcgttgctacctgtggggcaagagcatgtacaaacatgctcagaacttgctgggacagtgtgggtgggagaccagggctttgcaattcgtggcatcctttaggataagagggctgctattagattgtgggtaagtagatcttttgccttgcaaattgctgcctgggtgaatgctgcttgttctctcacccctaaccctagtagttcctccactaactttctcactaagtgagaatgagaactgctgtgatagggagagtgaaggagggatatgtggtagagcacttgatttcagttgaatgcctgctggtagcttttccattctgtggagctgccgttcctaataattccaggtttggtagcgtggaggagaactttgatggaaagagaaccttcccttctgtactgttaacttaaaaataaatagctcctgattcaaaaaaaaaaaaagggggggtctagagttcctgggggcaagttagcgtccagttttgtacaagggccaaagggaggatatagagatgggggttaaagtggagggaaagtagtgatttggaggaccttttggggggctttggcaccaaaggtagtagaataataggttggaaggctggggatggcgagat

SEQ ID NO: 159220 - DNA, 1546 bp, Homo sapiens
tgctgctgctgctgaatcttctccatttgttgagcgacttctgttaaagggctatgaagttatttacctcacagaacctgtggatgagaagtccccagaaactttcaaagaggcggtcaaagcaattatttcttgcttcccaaatgtcttcatagccagtaagctggttcgggtggtttatgcctcctggtccagggtgcaagctgacctcaactgcatggaagacttgctccagagctcagtgccgtggaaatacttcctgaatacatgtgggacggactttcctataaagagcaatgcagagatggtccaggctctcaagatgttgaatgggaggaatagcatggagtcagaggtacctcctaagcacaaagaaacccgctggaaatatcactttgaggtagtgagagacacattacacctaaccaacaagaagaaggatcctcccccttataatttaactatgtttacagggaatgcgtacattgtggcttcccgagatttcgtccaacatgttttgaagaaccctaaatcccaacaactgattgaatgggtaaaagacacttatagcccagatgaacacctctgggccacccttcagcgtgcacggtggatgcctggctctgttcccaaccaccccaagtacgacatctcagacatgacttctattgccaggctggtcaagtggcagggtcatgagggagacatcgataagggtgctccttatgctccctgctctggaatccaccagcgggctatctgcgtttatggggctggggacttgaattggatgcttcaaaaccatcacctgttggccaacaagtttgacccaaaggtagatgataatgctcttcagtgcttagaagaatacctacgttataaggccatctatgggactgaactttgagacacactatgagagcgttgctacctgtggggcaagagcatgtacaaacatgctcagaacttgctgggacagtgtgggtgggagaccagggctttgcaattcgtggcatcctttaggataagagggctgctattagattgtgggtaagtagatcttttgccttgcaaattgctgcctgggtgaatgctgcttgttctctcacccctaaccctagtagttcctccactaactttctcactaagtgagaatgagaactgctgtgatagggagagtgaaggagggatatgtggtagagcacttgatttcagttgaatgcctgctggtagcttttccattctgtggagctgccgttcctaataattccaggtttggtagcgtggaggagaactttgatggaaagagaaccttcccttctgtactgttaacttaaaaataaatagctcctgattcaaaaaaaaaaaaagggggggtctagagttcctgggggcaagttagcgtccagttttgtacaagggccaaagggaggatatagagatgggggttaaagtggagggaaagtagtgatttggaggaccttttggggggctttggcaccaaaggtagtagaataataggttggaaggctggggatggcgagat

SEQ ID NO: 159221 - DNA, 2399 bp, Homo sapiens
gagcctcttctctctaagtcacgggaactgcccttgctacttgtgacctgccctttactcagcagtttttgttctgggaagccctgggattctgctaatacctatcactgtaggtgctgaagggaaacagatgaagaacatgacctcaaggagcttcctgtcaatgagaagaccaagctgacgcctggcaaagatattaaagaggagcctgaaactgttccttggacatcttatgaatgtcagaaaataccttttggagggttagaagatcaggggacatggttgttcacatttgctgccacggaacaccgccagtcttcacttggaaacagaatcacgccttgtgaagagatcatccctaagcaggagagaagctactaaaggattgtgtcctcctccaccttccctgtgctcggtctccacctgtctcccattctgtgacgatggttcaatggaagagactctgccagctgcattacttgtgggctctgggctgctatatgctgctggccactgtggctctgaaactttctttcaggttgaagtgtgactctgaccacttgggtctggagtccagggaatctcaaagccagtactgtaggaatatcttgtataatttcctgaaacttccagcaaagaggtctatcaactgttcaggggtcacccgaggggaccaagaggcagtgcttcaggctattctgaataacctggaggtcaagaagaagcgagagcctttcacagacacccactacctctccctcaccagagactgtgagcacttcaaggctgaaaggaagttcatacagttcccactgagcaaagaagaggtggagttccctattgcatactctatggtgattcatgagaagattgaaaactttgaaaggctactgcgagctgtgtatgcccctcagaacatatactgtgtccatgtggatgagaagtccccagaaactttcaaagaggcggtcaaagcaattatttcttgcttcccaaatgtcttcatagccagtaagctggttcgggtggtttatgcctcctggtccagggtgcaagctgacctcaactgcatggaagacttgctccagagctcagtgccgtggaaatacttcctgaatacatgtgggacggactttcctataaagagcaatgcagagatggtccaggctctcaagatgttgaatgggaggaatagcatggagtcagaggtacctcctaagcacaaagaaacccgctggaaatatcactttgaggtagtgagagacacattacacctaaccaacaagaagaaggatcctcccccttataatttaactatgtttacagggaatgcgtacattgtggcttcccgagatttcgtccaacatgttttgaagaaccctaaatcccaacaactgattgaatgggtaaaagacacttatagcccagatgaacacctctgggccacccttcagcgtgcacggtggatgcctggctctgttcccaaccaccccaagtacgacatctcagacatgacttctattgccaggctggtcaagtggcagggtcatgagggagacatcgataagggtgctccttatgctccctgctctggaatccaccagcgggctatctgcgtttatggggctggggacttgaattggatgcttcaaaaccatcacctgttggccaacaagtttgacccaaaggtagatgataatgctcttcagtgcttagaagaatacctacgttataaggccatctatgggactgaactttgagacacactatgagagcgttgctacctgtggggcaagagcatgtacaaacatgctcagaacttgctgggacagtgtgggtgggagaccagggctttgcaattcgtggcatcctttaggataagagggctgctattagattgtgggtaagtagatcttttgccttgcaaattgctgcctgggtgaatgctgcttgttctctcacccctaaccctagtagttcctccactaactttctcactaagtgagaatgagaactgctgtgatagggagagtgaaggagggatatgtggtagagcacttgatttcagttgaatgcctgctggtagcttttccattctgtggagctgccgttcctaataattccaggtttggtagcgtggaggagaactttgatggaaagagaaccttcccttctgtactgttaacttaaaaataaatagctcctgattcaaaaaaaaaaaaagggggggtctagagttcctgggggcaagttagcgtccagttttgtacaagggccaaagggaggatatagagatgggggttaaagtggagggaaagtagtgatttggaggaccttttggggggctttggcaccaaaggtagtagaataataggttggaaggctggggatggcgagat

SEQ ID NO: 159222 - DNA, 2466 bp, Homo sapiens
ctgtgtggctttacttgtggagcagacaacaggcattttatataagagtttgactctttgcttcgacactaccgtctgcaagttcttgtgctagccgctgtgggaaagacacagctgagtcagacatgatccctgccctcaaggagcttgtgacaccacagtgaagacaagtctattttggtgctgaagggaaacagatgaagaacatgacctcaaggagcttcctgtcaatgagaagaccaagctgacgcctggcaaagatattaaagaggagcctgaaactgttccttggacatcttatgaatgtcagaaaataccttttggagggttagaagatcaggggacatggttgttcacatttgctgccacggaacaccgccagtcttcacttggaaacagaatcacgccttgtgaagagatcatccctaagcaggagagaagctactaaaggattgtgtcctcctccaccttccctgtgctcggtctccacctgtctcccattctgtgacgatggttcaatggaagagactctgccagctgcattacttgtgggctctgggctgctatatgctgctggccactgtggctctgaaactttctttcaggttgaagtgtgactctgaccacttgggtctggagtccagggaatctcaaagccagtactgtaggaatatcttgtataatttcctgaaacttccagcaaagaggtctatcaactgttcaggggtcacccgaggggaccaagaggcagtgcttcaggctattctgaataacctggaggtcaagaagaagcgagagcctttcacagacacccactacctctccctcaccagagactgtgagcacttcaaggctgaaaggaagttcatacagttcccactgagcaaagaagaggtggagttccctattgcatactctatggtgattcatgagaagattgaaaactttgaaaggctactgcgagctgtgtatgcccctcagaacatatactgtgtccatgtggatgagaagtccccagaaactttcaaagaggcggtcaaagcaattatttcttgcttcccaaatgtcttcatagccagtaagctggttcgggtggtttatgcctcctggtccagggtgcaagctgacctcaactgcatggaagacttgctccagagctcagtgccgtggaaatacttcctgaatacatgtgggacggactttcctataaagagcaatgcagagatggtccaggctctcaagatgttgaatgggaggaatagcatggagtcagaggtacctcctaagcacaaagaaacccgctggaaatatcactttgaggtagtgagagacacattacacctaaccaacaagaagaaggatcctcccccttataatttaactatgtttacagggaatgcgtacattgtggcttcccgagatttcgtccaacatgttttgaagaaccctaaatcccaacaactgattgaatgggtaaaagacacttatagcccagatgaacacctctgggccacccttcagcgtgcacggtggatgcctggctctgttcccaaccaccccaagtacgacatctcagacatgacttctattgccaggctggtcaagtggcagggtcatgagggagacatcgataagggtgctccttatgctccctgctctggaatccaccagcgggctatctgcgtttatggggctggggacttgaattggatgcttcaaaaccatcacctgttggccaacaagtttgacccaaaggtagatgataatgctcttcagtgcttagaagaatacctacgttataaggccatctatgggactgaactttgagacacactatgagagcgttgctacctgtggggcaagagcatgtacaaacatgctcagaacttgctgggacagtgtgggtgggagaccagggctttgcaattcgtggcatcctttaggataagagggctgctattagattgtgggtaagtagatcttttgccttgcaaattgctgcctgggtgaatgctgcttgttctctcacccctaaccctagtagttcctccactaactttctcactaagtgagaatgagaactgctgtgatagggagagtgaaggagggatatgtggtagagcacttgatttcagttgaatgcctgctggtagcttttccattctgtggagctgccgttcctaataattccaggtttggtagcgtggaggagaactttgatggaaagagaaccttcccttctgtactgttaacttaaaaataaatagctcctgattcaaaaaaaaaaaaagggggggtctagagttcctgggggcaagttagcgtccagttttgtacaagggccaaagggaggatatagagatgggggttaaagtggagggaaagtagtgatttggaggaccttttggggggctttggcaccaaaggtagtagaataataggttggaaggctggggatggcgagat

SEQ ID NO: 159223 - DNA, 2062 bp, Homo sapiens
tacggctcggtaccgaagcatcctaaccaggagagaagctctaaaggattgtgtcctcctccaccttccctgtgctcggtctccacctgtctcccattctgtgacgatggttcaatggaagagactctgccagctgcattacttgtgggctctgggctgctatatgctgctggccactgtggctctgaaactttctttcaggttgaagtgtgactctgaccacttgggtctggagtccagggaatctcaaagccagtactgtaggaatatcttgtataatttcctgaaacttccagcaaagaggtctatcaactgttcaggggtcacccgaggggaccaagaggcagtgcttcaggctattctgaataacctggaggtcaagaagaagcgagagcctttcacagacacccactacctctccctcaccagagactgtgagcacttcaaggctgaaaggaagttcatacagttcccactgagcaaagaagaggtggagttccctattgcatactctatggtgattcatgagaagattgaaaactttgaaaggctactgcgagctgtgtatgcccctcagaacatatactgtgtccatgtggatgagaagtccccagaaactttcaaagaggcggtcaaagcaattatttcttgcttcccaaatgtcttcatagccagtaagctggttcgggtggtttatgcctcctggtccagggtgcaagctgacctcaactgcatggaagacttgctccagagctcagtgccgtggaaatacttcctgaatacatgtgggacggactttcctataaagagcaatgcagagatggtccaggctctcaagatgttgaatgggaggaatagcatggagtcagaggtacctcctaagcacaaagaaacccgctggaaatatcactttgaggtagtgagagacacattacacctaaccaacaagaagaaggatcctcccccttataatttaactatgtttacagggaatgcgtacattgtggcttcccgagatttcgtccaacatgttttgaagaaccctaaatcccaacaactgattgaatgggtaaaagacacttatagcccagatgaacacctctgggccacccttcagcgtgcacggtggatgcctggctctgttcccaaccaccccaagtacgacatctcagacatgacttctattgccaggctggtcaagtggcagggtcatgagggagacatcgataagggtgctccttatgctccctgctctggaatccaccagcgggctatctgcgtttatggggctggggacttgaattggatgcttcaaaaccatcacctgttggccaacaagtttgacccaaaggtagatgataatgctcttcagtgcttagaagaatacctacgttataaggccatctatgggactgaactttgagacacactatgagagcgttgctacctgtggggcaagagcatgtacaaacatgctcagaacttgctgggacagtgtgggtgggagaccagggctttgcaattcgtggcatcctttaggataagagggctgctattagattgtgggtaagtagatcttttgccttgcaaattgctgcctgggtgaatgctgcttgttctctcacccctaaccctagtagttcctccactaactttctcactaagtgagaatgagaactgctgtgatagggagagtgaaggagggatatgtggtagagcacttgatttcagttgaatgcctgctggtagcttttccattctgtggagctgccgttcctaataattccaggtttggtagcgtggaggagaactttgatggaaagagaaccttcccttctgtactgttaacttaaaaataaatagctcctgattcaaaaaaaaaaaaagggggggtctagagttcctgggggcaagttagcgtccagttttgtacaagggccaaagggaggatatagagatgggggttaaagtggagggaaagtagtgatttggaggaccttttggggggctttggcaccaaaggtagtagaataataggttggaaggctggggatggcgagat

SEQ ID NO: 159224 - DNA, 1787 bp, Homo sapiens
ccggtgtttcctttgtctcttctgaaaacaggctttttggttatttgaatcaaaaaatctgccacatgagattcatcttgttctaatattggtttctgaagatgacttctttgtactgtttacaacaacttggttttggggatttttcataatacagttctttggcaacaaatatttcctttttttttgagatggagtctcactctgtcgcccaggctggagtgcagtggcgcgatcttggctcactgcggcctccgcctcctgggttcaagtaattctcctgcctcagcctccctggcagctggggctacaggcatacaccaccacgctcggctaattcttttgtatttttagtagacaaagggaaacaccggtgtttcccaaatgtcttcatagccagtaagctggttcgggtggtttatgcctcctggtccagggtgcaagctgacctcaactgcatggaagacttgctccagagctcagtgccgtggaaatacttcctgaatacatgtgggacggactttcctataaagagcaatgcagagatggtccaggctctcaagatgttgaatgggaggaatagcatggagtcagaggtacctcctaagcacaaagaaacccgctggaaatatcactttgaggtagtgagagacacattacacctaaccaacaagaagaaggatcctcccccttataatttaactatgtttacagggaatgcgtacattgtggcttcccgagatttcgtccaacatgttttgaagaaccctaaatcccaacaactgattgaatgggtaaaagacacttatagcccagatgaacacctctgggccacccttcagcgtgcacggtggatgcctggctctgttcccaaccaccccaagtacgacatctcagacatgacttctattgccaggctggtcaagtggcagggtcatgagggagacatcgataagggtgctccttatgctccctgctctggaatccaccagcgggctatctgcgtttatggggctggggacttgaattggatgcttcaaaaccatcacctgttggccaacaagtttgacccaaaggtagatgataatgctcttcagtgcttagaagaatacctacgttataaggccatctatgggactgaactttgagacacactatgagagcgttgctacctgtggggcaagagcatgtacaaacatgctcagaacttgctgggacagtgtgggtgggagaccagggctttgcaattcgtggcatcctttaggataagagggctgctattagattgtgggtaagtagatcttttgccttgcaaattgctgcctgggtgaatgctgcttgttctctcacccctaaccctagtagttcctccactaactttctcactaagtgagaatgagaactgctgtgatagggagagtgaaggagggatatgtggtagagcacttgatttcagttgaatgcctgctggtagcttttccattctgtggagctgccgttcctaataattccaggtttggtagcgtggaggagaactttgatggaaagagaaccttcccttctgtactgttaacttaaaaataaatagctcctgattcaaaaaaaaaaaaagggggggtctagagttcctgggggcaagttagcgtccagttttgtacaagggccaaagggaggatatagagatgggggttaaagtggagggaaagtagtgatttggaggaccttttggggggctttggcaccaaaggtagtagaataataggttggaaggctggggatggcgagat

SEQ ID NO: 159225 - DNA, 364 bp, Homo sapiens
acggactctgctggggcacactccctcgacactggttccaaggtgaagacaggactggctggatcagtatttctcaacttcctgggaacgggggataagggaggaggggacagagctgtctctcctgcccatctgcaggaaatagtgtctctcaggtctccacgtcaacagaccagagccaggggcagtgccttcactggcagatgggcccagtggctaagcccaggctccagaaggggtggtgaccccaccctcagagtggaggccaaagcaggtgaacttcctctaagcacacaacgatgacgagctaaagctggtttgcgccctaatcaatgcagtgtccctccgagctcctggcctaatg

SEQ ID NO: 159226 - DNA, 262 bp, Homo sapiens
tacatggccggccctcactcccagcagctgggcccctgcctgctgtctgctgccattagagcccacagctgggctgcgactgctcagaccagccagctggagggaggggctcagcagctctgggtttggccctgagagagtagttggattttaggctggccattgctgtatcaggacccaatcaattggcctagacgggatctctcagccttacaagccctctccaggtggtaggtacagagtggagagaggctgagttttg

SEQ ID NO: 159227 - DNA, 207 bp, Homo sapiens
gctcgtgaatctaagtgctccccttctttgctctcctgttccccaggccctcagagagccagcctcctggatgccccccagacacagtgggtgccatggagccagtgcctctccctcactctgctgtcctggagcctggctccctgtggtaagccaggcttgcagaggtggctcctgacatcaatccgcgggcatgtggctgctgcg

SEQ ID NO: 159228 - DNA, 474 bp, Homo sapiens
ctcgaaacatcatcggatttcattctcagaccaaccctaaaggtgctggtgttaactccccattttaaagataagaaccagccgctcaaccaggataagggacttgccctactgcggataagcagcagcttcggcctgactccagatcccaacgttgtggaagccggaacgccccgagaacaggcggagagcggagggagcaccgcagggcgccggccagggtgggggcacccccaggcctccaggaggtcgcgcgtcccgggcgagagcggacgagccgtcagcaccagggacagctccccaggccgctcccggcatcccccgacgactgcgcgcgcgggccggtgacgcgcgctccccgccaggctcgggcgcgcgccctccccgccagcgcgcgccctgcgctcgggaccaggctggagccgcgcgtgcagctcgcagggagccagccggggcgtccggagtcgcggccgc

SEQ ID NO: 159229 - DNA, 343 bp, Homo sapiens
agaggctgatgtgtggtcgacgggcttagcgacttgatggcgtaacccccgttcttcccccacaggactcaggagagtgcagcttgctctgtgagtgggtgacaacctcttggcgactcaggctcagctgaggatggtgccagtgtgccggagacagccgtcatactgccggatagagtggctcacttgcatgtatttggaacaaaaaaaggagatgcctggcagccccgctctctgcagtaagtattcatctgcattcttttacattcctttatttcttcgaacatcagaaatgggtagatgtttattgagcccagccacctgctatgccttctccattctt

SEQ ID NO: 159230 - DNA, 168 bp, Homo sapiens
attgcaacttgaatccctaggaatcggtgaggagaaccaaaatggtaataagagggtaaatataaaaactccataaatgtatacttgctcttcattccttttctcagtttctctaacataaaattatttaaagtaacaattagaacaagtattgttgggcttttaaca

SEQ ID NO: 159231 - DNA, 540 bp, Homo sapiens
gccccctgtgggtagggcttataaacaggaaagtcacattacgtagctgtggggatcagctttatgttccaatcaccccagagggaagggaccaggcatgagagaagagccacatcacatagaagctacgtcaagcgatatatcacaattctcactgaggacaaaccctggaagaggagagtcatatcatctaggtgatgggcccaaatatatagcacagtgactcctgtgtgcagggaacaggcagaataattacatcactggtgtgcttggcccaggcagaagaggagtgtcacatcacataggtaaaatagggcatttacctgggctttgtccataggagagattgcagtgggtcaagaaatatgtcacaatgctccctgtggtcagggttcaggcagaggactcacatcatcttggtgctgggcccagcagtgtgtctcaatgccttctaaggacatagccaaagcagagaagtaacatcaccttagtgttaggcccagcagtatgccacaatctcctttgtgggcagaacctagg

SEQ ID NO: 159232 - DNA, 152 bp, Homo sapiens
ctgtactccagcctgggcgacagagcaagactctgtctaaaaaaattaaaattaaaaagaagaaaaggagaaataaagtgatattataatttgttcattgggatgaatgtgtatattaaaacattttttaaaaacttcatgatacttttagg

SEQ ID NO: 159233 - DNA, 631 bp, Homo sapiens
atacatgatgtaatatttatcattttaaacatttgtaagtgtacaatcaaatacattcacagtgttgtgtaatcatcaccattatctatatccaaaactttttcatcatccctgacagaaattttgttcccattaaatagcagttcttcattcccttctctgtactagtcccttgtcgccaggattctacattgtttctgtgaatttgactcttctaggtacctcatgtcagtggaatcacaccatatttgtcctttcgtgtctggcttatttcagttaccctaatgttgtcaaggtccatccatgttgtaacatacaggcctatccctttttcttgtgctttgctttattgcactttgcagatgttgcattttttacaaattggggtttgtggcaaccctatgtggagcaagcctatcagcatcattttcccaacagcgtgtggtcacttcatgtctctgtgtcaaagcttggtaattctcacaatatttcaaatgttttcgttattattatatctgttatggtgatttgtaatcagagatctttgatgttactattgtaattgttttggggtaccactaaacacacccatataagactgcaaaaggaatcaataaatgttgtgtgtgtc

SEQ ID NO: 159234 - DNA, 475 bp, Homo sapiens
gaacctgagcaggaaggcatgacaataaggaccgtgtgtgcagcccctgaggcttggtagggcctaggagtgttctgggtgggctgatggaggaacaatgatccctgggaaggaagcttctgatactcagcacatggtacagggcctggctctgcattctttctgtcattgctgaatgaatgagaagatgaatgcatcacagtctcaaggtttaaccccacaggttaatgattcgttacaaaggaaacgagatacccatataacggtgaggtctggcggacaccactttaaccatcatggctatgcttagcatcaccaatgacaggacaaactcttatcaggtgaacctgaagtgatgcactgggaagggcacagcatcgcctacatggttacatcacctacatacatgtcctgccccagaggtccaatctgaatctaatcatgagaaagcaatcagaaaaataaaaagtgaagg

SEQ ID NO: 159235 - DNA, 1964 bp, Homo sapiens
  misc_feature (1955)..(1959): n is a, c, g, or t
  misc_feature (1961)..(1964): n is a, c, g, or t
agagtaacaggcaggaagaaagctttctgtactacaccagagggttggggctgtggatttagctactctcacctgaggctactgagcaagttgtcatgcaccatgagacaaagcccaagctgtcccaccaggcagtaagtatggagaggttcaggcacatggcatagctgctatttcgcacaattttcactacaccagtggtgacaaaatagaagaggttcatccatacacagaacctggtgaagagctggaggcagaaagaagtgtctatgtggagacgcaactgaaacaaaggtggcacagcaactgttccaatcccgtgtctttcctcatggcttcccaggagtttgaggttgaagctattgttgacaaaagacaggataaaaatgggaatacacagtatttggttcggtggaaaggttatgacaaacaggatgacacttgggaaccagagcagcacctcatgaactgtgaaaaatgtgtacatgattttaatagacgacagactgaaaaacagaaaaaactgacatggactacaaccagtagaattttttcaaacaatgccagaagaagaacttccagatctacaaaagcaaactattctaagaactctcctaaaacgccagtgactgataaacaccacaggtccaaaaaccgcaagttatttgctgccagcaagaacgttaggagaaaggcagcttcaattctctccgacacaaagaatatggagataataaattcaactattgagacccttgcacctgacagcccctttgaccacaaaactgtgagtggctttcagaaacttgagaaactggaccctattgcagcagatcagcaggacacggtggtcttcaaggtgacagaagggaaactcctccgggaccctttgtcacgtcctggtgcagaacagactggaatacagaacaagactcagatacacccactaatgtcgcagatgtctggctcagttactgcttctatggccacaggttcagctacccgaaagggtatagtggtattaatagacccattagcagccaatgggacaacagacatgcatacctcagttccaagagtgaaaggtgggcaaagaaatattactgatgacagcagagaccagccttttatcaagaagatgcacttcaccataaggctaacagaaagtgccagcacatacagagacattgtagtgaagaaagaggatggattcacccagatagtgctatcaactagatcgacagaaaaaaatgcactgaatacagaagtaattaaagaaatagttaatgctctgaatagcgctgctgcagatgacagcaagctcgtgctgttcagtgcagctggaagtgtcttttgctgcggtcttgattttgggtactttgtgaagcacttaaggaataacagaaacacagcaagccttgaaatggtggacaccatcaagaactttgtgaatacttttattcaatttaaaaagcctattgttgtatcagtcaatggccctgcgattggactaggtgcatccatcctgcctctttgtgatctcgtgtgggctaatgaaaaggcttggttccaaaccccttatacgacctttggacagagtccagatggctgttcttctattacattccccaaaatgatgggtaaagcatctgccaatgaaatgttaattgctgggcgaaagctgacagcaagggaggcatgcgccaaaggcctggtctctcaggtatttttgactggaactttcacccaagaggttatgattcaaattaaggagcttgcctcatacaatccaattgtactggaagaatgtaaggccctcgttcgctgtaatattaagttggagttggaacaggccaatgagagagagtgtgaggtgctgaggaagatctggagctcagcccaagggatagaatccatgttaaagtatgttgaaaataaaattgatgagttttaannnnnannnn

SEQ ID NO: 159236 - DNA, 2378 bp, Homo sapiens
agagtaacaggcaggaagaaagctttctgtactacaccagagggttggggctgtggatttagctactctcacctgaggctactgagcaagttgtcatgcaccatgagacaaagcccaagctgtcccaccaggcagtaagtatggagaggttcaggcacatggcatagctgctatttcgcacaattttcactacaccagtggtgacaaaatagaagaggttcatccatacacagaacctggtgaagagctggaggcagaaagaagtgtctatgtggagacgcaactgaaacaaaggtggcacagcaactgttccaatcccgtgtctttcctcatggcttcccaggagtttgaggttgaagctattgttgacaaaagacaggataaaaatgggaatacacagtatttggttcggtggaaaggttatgacaaacaggatgacacttgggaaccagagcagcacctcatgaactgtgaaaaatgtgtacatgattttaatagacgacagactgaaaaacagaaaaaactgacatggactacaaccagtagaattttttcaaacaatgccagaagaagaacttccagatctacaaaagcaaactattctaagaactctcctaaaacgccagtgactgataaacaccacaggtccaaaaaccgcaagttatttgctgccagcaagaacgttaggagaaaggcagcttcaattctctccgacacaaagaatatggagataataaattcaactattgagacccttgcacctgacagcccctttgaccacaaaactgtgagtggctttcagaaacttgagaaactggaccctattgcagcagatcagcaggacacggtggtcttcaaggtgacagaagggaaactcctccgggaccctttgtcacgtcctggtgcagaacagactggaatacagaacaagactcagatacacccactaatgtcgcagatgtctggctcagttactgcttctatggccacaggttcagctacccgaaagggtatagtggtattaatagacccattagcagccaatgggacaacagacatgcatacctcagttccaagagtgaaaggtgggcaaagaaatattactgatgacagcagagaccagccttttatcaagaagatgcacttcaccataaggctaacagaaagtgccagcacatacagagacattgtagtgaagaaagaggatggattcacccagatagtgctatcaactagatcgacagaaaaaaatgcactgaatacagaagtaattaaagaaatagttaatgctctgaatagcgctgctgcagatgacagcaagctcgtgctgttcagtgcagctggaagtgtcttttgctgcggtcttgattttgggtactttgtgaagcacttaaggaataacagaaacacagcaagccttgaaatggtggacaccatcaagaactttgtgaatacttttattcaatttaaaaagcctattgttgtatcagtcaatggccctgcgattggactaggtgcatccatcctgcctctttgtgatctcgtgtgggctaatgaaaaggcttggttccaaaccccttatacgacctttggacagagtccagatggctgttcttctattacattccccaaaatgatgggtaaagcatctgccaatgaaatgttaattgctgggcgaaagctgacagcaagggaggcatgcgccaaaggcctggtctctcaggtatttttgactggaactttcacccaagaggttatgattcaaattaaggagcttgcctcatacaatccaattgtactggaagaatgtaaggccctcgttcgctgtaatattaagttggagttggaacaggccaatgagagagagtgtgaggtgctgaggaagatctggagctcagcccaagggatagaatccatgttaaaaatacctctgttgggatataaagcagccttccctcccagaaagacacagaatgatcagagatggtgcccttgactttatagtggcacaaacgcttcagagacacacaattataagagacttatcttttagcataaatacttatggctcaaaatccactgacgatcattctcctaaactgaacacatgactagaattggtggtgagatatcgcttgattttcttttcctttataaatgtctagttcttacccagttaacaaaagaaaactttatcgctctaaagtaaaacttgtaacaccacattagtgaattatggaatgattttggtggaaatatccaggttctaatgtgtggaatgtgcagatttaggttactttagtgtatgttctagttaataagttaaaattctggacacattattaaaggcagaaacttctttcaaagcaaaaaaaaaa

SEQ ID NO: 159237 - DNA, 379 bp, Homo sapiens
acaacagctccagttacaacagctccagttacaaccgctccagttacaacagctctttttgttttattcctctttcccctgaagctcatccttcaaaccaggctctttaatttaggacatgacggggtccacatattaggataagcacaacatattagctctgcaggagctgccagaaaggacagtagctattttgtgctttaggttttgaggagaagagaatttgacaaatggcccgtgtccttgggggataacaaagcagcaagtctagggtagccagagaggagaatgataaagacaaggggaacactgatattcagctttccaaaatctctcttcccatggagggaaaagaaacattgttcaagttgcaaatcct

SEQ ID NO: 159238 - DNA, 260 bp, Homo sapiens
caacaagtagttttttagtatgtctcaaatattgcattattcattgtttatctgacgttcatatttaactgggtgtcctgtacttttatttgctaaatctgacaaccctgtttggcaaatctgggtcacagggtatcaggccaactggaaaagacagttaaggaatgaaagataagtttagatgaaagggaagaggccaatggaggacgagttggactttattctgtagaaaatggggaacaactgaaggtgtcagtttt

SEQ ID NO: 159239 - DNA, 493 bp, Homo sapiens
ctcattttatagaaatgttcaaggttaaaaactgtgtcctatcatcaccccactacacaccaccctccacaatcccatctctacaaatgtgtcttctatttccaacagagaacgctggtttaggggagagaaaattcaggctgggggatcccaactcgaaaaggttgtctcaaattaatggtaaacaccacccacagagcagcctgacggaagaatcccatcttatcagttgtgaagcagcagattcagaaacttggtgtcaaagaagaatagactggaaggaatgtcaccttctctagctcaggagaaagtccctacatttttaggtggtagtaaaatgtcacaagtgcttgcaaagtggatgctgctagatttttctcttcaaactcccagtccattctggaggaacaaaggtgggtcaaagatctgacgattcatttgtttgtgaaggaggataaacaaggatgtgggggaaaggcatcttgcctggttg

SEQ ID NO: 159240 - DNA, 1385 bp, Homo sapiens
taactggttagagcttcccgtcctgctgtacatttcataatatttaatgagcacacttgtgcaacataagatgtaacatatgctgataccttcaacaaggaagaaataatgcttttgccgagctcagtaggacttttttgttgcctgtttattggatcattcatgtctttatgagtgtgcttgtcttaatatctttccagttattctgtaaaccaaatttagaaattatgtcaaagggacagtcagatggccagggcaatgaaatggcatgacacagccagttattgaaaataccttcaaattcttaagtttcaaagcttaagatgaacctatatatgtaaaaatctaataagaaattcagacagtaatacattagtttcatcatccaaaacaccaagaaagccataatttaggggtaattttgtttgccttttttttttaaattcgccacattttgaaagaactaaaggcattagtgtcataaaagaaaagtaatagatcagatgagctacttgaaaccacctatatttggaagattgaaataaaactttctaaattttaattagtatatttccaattcatgcattactaattaggaacaattacaaagagttgacaagaaaacagcctaattcttcactatgagtagagagatagtgggttaatttttgaaaagaaagatgaagtaccatatgtaatttaatattacttcccacaatccaagatctgcagctctatggttgagctccacttgtgtttcctccctggctccatccccacctccctgaacaataaggtagctgaacctcatccctacccctagcccatctccaattcttctccactggaaatttggcatgctctattagccctggatcgggggggaaaaagtgtaggatctcagtcaaaattttggcacgagggaacaaaaaaaataggggagtataggaaaacaactcattctaaaccaggaagtctagtatcaaacatttcaatatggaggaaaaaaaactagcactttggggggaaagctttttgggggaaaagcgatgatgaggcacaaaagaaaaagaaggaagacagaaaagggaatatgagccaggcgcagcagctcacgcctgtaatcccagcactttgaaagaccaaggcaggaagactgcttgagcccaagagtttgagaccagcctgcacaacatagtgagaccttgactctacaaaatattttttaaaaattagctggatgtggtagctcaagcctgtagtcccagctacttgggaggctgaggtaggaggatggcttgagcccaagaggtcgatgctgcagtgagccatgattgtgccactgcacctcagcctgagcaacagagtgagaccctatctcaaaa

SEQ ID NO: 159241 - DNA, 320 bp, Homo sapiens
ggtgcccagccattcatttacacaacacgatgcatcattattcaacacctgctgtggcagcttgggaatcaaggctgagagtgaggcatcagcacacacctgggggcagggccgggggtggagggagcctggatcatcgcaccctgacggtgtggccgaggcaagccccttcacctctgtgggactcatctatgaaatgagatcgatgctgtgctgctgtgcatcttgctgagacgtggtgagggtacagcaggaggaaggcgagctggtctgccctgcatctggctcacatcgggtccacagtgtttgtctcctgatga

SEQ ID NO: 159242 - DNA, 374 bp, Homo sapiens
aaaatatagaaaggaagtttgtttagtagagttgtatatgcctttcagtagtatttggaggttgttatatagctactgttatgttaaattgtttttaaagattgctttggtgagtaggagaaatctgtgcttctggccaatgaattgttgatccctcaatgaccactttttaatgtcaaatgataatattatataactagaaaatacaggctgatttgttggaagactgagacccctgtcaaggccacctgcaaagttctccactggcatggacggcgctctctaaacgcctacgtggcacgccagataatacatagctgattttcccattcattacattggagtagtgtggattttctgtcaaaccagatttt

SEQ ID NO: 159243 - DNA, 273 bp, Homo sapiens
tgatgcacatttgtccatttgtttcacaagttttctttgagtggtttccagccttaaaattgacatcactgaagttattgtgggtcaagccaccacaggctagtcatataaagacttatttatttatttatttatttttgagacggagtcttgctctatcacccaggctggagtgcagtggtgcgatctcagctcactgcaacctccacctcctgggttttaatcaattctctctgcctcagcctcccgagtagctgggattacaggcgctct

SEQ ID NO: 159244 - DNA, 594 bp, Homo sapiens
aatcggctcggcccgtgttctctttaaacacttgaaacatttttaagcaattgcaatgtgtcaggcacatcacgtatgcattttcttatttttcccggaacattatgaagtggagtctattcttgattgcatttcatagacaaggaaactcagacttcaagggtaactaggtaggacagccaagatgactagccttctgtccctccacctccgctagaaatcaaattacccgggaaggcaatgccaggtagtggtgggattaagtagcttttgctctgcttagagcagacaggatgccaggaatgaggactccttgaggtggaactcaagtggaagatgagtaaactatatcttagagctatattacagagcttcttggtattctgtttttattttccttttattatcccctatctttaaggcatcttaactatgtttctgtggaccaagagaagagcgggtgaattactcacacatgggccaaagtgatcaaaggagtgcatctctctattccaccccaagctagtttggtgttggcagcagttggcaggcttcctaaggtagagtggtttttttttttttttttttttttta

SEQ ID NO: 159245 - DNA, 308 bp, Homo sapiens
gatgggtaggggtggggggcagtggtgacagtgtatttatcaattgtttgtaaattgaatatttatacattgagagctaactgtattttgtttgaaaagtttcacctgcagttggaggatctgaaagatgtgattatggttgacctttcttccatgtctatgtttaatttccatctatgtttatgcatgtggatgcagggtaattctgaataatgctaatgatgaagggtcatcattacacagaagatcattctatgctcctaattaaaattatggctggaaattgcttccttatgtgtagctccaat

SEQ ID NO: 159246 - DNA, 604 bp, Homo sapiens
tcccaaagtgttggattacaggtgtgagccacctcacctggtctggtttgttctttccttttgttgctttgctctttggtgtcatatctaagaatccattgtttaacccaagaccacaaagatttatcctgtcttttcttgtaagagttttatagttttagctcttacatttaggtctttgaaatattttaagttaatttttgtatatggtgtgagggaagggtcctgcttcattcttttgcatgtggctatccagtcgtcccagcaccacattttgaaaagactgttctttccccattgaatggtcttggcacccttgttaaattaattggctgcagacacatgaatacatttgtagactcatctgttccattgatctaagtctgtccttagatcagcaccatactatattgattacagtagctttatagcagaaattgggaagtatgactgctctaacttcgctcctcttttttaatattgttttggctctcctgggtcccttgcgtttccatatgaatttttagcatcagctcgacaatgttggcaaagaaattaaccggaattttgatagagattgcattgagtctgtattaactgcttg

SEQ ID NO: 159247 - DNA, 399 bp, Homo sapiens
ctaggcagttacacaacacaatttatcttctcacagctctagatgctagaagtcagactgcagtgttggcagggttggtccttcagggccatgagggaaggatctattctaggcctctgtctttgacttgtagatggccattttctccctctgtcttcacatcatcttccctgtgtgtgtctgcatccgaatttcctcctcttctaaggacacctgtcatattaaattagggcccaccctgatgagctctttttaacttaattacctctttaaaggccctatctccaaatatagtcaaattctgaggcactggggggccaatccagatttttttggtcatccattttttttcttttctgttgtcttatctattatattttcctcttgtgtaaactgatt

SEQ ID NO: 159248 - DNA, 99 bp, Homo sapiens
agtgagtccgtaggatgaaggaagaagtggaggaaccagaaaggaaagagctcccttccaaaggccaataaatatcagctctggccaaggcagtctgct

SEQ ID NO: 159249 - DNA, 534 bp, Homo sapiens
  misc_feature (508)..(508): n is a, c, g, or t
gcccggcctgaacactgtgctccctgcaatgacctctttatgctcccggggggaggagcagggctcctgggttctagtttctggtgctgccaacccaccacgtgtccacctctgcctaatttgtggcctaaggccgtctgccctgctgtcaccatcagctggtatttttggacgtctctttctttcctgacatgagggtgggagtgtttggaaatagatccaggccaggagaatttaatcagcaatgtccctgtgtcccctgagcaactccctctcagtccccttgtctctgtgcctaagtcagagaggcagagctgtgtgtgtgagctgtgcacctttctagttgttatcaatggctccttctgtggtttttgcacctatcacttcccccacctcaagatgagaacaagactcagttctgtcccaggtcacaggggaggagaggaaacatgcatgtattatagcatgaaggattgaggttaaacaaggaagaacttcccacaggggnagatgccagctctggcttttgatggg

SEQ ID NO: 159250 - DNA, 430 bp, Homo sapiens
taacaccttgtttcatggaacccaaaactgaactacccctcaagatgggagtctgaacacatagatttatgctttaaatgtttttagggcatggtttaaactatgagtcaccagttaaaaccctttttgaatatgttttctgtttttaaaaaaagttgcctatttaagataactacttattcacaactcaaacagaggtaggcttcacttgaagcaatgacttatttaacatttttcatttgaattactagccacatcagaacactgatttgatatttctaaaggtattgagaggcaaaccatctttaattctgctttatgatgtggatattttgggaattgttaggaaaataatcaaccatttgcatatccaagacataattattacaaattctggatttttccccatcagtaacaaaagtccagtata

SEQ ID NO: 159251 - DNA, 246 bp, Homo sapiens
agtcatcagagggtgagaaagtgctcagaggatggcagttggggaactgtgtgaccgaggtcctgggccgacgccagcagagctcagcaagaatggcccagccagactctgggcctcactatatgacagcctagacttacgtgtaccccggacggcgtgcatgcctaaaaaacctaacctgagtctaatcgaggctttagctctgccagcctacaggaggcacaggggagtgacccgatttctcca

SEQ ID NO: 159252 - DNA, 560 bp, Homo sapiens
ctgcgatatgtgaggagtttgagattgcagtgagctatgatcaaacttcacttcagcctggtgtgacagagcaagggtttaaaaaaaaaaaaaaaaaaaaaaaaaatgtgttggcgcgggggcccccgcttgtaatcccagcattttggaaggccgaagggggctgatcacctgaaggtcaggatttcggagaacaagcacgggccaacatggcgaaaacctcgtctctaactaaaattacaaaaaaatattaggccaagcgtggtggcgcacgcctgtatttccaactgcttgggaggccaaggcgaggagatcttgtttgaccccattaaggtggaggctgcagtgacccaggtatggtggctcatgcctgtaatcctagcactctgggaggccagggctggaagatcaactgaggctgggattttgaaaccagccggggcaacacagtaagactatctctacaaaaaattgaaaatttatccagatgccgggcacggtggttcacacctgtaatcccagccctctgggaggccgaggcgggtggatcacctgaggtc

SEQ ID NO: 159253 - DNA, 160 bp, Homo sapiens
tccacttccctagcgccgccactgagaacatttcaaagaatatcttttaagctctgaagtcaagtttcaaaggcagactcaggcaaggtagcattgttagaataaatgggtggtcagtcatttggatgtaggagtctatgtgtgagggtctaaacacaaa

SEQ ID NO: 159254 - DNA, 223 bp, Homo sapiens
cctcttgaaatgtcttatggtaatcgcgacagtacaaatattccagcctgaagactgctgttctatcaagaattagattactctatttctagagttgacagctattggaagaactccttaactagccataaacctgggaatcctgcactgttcttctacttagggtcagtgcagtcaatgtgaatccagagattgtttgctttctctcaccaaaaaaaaaaaa

SEQ ID NO: 159255 - DNA, 244 bp, Homo sapiens
gaaaaagaaaaaaagtactctatgggttttgttggaatggtttgattcaccctgaaatttgtaatgggagaaccagaggaacaaaagtttgtaaagaaaaatttctctcattctctttctcgtaagtctctcctacctcctttcctttggacaataataataaaaatgctaggatcatttgattaaataagagtcactcagtcaacacaaagcctgctgtcttcctccagtatatttgcatttg

SEQ ID NO: 159256 - DNA, 425 bp, Homo sapiens
gcccatctttccctcatttcagcaacactttcagtgagccccagctcatggaaagagagacgaggagagaaaaaggcttattcctgaagctaatagctttccttctctctctaatactatatgtttgcagtgacaatgatccctcagcttctgaatcatctcctcattctgtgatgtacccctgggttctgagtttcatttctttggcagtcagtcacatgctgaatatagagcacctctaatttgttcagtgtctcatggatcactgagaaagaatagggccttatgacaaactccactggtcagagcgcccggatctaggtgtgtgatcacagcctttaacacttgaccaggaactcatatttcatggagtgagaattgtgagaccttgcactagggttttgtgattctgagaaagatgctgg

SEQ ID NO: 159257 - DNA, 267 bp, Homo sapiens
acacagggtaggcccaactgtacttccaaaaggttctgttttgttttccatttcagcactgaattttattattattcgattctaaaatggatgcacactcatatatatcgtagaagtgcatgagataaagtccctgtcctcaacagctgccatgaagttcttctagactttactgcacacatgccaacacatatatgcacactggtacacagacatatatatatgtaaatattttacaataaatagaatattatactgatgactttg

SEQ ID NO: 159258 - DNA, 119 bp, Homo sapiens
caaataacagatggcctttagtcactttcccgggaatgacatgacgaaaacaaacttcaaaatctagtacaatttgtaggtcgcattcattatgttgtattagtccctagttttatgtt

SEQ ID NO: 159259 - DNA, 274 bp, Homo sapiens
ctgtacaaacagcccatttcacttacagaggctggtagagcacatgactaatgtaacttactcaaggtcacagagcagattcttgtaatgattaggactaaaattatgtaattagctgatctgtgccactttctttatctccccatttaacgttttgaccataggttcccaaaacctcaaaaaattattttctgtgatgtttatttcaatagaactaagttctattaagaggcagattaggtagctgtatatgtagaaagctcttgaaaaataa

SEQ ID NO: 159260 - DNA, 204 bp, Homo sapiens
tggcaaggtcgggggaggggccaaggtgaccaactagaagtagctgctgttggctgctcctatcaagaatgaaaacagcgagtgaatgttgcactttcaggctgaggtaaccaggttctctcattgggactgactaggcagttggcacaacccacggagagcgaggaaaagcagggtagtgcaacagccccacctgggagccgc

SEQ ID NO: 159261 - DNA, 149 bp, Homo sapiens
cttcaataattttctttcacaatttctaccaaacacacatagcagcagatgaggtgtgaattatcagtatcttaaataactgaagctaatgaacaaaaagagtttagctcttaaacaattaggtataaatcagctctggcttctttttg

SEQ ID NO: 159262 - DNA, 595 bp, Homo sapiens
caccactccaccccaccctgtgcctctcctggtcatgtcacacatgatagtgtggcttcctagttatgagcccagcctcaggagccagactgtcgaggttcaaagctcactgtggcttgtgggaccttgggtgtccccctccaagcctcagattcctcttgtgtaaaatgggatcacaagagcaagtacccactactcctggggctcttggggagattaagtgagaaaatttatgctaaatccttaaaactcacataagccttggctgctatcgttgttgaataaatgaaccacttgcaggctgagaccggggctgtgtgtcacatggcacctctaggcctcagtttcctcagctgcttctttgggaaagcacatctgctctctaggttgggcctcctccctcgtccttcaaagacctattcttggggcctgggccctgtgaaacctctggctctcggacgcagcctggaacccctgagacgaggtcaagctccgcggcccgcctcctgtcgcccggccccaggcgggactgccttggcaggactcgggccgcgagctggaggcgcggctcccggctcggggctccagcggccgc

SEQ ID NO: 159263 - DNA, 213 bp, Homo sapiens
gaggacaatattctgctcataaacttgctgtaaaggtaaatgagacagcatatgtaaatatatgcttagtacagtgctccacatatagtaagtgttgaatgcatagttatataagtataaatgtggataaacatgtatcgagcacttggaaggcagtgtattaggggatttacactataggcagatacacagatatatgtaaaggggggagtg

SEQ ID NO: 159264 - DNA, 242 bp, Homo sapiens
aacccatggggtcagcagagggagatgcagcacaggggctactgacaaactctctggtgtggctctacctggaaacagggatggacacaatgacctcccttgactatgcgtggcctgaggtcctaattggagacttccttactccctcatccacctcttattgcgaacctggccattcttccatcatggtatgtgggtgtttctttcctcctgaggggtcctcagcttcttgcagcctctgc

SEQ ID NO: 159265 - DNA, 418 bp, Homo sapiens
ctctgggtaggcccgtaaaccagggctccaccttctgactggctgcaggtggtcagattgctcttggctacccaggagccagtgggttcttggttctggagaagctggttgaccacaagggaattgtaggttactggggccggcaccatgggtgccctttggaaggttctgctctgacctatccctggaggccccagccagaagagttgtcacttcccttccggccacccactgtgcaagagacaaatcacatgctagtttcgtgccatcttccagtaagatgtgggaggcactggcctgagtgatcccttttcaagcaaagccgcatctcgccgtgctcacaggactactgtcataggaacatggatggtttgttcttccatttttgtggagctcggggatggggggatgtgtctgt

SEQ ID NO: 159266 - DNA, 345 bp, Homo sapiens
caagaactcattgttcaacgtaatagtatctactggtatcattgggttaaaaaattgtaaatatattttaatacccgtgtatgtctcctcaacctataaactcctcacttaccccagaagtaacagttttcctgaatttggtatgttttatttctatatacattttcctgccttttctacaagcaaatgtgctcataaacaacatttggtattgatttgcacattttcaaagttagtataaatggtacatgctgtgcatagtattaggcagtctgcttttactactcattgttatgttggctgtggatacatgtagctttagtgaaggatctgctacatagtttt

SEQ ID NO: 159267 - DNA, 321 bp, Homo sapiens
gtccaggttctccagagggacagaactcataggatgtatgtatatatgacagatagtttgttagggagaaatggctcacaggttcacaagaccaagtcccatgacagaccatctgcaagctggggaagagagaagccagtagtggctcatctaagtccaaaaagcctcaaaagtaggggagctaacagtgcagccttcagtctgtgactgaaggcctgagagcccctggcaaaccactggtataagtccaacaatccaaaggctgaagaatctggagtctgatggaatggaaggaaacatccagcacaggaaaaatatgaa

SEQ ID NO: 159268 - DNA, 364 bp, Homo sapiens
tctagatattcaaattgctggatcaaactttgtctattaactacagacatgaatgttggtatttatgtagctgttaaaatgttgcatagttttactccttggtaacattaaaacctatagagacttcacgtcctgagagtgtcagagatgttggctagatgaggctattactctgcctattctagaacattctcaggcacggaagcttactcccgcattagcaagatacccagttttgtcagatatttgtgctttagaaccctggcccacttttcttcccactttaagtagctattacctgatacacaaacaacttgctccccggaagggaaatccactggcatggttcatccacggcatgaag

SEQ ID NO: 159269 - DNA, 356 bp, Homo sapiens
actattttaccaggtaaattatttttattttaaagggcataaatctgtaggacaaagtggagagaatggagcaacaatttcgaaagctggaaagcagatgcctgatctgcagtaactaacttagcaggcgcacagaaaccgatctttttgctggcagtgaggaaagctgagaaacaagttgatttacaccatcgaacccattaaaggctcaaaaatttgttgtatcatgtacttctgagtacaggagagaaggtggggcaacatgcaagagatgcagttgaaacactgtcaaagtctatcagatccctagatagctcctcttgttcatatagcattcccctcacctaggcgcctta

SEQ ID NO: 159270 - DNA, 364 bp, Homo sapiens
tcccctgctgtcctctgaaatgcttatctaggcatcgatcttggtttcctcttcaactgattaactaactggtctactctgcccagtctctatttgagaaatcatttgacatcattttctttaacttgatgaaatctcctattttgacaagatttacagttcctctttataagttcctctttactttgtgtgtgctttatattgtctttggttgacaagagacagccaaagaggtcagtcagcagagatacaagtagggataagatggatagggagaaacaacagtgttcaatagggagggatgtttcagggaaactaatttcataagtggtcatttcagtagtgaatatatttgaatggttaa

SEQ ID NO: 159271 - DNA, 411 bp, Homo sapiens
acatgtacattccaacttaagcacacacacagttttcaactcacttgcctataaacacacacacatttcaatcagttactagaatgtgacattccactacttgtctgtctttggctgtctacactgctaggccaggccgaggacttctctctgaactccaacaatctttgaacacccttcctgtctacactttcagctctctcaaaatgttcagttacccttcctgtctgtgctcatgacttcagtctcattcccaccaaaccatcctcttttctgcagccacagggatttttctaaaactcaacccaatagggtctcttttctgcttaaataaaacttcattgaccacttctctacttcccattactgatcctagcatgatacacaaggccttccatgatctcacctgtc

SEQ ID NO: 159272 - DNA, 458 bp, Homo sapiens
tgaggagcagcaattaaagtcccagttactgagcggcacatagtaggccctcacttgagagaccgtctcagctacagacatcagtgactctcgtcccctgtgcacagagagacatgaacacacagatgttcataccaagagctggtggcagacccaagactagaaccaaggtctccagactcccgggccagggcccttccatgatgtagccccccggtctcttcaaggacaacagttggggagagtgagaaaagcaggtttgggagactgtgtccttgactggcagcagccctcaagccaccccacagtgggcgctcactggcatgaatcatccttctcttcctttcttcaacttggttccaaagaagaaataatactgggggctgggggctaaaaagcgcacatgtcctttcctcaggtgtcaattcactcccagcagcactgactgagtgctgacc

SEQ ID NO: 159273 - DNA, 296 bp, Homo sapiens
aaaaccactgaatcagaaccaaaaggaacccagttcaaatcccttcccattctgagaatctctaattctggggattgtcctaaaacccacagctattataaagcattggcagtgtgatctagtggttgagttctttctaactctgatgtcagacaagtctggttgtgaaacccagagttgcccctatgtgacctttcatctcaaagtctgttaggtcatctgtaaaatgggggtaataatagtcccttcctcataaggctttacaaggattgaaaatgatgatgtttattacaaca

SEQ ID NO: 159274 - DNA, 363 bp, Homo sapiens
acaatgcagagtcctggaagtgaggctgaccgctgaccgctgtcaggagggacatggaccgctgccggggaatcatgggatttcccaccggcccagtcatctcccacgtcgggaaaagggaagagctgcttccccatggcgtgtgcgcgtgggaagggtctcgggcagagaagaggcactttttctgtcctccaggctgtttccgccaaatgaagacctgggctggaagagccaggaacaaagaggagagtcgagtgctgagcacccagcgggagaggatgcagcccggtcatctcacacctgctgaccacacaacatcgtctgcgagttccccccacctacttcgcctgcagctgccatttg

SEQ ID NO: 159275 - DNA, 108 bp, Homo sapiens
agaaaaaatcttcagtcaattacttcagagccatctcctctccccactgctctgctcccctgccccaaaattgagtataaaactagtaactgggacattccagaaaag

SEQ ID NO: 159276 - DNA, 218 bp, Homo sapiens
taggtactcatagttactatacagttgacatttcaaaacaatttgtagtccaaggaaaagtacaaaaaacaacatactgcacctgactcatataaaattttcctgccctggaccttcccagttgtacttattttacactagtggttcccagatcaggatctcaactaatgaggttcttagacctgttctcagtattttaaaaatctattgtgtatgtt

SEQ ID NO: 159277 - DNA, 214 bp, Homo sapiens
  misc_feature (5)..(5): n is a, c, g, or t
attantcttaatctctctatcttaatctctctatcctatatctctctatccttaatctctttatccatcattctgctgtattttcttataactaaaaatggcatttctgctcatgagatcattccaaatgtcatgtttgttttttattataaaactgagttcttctacctaatgttttaatctggcatttcaggaagactcaaaaaccaacatt

SEQ ID NO: 159278 - DNA, 330 bp, Homo sapiens
ctacagcctcaatttctccatatacccagggcaggctgtgttccttcttctctgatctctggagtctgagtttagaatctggccttgacccctggatccctcatttccatccctatacccccctccatcacccactttattcttccaggacctagagcctcctccgtgaactgtgggtcccctgctcatcctgtaggactgtcctggcaggcagtgtgtggggagacccaagcctgctttgaactggagcttcctatccctcacaggcaccgggctctgccccagcccagcccacttggctctcctggcaaggagtgggctccacctaga

SEQ ID NO: 159279 - DNA, 425 bp, Homo sapiens
tatgtgaaggaacccatccctagggtggctcaggaatttgagcgaacaagttcagtgacctgggcgtggtcatgactgatgtgatgattctaagaaagaatgagaacgtcatggacaaggagagaaggacttttacaaaagaataagagggctgggcacagtggctcacgcctgtaatccaggcacttggggaggccgaggcaggcatatcacttgaggccaggagtttaagaccagcctagcaacatggcgaaaccccgtctctactaaaaacacaaaaagttaaccaggtttggtggtgtattcctgttgttccagctacttgagaggctaaggcaggagaatcgcttgaacccgggaggcagaggttgcagtgagtcaagatcataccactgcaccccagcccgggcaatatagcaagactc

SEQ ID NO: 159280 - DNA, 839 bp, Homo sapiens
aagcattcccttttctccccagactggccaacgtctggtattttttgacttaatagtagccattctgactggtgtgagatggtatctcataggttttgacttgcatctctctgataattagtgatggtgaacattttctcatgtttattggccgcttgtacgtcttgtgttgataagtgtctgttcgtgtcctttgcccactttttatgtggttgtttgcttatttcttgttgatttgtttgttagctcaagtcttagtccctcgggtctcaccatcatcttcctccagcccagctctcttctctacttcctcctctggaactcctcactagaaccccgaaaaaagcaaacagaaacatttcctgaatgcttgctgcaaatcaaacacaattctagacatgggcgatgcagagacacaggccagctggccaccacatgtcattcattctaagtagcacttttgctgtttttttaaaaaagtcaacgtctccgaaatcagggtatgtcttaccactcatagcccattggcaggttcttttcttttttagaggtacttgaaacaatgattcattttacaaccatggcatcttaggtttgttgaaatataatagtttctcccttcaaggaacttacagtctgccttcagggtgaggcaagagcacagtaagagccaagtgagagcatgccatgtgagccagggaaggagcacttccttctaacctggagcatcagaggggtctccctgataggggaggatctgaactagagcttgaaggatgagtggatttttctgtatttttcccttgctctgtcgctcaggctggagtgcagtggcacaa

SEQ ID NO: 159281 - DNA, 397 bp, Homo sapiens
accagggtatttccactcatctggcctcggtggttatttaatacagggggtgagcagaggtcccaagcgagtccattcagagcccttcctgtgtcttctgttggaacaactcagaatctaagaggattgctagacataaatgcactgtgagcctagagctccatgaaaatcagcctgaaatcccattaaaaccagtagaaagacaagcagagagaagggctggagagtaacaggggacaaagggggggtgagaaacaaagtccttatcctgtcatttaggtatctggatccagcctttcctgcttcccagttatataggctaatacaatcccctttctggatctttcttttattttttgttttattttatttttttggtttgagacagagtctcgct

SEQ ID NO: 159282 - DNA, 376 bp, Homo sapiens
ccatcactctgtgtgaaggccctgcacgctcggaccggttcaattatgaacaggagggcggttaggtctgtgcgtgcgtgtgtgtgtgtgtgtgtgtgtgtgtgtgtgtgtgtgttcagagtaagaattctggggagaaggaacttactcatcataaaattttaattgttctcttaggtgcatccttccatctgtccttgagaggtgggaggtcctgagtcctagaaaccctagaaaattctttggaagttgcaaggggtggattaaggaaaatagcccgtctttttaattgcgatttcctggccagcagcttaattgttgtggtgcttttctagaaactcccttatcctggctgtggaaattacatgctgaatct

SEQ ID NO: 159283 - DNA, 168 bp, Homo sapiens
tgatgagcttaaaaaatggtcatgttgggagaattaaacaagctgagaggatggagggcaagtgatgacaagcactattatgtaattgtgaatgtggttgattgatgtagacttagtgatgggaggacatctagaaaatgggggaggagagcacagctttagacaggg

SEQ ID NO: 159284 - DNA, 244 bp, Homo sapiens
tgagagaacaggaaacctgccgagaaaaagatcgataagcagacaattacaccaagccaacttcagtgcaatcgttaaagcttacacatgggtgcacgcttgggagccgtgagctaccatgttaaaaggccaacttcctaaggaaaaatgatggaaagagatcccgagatcctatgaaatggaagagggaggacaacccagctatcccaacatcccagctgaggccagccacacacgtgactgt

SEQ ID NO: 159285 - DNA, 213 bp, Homo sapiens
catccacctcatctcccacccccacaggtaaactttctaattgtgtgtgtgtgtgtaagcttccagtttctccctgtgtaagcacaagcaaatgtaaatatgtatattttatttctgttttcttacacaaaacgcggcactccgtatatattgttctgcaccttgcattcttgcttactagcatgccctgcagatttttttttttttttttta

SEQ ID NO: 159286 - DNA, 132 bp, Homo sapiens
tccaccactgtgacatgttcctgccctaccctaactaatccatccaccttgtgatatgttccttccctaccctaattaatccatccaccttgtgatatgttcctgcccttccccaactaatccatccacctt

SEQ ID NO: 159287 - DNA, 201 bp, Homo sapiens
ccagcacaggcttcgggggtctgtgttttctcactgacaagggagccccaaacaaaaggctctggcagtgttagggacccaggggtttgggggaggaagaaggaaaaggctaggtgtggaaaaatacctagtactgagtcagagtggaaagaagtgtcttcaacgtttgctcccacttcctctgctgtgaatatttgtaaa

SEQ ID NO: 159288 - DNA, 337 bp, Homo sapiens
cagactggcctggccaacatggcgaaaccccatctctactaaaaatacaaaaattagccgggcatggtggcacatgcctataatactagttactggggaggctgaggcaggagaatcacttgaacccgggaggcagaggtggcagtgagccaagattgtgccactgcactctagcctgggcagcagggcaatactttatctcaaaaaaaaaaaagaaaaagaaaatgaaagtcttctaacatcttgcctcattggtcattgagtcaataaatatttgctgagcacctatgtgctagatgctgttccaggtctagataaaacagtaaacattatagac

SEQ ID NO: 159289 - DNA, 447 bp, Homo sapiens
gtgcagtggctcacgcctgtaatcccagcactttgggaggccgaggcaggtggatcacttgagatcaggagttagagaccagcctggccaacatggtgaaaccccatctctactaaaaattcgaaagattagctgggcgtggtggcaggtgcctgtaatcccagctactcaggaggctgaggcaggagaatcgcttgaacatgggtggtggaggttgcagtgagccgagatcgcgccactacactctagcctgggcgacagagtaagactccgtctccaaaaaaaaaaaataataataattcaatgtcgtttctttgtgggtactgtcttgagaagctgcttgttttcttaactctttagatgtttgtaaattacattgctgttctttagtttttctggctttcctaaggagacctgttgcaagtttctgctgtatcaccttcctca

SEQ ID NO: 159290 - DNA, 135 bp, Homo sapiens
atcatttaatcagcactctgcttgaggtgaattgtcttaatttcccttcatctaggaatgtgttcatttcaccttcattcctgaaagacattttcaatcactggatatagaattgttaattgatgggattttttt

SEQ ID NO: 159291 - DNA, 329 bp, Homo sapiens
  misc_feature (214)..(214): n is a, c, g, or t
  misc_feature (223)..(223): n is a, c, g, or t
  misc_feature (272)..(272): n is a, c, g, or t
aaaaaaaaatccttaatttaattacatctgcaatgactcatttccaaataaggtcatagtcacagattctggccattaggatatgaatagatcatttgcaaactacccaactgacaggggactaagatccagaatatataaggacctcaaacaacttaacagttaaacaaataatcctattgagaaatggacaaaggacatgactagatatttntcaaaagangacattacaaatggccagcagtgcttcaatattattaatcactaggggnaatgcaatttcaaaaacttacaatggggttatcatctcacttccagttaggatggct

SEQ ID NO: 159292 - DNA, 548 bp, Homo sapiens
attcttcaaaagaaatggtctgtatgcttcaaaaatatcaactcatggaagacaagactgaggaagtgttccagatttaaggggactaacgagataactaaatgtaatgtgtgatcctggattagatcctggacctgagggctttttccccctttgattgtaaaggacagcagtagacaataggtgaaagttgaagaaggtttgttgattagataatagcattgtatcctgattttgatcattgtactctggctatataagagaatgttctttattttacaaaatagtcactggatggagttgaggggaagggacattatctctgagattttatatagatagatgatgaaaggatggatggatggatggagcagtagacagatttgatggaggagtggatggatggagatagttagatagatagatagatgaaactgggaatgatcaagcaaatgtggaaaagtgaatctggatgaacagtaaagggtttgtttacaagaattctttgtactatgtttgcgacttttctgtacatctggaattgttta

SEQ ID NO: 159293 - DNA, 199 bp, Homo sapiens
ctagctgttccctctgcctggaactctgttccgggaaatcatcttggttcaccctccttcatgtctttcagctctcaccattctagctaacgttgacccccactccagtctctaatatatcattgctttatacccttcatagccctatttgcatctgaaatcatcttagttgttttaggtctgcctttcactctagaat

SEQ ID NO: 159294 - DNA, 255 bp, Homo sapiens
ggagtaccagcatccttgaagagctatatgatccctcacctctgtaggtcagaaattatgtgggaatggctgacactgaagcaggaaatctcaattcagtgaggataactggataccaagatggttgaggccaagtgacgctaatttcacctaaacatcggcatggttagtacaatagacagcacagtcaacacagtaatcatgatagtctgacttcggagaactatggtgctggctagttgatcacagtgttcc

SEQ ID NO: 159295 - DNA, 533 bp, Homo sapiens
agcctatatctggatctcagtatcgcatctatatcactgaactagcgagcttctagagaatacgaataaccacgatgtctcaggaggtacaaggcgagcagcaacaaggactaatgatcacttcttcaagaatttatcccaagaaatgcattgtatcttaagttggggaacacttttacctactctaaaatctttagaggtattcagataaatccatgatctgagttttatgttaatagttttacagtgtcatagtgtggtcctgaagtgtagcaatttcaacctctgagccactgcgcccagtgatgtgaaggaatttctttaacaaaactaaatagggcttatttttatatttatagattgtttatgacagtgctttctagggactgagaattataccgtatacagactcaccccaatttaaaatttcttccttcaaacgttaaacctaatccacctcaatccctgacacagtaactgaaagcttcaaatttttgagattaattcacttgttaatagtgaatttgaaatta

SEQ ID NO: 159296 - DNA, 222 bp, Homo sapiens
attattcatttttcaaagtatattttaagcatatagagaaagggatcaaagggagctagaatatttaagaggtcttccagagtaggtgggtatttaagttataaaggacacacagaaacccattaaggaaataaattacagaagattgttaattaagggtcacagttctatgagggtatgaaggtgggggtatgaagaggtggggtatgagacaacagtgca

SEQ ID NO: 159297 - DNA, 381 bp, Homo sapiens
gactctctcaggcttgcctgccccctgggcatcagcttcactctctctcgggcttttgtgaagtatcacattgctgtaggcagttctgcaggcaaaatttgcaatctcacaaacagagaaaatagataattccataccacttccatccaaaatagaataaaatcatctcagtttggcacatccctgaatcaaacactgtggccaggagaatggagcactgttaccaacatactgtattgtgcaggtgtagtctgtcatccaaaagaaaaggaggccaggcaaagacaacagtcaccatactcaagctcttcaaaaagcagtgcaactgtggctgatacttgacagagcaggagcatcaccatcttggacaagcaccgccat

SEQ ID NO: 159298 - DNA, 279 bp, Homo sapiens
tggttgttctttgtcttcaacttcctgcgccaggctttctcaggttcttggctgcccctctccttgccttcctaacttctaagtactctggctctcttttcttctacacctgccctttcttcctaggtaatcacaggcattcccactcttgtaaatatcacctcttcagcaatgctttcctgatttttatgtctagcctagacctctcctctaaccttcacacttgcagtagctcccacttctctaggtggcatctccacttagatgtctcaccctgtg

SEQ ID NO: 159299 - DNA, 442 bp, Homo sapiens
atgttgggattagcaatctgtgacttttaaagcatcttttccagagatgggtgagggtataatggattttaattgagatctcctttaaatacatttctaataaagaatttcacaagttcacaccacgtaccaaacacaaagtattagatattgtgaaaccatagagatagacaccatgttctatttcttaaacatgctacattgtccagcacaatgtagtattaggcatccaacatacgtacaataaatattgttaaattggctggccacaggagcaagaaaaattgtattgttggagtaggaccccgagacgatgtgatggacatgagtaactccagctgcgcctctacattgatgttgggaaactgagaagagaatgaggtcaacattgcagtgatgaaaatgttgcctgacccttaggcagggtcttgaatcaaaaaaa

SEQ ID NO: 159300 - DNA, 440 bp, Homo sapiens
  misc_feature (407)..(408): n is a, c, g, or t
  misc_feature (433)..(433): n is a, c, g, or t
  misc_feature (436)..(436): n is a, c, g, or t
ccctcgtcgacctccagcccagaaagcacctgcaaaggccagcttgaccctatacaaatcatcaccgccaaacacccacggtctccactgcctgggagccacatccattctcagtcactggacacaaaacaccgctcgtcatgtttctgacatttgtacacatcctccacataaatgaaggttagctgtttagtctcctcactcaaccacactccagcagggatcttggagggaaaagaagcttttgaagctgagaatgatcctaaagcacatcggctttactcctaagagagtccttcatgtcctctctcagaagccaaggccatggtgactccacatatccgtacctgcaatttccaacacacccttaaactgaccctcaatgccagattcacacttctgtcganncggccgcgaatttagtagtagtagncgnccgc

SEQ ID NO: 159301 - DNA, 247 bp, Homo sapiens
  misc_feature (214)..(215): n is a, c, g, or t
  misc_feature (240)..(240): n is a, c, g, or t
  misc_feature (243)..(243): n is a, c, g, or t
ccctcgtcgacctccagcccagaaagcacctgcaaaggccagcttgaccctatacaaatcatcaccgccaaacacccacggtctccactgcctgggagccacatccattctcagtcactggacacaaaacaccgctcgtcatgtttctgacatttgtacacatcctccacataaatgaaggttagctgtttagtctcctcactcaaccgtcganncggccgcgaatttagtagtagtagncgnccgc

SEQ ID NO: 159302 - DNA, 236 bp, Homo sapiens
gggaggcagaggttgcagtgagcagagattgcaccattgcactccaacctgggcgacaagagtgaaattccgtctcaaaaaaaaagtaaaatttgatgatttggggcagatgtgtccatccatagaaccatcgccacagtcaagataatgaatatatgtatcacccccaaagtttcctctctccccatgtaatccgtccctccctctctccctgtgtaatccctccctccctctct

SEQ ID NO: 159303 - DNA, 513 bp, Homo sapiens
ggtggaggagctgggattaataaacactgataggctgatacacattcaaagattctttttttccttaaataaattcctcatgtctacacactttgtgtgtgtggtgtgtggtggagagggaggtcaggctctcttctacaaactgagcttagaaaaaaacagttcatagggtgagcgcggtggcacacgcccataattgcagcacttcgggaggccaagttgggtggaatgcttgagcccaggagtttgagaccagcccgcagcaacatagcaaaagctcatctctacaaaaaatacaaaaaaatttagccaggcatggtggcttacgcctgtaggcccagctacttgggagactgagatgggagaatcacctcagtctcccaagtagctgggcgtggtggcgtgtgccggtagtcccagctgctcgggaggctgagacagaggaatcacttgaacccaggaggcagaggtggcagtgtgccaagattgtgccactgcctggggacagagcgt

SEQ ID NO: 159304 - DNA, 141 bp, Homo sapiens
accacccaaaacacacaggaaggtttagccataggtggccagagctctctaacatcatccccaggaagtctgtgttggtcttaagtcctagagtcattattcaaagttttacttaggtggctcatgcctgtaatcccagca

SEQ ID NO: 159305 - DNA, 165 bp, Homo sapiens
caaactttaaaattagacacaaaacataaaatattgtttaaataaataaaagggaacgagtatataagaatcgagctagatcagatagattagacacaggaaaccagagggaaaaaactgagtaaattatctagactgcagcacatagaaatatagaaatagaaa

SEQ ID NO: 159306 - DNA, 303 bp, Homo sapiens
gtgcagggtagactcataacctagcacagaaaaacacattactgaggaaaggaaaagaacgtgaatggggaattttgagacttagctcttcacagaaaagcatgcttggcaattacaaacttcttatattaaaaaaaatcaggcaaaccaaaagtcattaaagcattaaagattaagacccactcacaaggaattcacatactctgcttctttacaagggcagtcttgcacctacactgacttggtgcacctccttacacagaacaaatccaccttcatgacttgagtataaaaaaatgcttt

SEQ ID NO: 159307 - DNA, 353 bp, Homo sapiens
tgagtagctgggtctacaggctcatgccaccatgccccactatttttaaatttttttgtagagacaagggtctcgcctcattgcccaggctggtcttgaactcctggtaccaagcaaccctccctcctcagcctcccaaagtgctgggattacaggcatgagccactgtgcctgggctaatttgattttttaaagctttttattttgaaataatcagaggttcacaggaaattgcagaaatagtagaggtcctgtgtacccttcacccagcttttcatttaacttcttccagtggttggttccatcttacataactatagtaaacgttaaaggtaggaagttgacactggtag

SEQ ID NO: 159308 - DNA, 186 bp, Homo sapiens
cgacctcggtaagggaagacgtggaattccgagtgtggagacccagacagcctccgaaacccccacgcaaccctgggcgttcagcagctgccaatgcccgcctgacaagtttctggggcatctctgcacacggagaggtgtgtctcctgcagctccaaaaacagattttgccatctcatccccata

SEQ ID NO: 159309 - DNA, 397 bp, Homo sapiens
attgggtgacataactgaacaggtcgctgcaaacactgagaattattgagttgtttaggtgagtctctcttgtttaaactgttgaaaggttcattgatttgtgggtgagggaaaactgttgtagcgtagttttagtgtttgcatttcattttaacattaccttgcaagggatttttcatgctgtactaaggagattacaaggccaccctaaggcattttagggttatataaggaactggctttgctgttttatgtactggcccttttattttctggctaagccagaatcttggtaaccctctcacctatcacctttgggtattaccttttcagctctccctttgccctcatgagtccaaccagtgccctggtctgagcctccatcctcccaactgcc

SEQ ID NO: 159310 - DNA, 865 bp, Homo sapiens
caagatggcacattgagtttatgtttcgactcactccctttgctccaaacacatagcaatgacgggtaaaatataaacgagaaaacaaaagagacaaggctgggcttccagaaacaagataaatatcttcatggaccagaaatgccaagtagtgagcaaaactgcagcctgggcctgctggactctctatccaaggcaggtggtggtgtccaggaatttggctacaagtaacagagactaaatgtgcaccatgtgggacaaggggccagagtcttgaaatagctgtcatgtcctgagaaatgtggacctgtaactcttaaaaatacacgactcttactggtctgttatatctggtaacttttttgcccgttactaatatgtaatactgatcacctctgcattctatgacagtaggtaaccttgggaaggttctttgttgcagcaagaagagctttgggattttcttacacatgaagtagaagtaatagttttgaattctttagttaaccaaaaggtttctgatatttgtgtcatttaagttaactaaatatagctggagttttaggaatccaatctgataaagtctgattaggtatattacatcagtctatacttgttattactgacctatttctcgtcctccttttctcgtccttttttctgccattcgctggcatttataccggggtcctagattcctccctgacctcccttgaatctctggtcttgagaagcgacaagtggttgactttgggtggtaacctttttagtcttccttggacaggatattcagaattcctactaatccgaagattcacggctgcataattttaataacccactaaaaatctcgggttcccttcgt

SEQ ID NO: 159311 - DNA, 269 bp, Homo sapiens
ttgcaaaatttttaacaagtgaaaagcaatgacgggtaaaatataaacgagaaaacaaaagagacaaggctgggcttccagaaacaagataaatatcttcatggaccagaaatgccaagtagtgagcaaaactgcagcctgggcctgctggactctctatccaaggcaggtggtggtgtccaggaatttggctacaagtaacagagactaaatgtgcaccatgtgggacaaggggccagagccagattcacttcttgaagccaaggact

SEQ ID NO: 159312 - DNA, 429 bp, Homo sapiens
tggcacccacaccacctgagtccaccacctgagtcctttctctgtatctcccatcatcatttaaaatataacatcttacaaaccttagctcatttaaatgaagaaacctagaactaacctcagtaaatacctgagcagtactggtacataaaatgcttgtgatagtgctgccactagggcaaaatacaataaagctaacattataataaagagagtcacacaaatttgttggtttcccagtgcaaatagaagttatgtttatattatagtgtagcctattaagtgtgcaacagcataatgtctaaaaaatgtgcttattttaattttaaaataccttattggtaaaaatgcaaattatcatctgaacttgcagcaagtcataaccttttgctgcttgagggtcttgacttgatgatgatggctgctgac

SEQ ID NO: 159313 - DNA, 397 bp, Homo sapiens
ctgcgctctgaggatcccctaaagcatcactcccctcctgtcctcacccacctagcagaggttctgttactcatatactcctaataccagctgataacagctaatatgtatctctaaggcaccgtgattattcccattttatagatgaggatgcagaggtcttcctacagctaaagtggtggctggtacccctgaccccagggtatgtttaattcctgagctagactccctaagacgggacctggaaaattttctagccctgaggaatgtcagagcatcatgtgaatcattaggacagacagactgtgaggaagaacatgagctgggcgggaaagtttgtctgagctcaggctctgcagattcctgagatgccagagcacattcttacctgcagaaa

SEQ ID NO: 159314 - DNA, 371 bp, Homo sapiens
atatggtggagtgttgcttaagatctgaaagtctagaagctggaggttccagtaattatattcattatcaatcttaagaatttatttcgatcagtcctcatcctctttgtaaaactctttccctcctccccttttgcgccatgctgcacactcctggcttccttccccagtcccactgtgcttcccatgtcccctgatccccactggcctccacgcacctaaacactgcagtgttctccaggaatccatctctccttagtctcccagctctcccactatggacccatcccatgactccatcttttgctgggtgtggatacacacccccagtcccttggcacaaagattttggccaaccctgggtccagctc

SEQ ID NO: 159315 - DNA, 484 bp, Homo sapiens
agggaaggggagatctcaagaaggggctcagaaaaaaaaaggctgaggaaggagggagaaacttgagtaggatgtattttattgtataactatggaatcctcttaataacctctgaagacacttcttgagtcatttccatgtgtgagaagttaactgtaaaatcacagatgacatactgtttgcaactaagaggtcttcagggttcagggacttattatagccaggggatcacaggttccaaagagttcttccaaagtgtaaatggagtccaggagctgctgtcaatatgtcttaatgtaaaatagtatttgtgcatttaatcataataaagacagcataggctaactagtgggttaaactataatttttttgatgtgcaatggaattaaatcagttatatcagttactgcttggtaaccagagacacggattgaatggcaattgaatcctgaataatcaaaatggggaaacaaatgattactt

SEQ ID NO: 159316 - DNA, 404 bp, Homo sapiens
caaaaggagagtacagtgcatcagaatggggcagggacatgagggaagtaggcaggggagaagaaagctgactgcatcaggcaggtcaaccagcagggggttctgtacctcctgtcactactggtgagctgggggactggggtacagattctactgctggtgctcaattcccagggttcactgcccagcgctcagtatagttgatcctaccccttactccagacactgagccacacccaaatctgaccctgggccctgggagagaagagtaaacccgccagtggatgctgactgtgggtgggaggcagctgggagagaccaggtgagggaggatggaagagcctgggaaaggctgggcctccagagcttctgacagcccccaactgtgagggacatataagggg

SEQ ID NO: 159317 - DNA, 186 bp, Homo sapiens
ctgagcatataaagtgagtaagatcatcttggtttatgacttaatgagagtttaaaatcaggtaggcttgatagactcttaagccacaacaataaagtgagattagtgcaatgagaggagaaggatgtggtaccacaggcaaatacggcgagaacagccacactagtatagccagcagttactctc

SEQ ID NO: 159318 - DNA, 414 bp, Homo sapiens
atacctgggcttttatgtgcaagagaaagaaacttctagcttgtttcagtcactgttttgttaggttttctactgcttgaagccaaaacgactttaactaataaaaactgaactgagtagaaaagaagtaaaaccaggaaggggctggtaaagagaagaccagagaccagagggctgacccttaccctgtcagtccagaagcaggtttagagggagtggggtagaagggaggaaggctgtaatcaaaaggggaatttcagcattctagatttcagaagtagaacagttcccaagaagaagtggttaaattctttgggatttttggttgtttgtttttgagtaagggtcttgctctgttacccaggctggagtgcagtggcatggagagaagtgaatgggttcttggtatgaaca

SEQ ID NO: 159319 - DNA, 202 bp, Homo sapiens
gtacctaaaaagtagatcagaaaccaagagaaatatttggtctgcagaggcatttttttttaacttttatttaaggtttggggttcatatgcaggtttgttacatgagtaaattgcatgtcaccgaggtttggtatacaaatgatcccatcacccaggtagtgagcagagtacccaacagctagtttttcaaccttcccacc

SEQ ID NO: 159320 - DNA, 521 bp, Homo sapiens
acagtcacacaagcaggatatatgaatagcaatctctgatcaagacattcctgtgcagataaaacctgcccaaggggatgaccatggtttgcattagcaatgctagactcccagggaaagaagtgatttcaggaagtgcatcagctaaaagcgtgtgaagttcaaagccaagagtaagaaaacaattagaaacagacgtcttctgctttaccacagcttgaccagagaaaagtggagatggtttatataagctacagggatcctcaaaagaaagaaatctagcttatgagaaaatgttcagggaaaattcaattttcctaggaaaaagagactgtagtatctgaatgagccctgtgggtaggcaccttggaagaatcatagcactcttaacagtttgtgcaattacactggggtttgtccctcccgcaaatgtctacttgagggaatgggcatgaggcagtagtttgtagacttaagcttgtggtactgttgtgatatccaggcattaactctaaataagg

SEQ ID NO: 159321 - DNA, 710 bp, Homo sapiens
aacctttaaaatttactatactacatgagaggacaattttgtacaactctttccaggggaaatttagcataattttatcaagttttaaaaagtccaattcaaatctgcaattacacatatgtcaaacaacaattttactggaaaaaatgacattaaatggcctatttacatgttaaggaacatggaattttccttttttcctaatactctcctctgtctcttcatagatgattactactttgctttttgcctaaaaacagtagcgattcttattcacgtccagtgattggtattaaagagagtatctggaataatactgttaattctcctatgtatctgacattttattctccttatttctaattttatttgtgttttttcagttatattgtcataagtttattttttcaaggaattatttcttgaatttaacaattcactaaatatcctcttgctaattcattaactgacacttttcatcctgcttttttttaaaaaaagaattcttttaatacttaattttacttattataattctgttgtatttaataatagcattaaaggctctgaatttgtctctatagcattggcctcaagacatgatatttttatatgtcattctcaaatattctttaattttaaaatatttcatattctaagtttgatttccatcttgacctagtagttataggatacttaacaaaattttt

SEQ ID NO: 159322 - DNA, 179 bp, Homo sapiens
tttgtaagagttaagtaagcgtggcgcaaataggcatctactccaactgcccccgtggaaattcttgagtgcccaattcagtggtgcttggaattaggggagcgaataggttcttacaaatcacctagatcaatccctcccctagatgtctctatatcatactttaaggcctgtataac

SEQ ID NO: 159323 - DNA, 415 bp, Homo sapiens
ttatgttaatactgatggggaagatgctatattttggcaagtcagctttttaggatatgtgaatcttacgtgacttcttccaggtggcaaattccagttatggctccgatgataatataagcgaagaaacattgtgaatgagtggcaggtggactttggctaaagaattccactctgcagtgtttaatgcagaagtctgagaggatggtctagggctctggagaaggatagagctaggtttgagtgttgcagtattttgccagtcttgttcaagtttcagtcgctgtaagaacacgagaagaagaatagtttttgttcagaaggtgtcgtcatataagtaaaggagaaatttgttgatgaagtaaattttgaaagcaaatatgttgcccttccaggtactcagtgcagcatgatc

SEQ ID NO: 159324 - DNA, 411 bp, Homo sapiens
tgttttcccactgctgcaaggacaatgaaagggaaagtaaacttgtgcacctcatttcatatctagttgtaattttccacacaacaataaacagaaacatatacttcaaggttatcaggcctttttttctgtgtgtgtgtgtgtgtgtgtgtgtgtgtgtgtgtgtgtgtgtggtgtggtgtggttgtgtgctttcattaagaaagttaatgcaaaaatcccaatcttcaaatcatcaagtgacaatcattttaatgcaccttatcttctaaccacaaatattataatatggaatacttagttttatctgaacatcccatttaattggaaatacgtaagttgatctaataaaattacaaattaaaaaagctgtgtgattttaaatttccagacatgaaaatcaacagcagg

SEQ ID NO: 159325 - DNA, 355 bp, Homo sapiens
gaacacttagaggccattgtagggttatcaatttgtctaatttcagtattgtcatatctcagggaatagagagagagagatggggcagtggtaggtggagcaatcagaatacatgtaatatatatagacaaagtttgctgttttatatgggcatagtttgtgatgccccaaagcaattaaaataggaacatcaaagatcattcatcacagatcaccataacagatataataataatgaaaatctttaaaatattgcaagaattccccaaatgcaacacagagacatgaagtgagcatatgctgttagaaaaatggttgccacaagctttcaatttgtaacaaacacaatatctgt

SEQ ID NO: 159326 - DNA, 255 bp, Homo sapiens
tcctgggttcaagcaattctcctgtgtcagtctcccaagtagctggaattacaggtgcatgctaccatgcccggctaatttttgtatttttagtagagacggggtttcaccatgttgggccagtctggtctcgaactcctgaccttgtgaactgcctgcctctgtctcccaaagtgctgggattatagcccggcctatttttattttttgagaaggaatcttactttgttgcccaggctggagtgcagtggcatg

SEQ ID NO: 159327 - DNA, 362 bp, Homo sapiens
ctcctaacctcaagtgatccacctgcctcggcctcccaaagtgctgagattataggcgtgagccaccacgccaggctcatgtatttaattttataaaaagttaaaagaaatctgggctggatatcttttctttacctctccagatccatcctctactcttttctacctggctctttgccccagataaagaactcttaggccctctggattgaagggccagagaaggaggtcagaatatttatcccttcacctctcagggtagcatgtattatatacctggattctgcgttctggtaatctctgtctcctatcttctttggcacttctagaagcaatacttgttctgcctttttttttttttt

SEQ ID NO: 159328 - DNA, 796 bp, Homo sapiens
gaaagttttggactttccaggtgaggaagaagtccttgggctgtctgagcagggcaggcagggaaggaaaatccgattgtcctcagaccttcaccagagccaaggaaaggaactgtgaatcgagggtttggtcgccagccaaattgatcttctgagaataaaggctgcagacagatggtaatgaacgtgccagggctccagaggattgttcattcctggagaacagaccttggctggcagacactgggcgctggcgggcacagtgcgtgtccctgtgagcatctctgcacttcagagcagggccctgcgtattcatccttagagtcaaacaggctgggactcagagacagacctgtggcggcctttttctacgagcgtaatttggtacaggccatggtgtttctgttggcattggccaaatatgattttgagtaaaatcattggtcgaggctttgatcgaggccattactgtccaatagaaatagaacacaagtcagatccgtaatttgaaattttcccatagtctcattagaaaaggaaataggtgaagttatttttaataacatacttaatccactgtatccccatattaattcaccacgtcattcctatggcagtatagttgaggtgggtatttgctagtctgttttgtcctactcagtctttgaaatctggtgtctcatgtagtgcgcctcaggtgggagcagctgtgctccggccccggctgccacatcggacagtgcagcctgggcgagctccagagcagcgcacgtgagggcttgcaaggcctgtggga

SEQ ID NO: 159329 - DNA, 916 bp, Homo sapiens
catagtctaagcacttatggacccgctcagacatccaatgtaatctgggatctgaagacgtaaagtacgatttcttttaaatattgatattcatttaaaaatagcgtttgtgtactacactttgtgcaaggtaccgagctcgagatcaataactcagtggccgtatctgcttccctgtgtaggaaggaaaatccgattgtcctcagaccttcaccagagccaaggaaaggaactgtgaatcgagggtttggtcgccagccaaattgatcttctgagaataaaggctgcagacagatggtaatgaacgtgccagggctccagaggattgttcattcctggagaacagaccttggctggcagacactgggcgctggcgggcacagtgcgtgtccctgtgagcatctctgcacttcagagcagggccctgcgtattcatccttagagtcaaacaggctgggactcagagacagacctgtggcggcctttttctacgagcgtaatttggtacaggccatggtgtttctgttggcattggccaaatatgattttgagtaaaatcattggtcgaggctttgatcgaggccattactgtccaatagaaatagaacacaagtcagatccgtaatttgaaattttcccatagtctcattagaaaaggaaataggtgaagttatttttaataacatacttaatccactgtatccccatattaattcaccacgtcattcctatggcagtatagttgaggtgggtatttgctagtctgttttgtcctactcagtctttgaaatctggtgtctcatgtagtgcgcctcaggtgggagcagctgtgctccggccccggctgccacatcggacagtgcagcctgggcgagctccagagcagcgcacgtgagggcttgcaaggcctgtggga

SEQ ID NO: 159330 - DNA, 505 bp, Homo sapiens
tcacattttggagactgagctgagcaagtgctggtcacgttctagaggactgagctgagcaagtgctggtcacattttggaggactgagctgagtaagtgctggtcacattttggagacagagctgagtaagtgctggtcacattttggagacagagctgagcaagtgctggtcacattttggagacagagctgagcaagtgctgatcacgttttggagacagagctgagcaagtgctggtcacgttttggagacagagctgagcaagtgctggtcacgttttggagactgagctgagcaagtgctggtcacattttggagactgagctgagcaagtgctggtcacgtttcggaggactgagctgagcaagtgctggtcacattttggagacagagctgagcaagtgctggtcacattttggaggactgagctgagcaagcggccagactttatcctccagtgaggtcgggagtatgtccaggtttggggacagagactggccag

SEQ ID NO: 159331 - DNA, 204 bp, Homo sapiens
ccttgagccttacctgttctccccacagctgcctgccagtgtcccgaacccagttctccccacagctgcccacccagtgctccagaacccagttgccttggctgccttcctcctgcctggacggcttgggatagggtgccctgtgcctgtcctcaaggccgcacgagtccaccccggaaaggtgccacctcacatggtctcaag

SEQ ID NO: 159332 - DNA, 850 bp, Homo sapiens
aaaaagttcagaagccactgctttaagctatctactgagtgaagaaaggcacaaacaaaacttatcatctgaactgataaccaggaaagagtaagttctatcacgtgctcttgagaaaggcagcagtagaaacctagggcagggcccagcaacagggattgataacattcgcagtgagcagcactgcaaaatagggagaatgaagaacagaattcaaaccacagagcttgcagagtctcagagaccactagttttagttttgtagacagttgccccgattatgcaagtattaataacacacctagagtcatttggtagcagaactaggatggaggtcttgtgacctagtacaggactgtactacaggtactgctgtttgcatggtgctttagttgtattagtttctctttatttgtattttggtataactttttagcagcaagaagtatgggaggggagatgcatgtcagaagttgttcattcttgttcaacttaatttagaacccaacagaaagatatttttccaggtgagcaataaggcctgtcagtgggatttgttcatttattcaacaaatatggttctagacaatagcaatgataatcagatgaatatttctgtcttcatggagcttatgtgttacttaggggaaggagccaataagcatgttaacagtgaattttatgacatttgaacaaagacttgaaggagatgctgaaacaagctaggtaggtatcttggggaagagcattgcaggcatacagagcacccggtgcagagagcggaaggagtctggcacatctgatgaacagccaggaggccagtgaagggagcgggcaggaccactagata

SEQ ID NO: 159333 - DNA, 387 bp, Homo sapiens
ttccatgcaacagtaagttgtctgacagtaaccgaatgtaacttacagaaagtaattaaaagttatattcagaataacagcaatcaggccttggatgttctttattaaactcttttcaggcagtaaactttaccaaaaaaatctgtcattttctaaagtccttgtgctaaaactgttgactatggaaaacaaacaacaaaaaggaatgtttttagtctgctgctattattaacatttattatctgtatcttttggctcaggaaatgacttcacctatttgttccataagctgatctttaacagggtcagctagctaactaggctgtgtaaacagatgtgctgggagaaaattataatatttagtatttgtcctaaatatcaaaaata

SEQ ID NO: 159334 - DNA, 362 bp, Homo sapiens
acaattaaagttagtgatccctcagagacaggaaacaaggtgagctctgaggcgggaggattgcttgaggccaggggttcgagaccagccaggacaacatagcaagacctaaaaataaaaaaataaaaaattattttaaaaaaaggtgagctctagggatggcccatttaactgcctggagttaggcagtgcagggagggaaacccaggtggtggagtccagtggactttctaagagttaaaaagatggaggtgaggctgggcatggtggctcacgcctgtaatctcagcactttgggagaccgaggtgggtggatcacctgaggtcaggagttcaagaccagcccaacaacatggcaaaaa

SEQ ID NO: 159335 - DNA, 432 bp, Homo sapiens
gaagtttgaaactaggctgggcaacatggtgaaaccctgttgctacaaaaaagtacaaaaattagtcgcgcatggtggcgcatgcctgtagtcccagctactgaggaaactgaggcaggagaatctcttgaacctgggaggcagaggtcaagatcgggccactgcacttgcactccagcctgggtgacaagagtgaaactccacctcaaaaaaataaaataaatttgatcatgcagatctagtcaaaaaagcagcgaacggcagatgctagggcccagggaaatgatgacatcagtggatcacatcacaggggctgtgaattgtctgcccacacatgtagctccccaattaataggatttaagtcccttagcaaagatttactggccacatgctctgtagtggaaccatgcttagcttgggctgttcagctg

SEQ ID NO: 159336 - DNA, 232 bp, Homo sapiens
gtgccttattaagacataggaaacatcgagagcagcagtgtggtaagatcagcatttggacttttttttagctttgcaatctctttgaaatatccaagaagacataccactggtgctcagaaattaggtctgaactgggttcatgagcgtgttaacatataggtcataattaattcaaagattgtggatgggattgcttagggaaggagtataaagcaagggtcctcggcta

SEQ ID NO: 159337 - DNA, 261 bp, Homo sapiens
gcacccaatcttcctagataatgtttcctttcttggaaattattaattctgtccagcatttttaacagttgtctctaccttatttcaagtcccagtatttcattcagaattgttattgcagggaagaccctggaaacttatgaggagattactgaagaaataagctattacaatttttgccttgctcttggtttggaggtagcaaattcatgtacaaaggctgcttctgggaaatgtagctaccaagtttctttaattcag

SEQ ID NO: 159338 - DNA, 496 bp, Homo sapiens
cctagctttgttttcatacacagcccaaaatgttcttttctgaaattatcaaatcaaattcatttctaccaactgaaataaaaacccctccatcaaaccctccctattaacctcctgcctcaccacctcctccacaagcaccatacatcatcatcattatcattattttggcattcttctccagacaccctttctacttcatctgtaccaaaataactgcaaatgtcccactttcagttgtttgtttgttttgttttgttttgtttttgagatggagtctccctctgttgccaagcctggagtgcagcggagtgatcttggttcgctgcaacctctacctcctaggttcaagcaattctcctgcctcagcctcccgagtagctgggataataggcacccacaaccatgcctggctaatttttctatttttagtagagacagggtttcaccatgttggccaggctggtctcgaactccttacctcagatgatccacc

SEQ ID NO: 159339 - DNA, 237 bp, Homo sapiens
ccatcagacgtgacctggccaagccagacaggctctctgaaacccagggtatgcggatggggaaactgaggcctagggagaggctggtttggagtggaggtcacctgggacgttaccagcactggacttgacttaagcgggtgcagccaggcccgcaccgagacgacagcatctctttcatcttccaaggcccatcttcctggcaaggcccaggttggcaacgctcagcttttcagc

SEQ ID NO: 159340 - DNA, 448 bp, Homo sapiens
aacaccaccggttccccaataacctatggaaataaaaaaaagaaaaaaaaatttaaaataattttttacatctctgcttttatcatttgaaggagtattaaagtttaatttcacagttgaaggtcatgttttcaacatgtatgttttgataccatgtattatagcacagattgattttgtgtcaaaacaccctgtaatgtaatttatcactagtgtttttatgtttatacaaacttagattgtgtttatacaaaggctgttctattttattttcacttggttgcagtaataatagttaacatttcttgagcttatgttatggttgaagcattgtgctgagagtttcacatttattatatccttgaaagttttaaaaaacctaagaagataggtatttttatccccattgtacataggaagagactaaatcaaggaagataagtggtgg

SEQ ID NO: 159341 - DNA, 553 bp, Homo sapiens
accactgatgttctgtgaaatcagaatttccagctacatttcatatagattctgaatattcaggtattctgagacagattattaaggatatctttgtcctgtgctgatttttccaaataaatctttttcatcttgaaaaaaactgtttgaaggcaaatctcttttgcttataaaaaataatttctagtattaaacatatctgccattatttatttggtttcaatatctagaccttacccaattattatcatacagttagtgttaaacattctttaaaataaaacaatactgttgggttggatgttaagtgaagatttgttgtgtgatttgtggtgaattaggcatttcttgagattgtaggtttctagaagtattaaaagatggcttgactctgcattgttgtaaatatttccccaaagtttggacatttctccagtaaaacttgtctgatgggttaggaccatttgtcttcaaggaatgggggtggttttttttttattgtttgttttttttttttttttcaagataatgctgagacatccaaggagtacag

SEQ ID NO: 159342 - DNA, 578 bp, Homo sapiens
gagaacaccaaatgctgaagagaatgtggagaaaccagatcactcttacgttgcatgtgggaatgtaaaataacacagccactctggaaaaatggcagtttctttaaacactaaacatgcagctaccatacatcctagctgttgcacccctggacatttatcccagataaatgaagagttaggttgactcaaaaacctatacacagatgttcatagtagttttattcagaatggccaaaaactggaaacaggctagagacattgggttgaaggacactttagtggctgcatggttacagtgtggtccatctataccatggaatactactcaacaataagaagggggaaactacagatactatacagcaatctggataaatctggagagaactatgcttagtgaatcaagccattctcaaaaggttgatcctgtattatcccatctgtgtaactttcttgaaatgataaaaatttttgtaacaatgtactaataatgtagttttgtatgaagtcactactggggggaaactacataaatgttacacgggattcttctgtattatttcttacacctgcat

SEQ ID NO: 159343 - DNA, 344 bp, Homo sapiens
gcggccgcctactactactaaattcgcggccgcgtcgacgtggagactccaaggacgaatggtatttagagagtaaaccccgatagagagggtttgtgtctggcacagagaagagcctgtgcaaaagccagcggggcgagaggacaccatgtgttcatccacctgaggggcgaccagcaggctggagctcagcgggttgagaggaggatgcagagcccgggaaaggcaccctaggcagagggcacagcagggcaaaggcctggagtcaggcctgagcctgtgtggtttgaggaacggatagaggcctgtccggcaggaagggaacagcacaggggagagacctt

SEQ ID NO: 159344 - DNA, 241 bp, Homo sapiens
  misc_feature (162)..(162): n is a, c, g, or t
  misc_feature (226)..(226): n is a, c, g, or t
  misc_feature (233)..(233): n is a, c, g, or t
acagagtcagacaacttgggcttaagaaccagcttgacttcctgatttcctctctgtgtacagaagttgcttaatccctagacctcagtttcctcagctttatactaagatagggtgggcataatggcttatatatattttatacacacacgcacacacacnattacatcactgttggtcaaagacgcactcctcctttaatcaatttaaatgaggctagcgagtntctgttngatgtttg

SEQ ID NO: 159345 - DNA, 380 bp, Homo sapiens
tatttgcatcgctgactccatttgatattcaatgtcatgcagtacaacattccatttttcttgaatttattcacgtgctttgctatctctaactctaaaaatgcttagaatagagtacatggcgtatatgaactccctgaagaaactgtgaacaccatgaaattacattagcgtgggcacagtggcttgcacctataatcccatcacttttgaaggccagtatggaggcagtacagagattattgagattaaaagaaagaaacaggtggaacggatctatgtaatggaaagctaaacagaatagttcgtggtacacagtagaaaagcattacatgtctattaagatatggtcatcttccatttattaaagttacatgttt

SEQ ID NO: 159346 - DNA, 230 bp, Homo sapiens
gacctcttgacctcatgctctgcctgcctcggcctcccaaagtgctgggattacaggtgtgagccaccacgcccagccaggtttgttttttttagtttttttgttttttttttcaacttaagcataccctgagattctttaagttttttcagattgttttatgactgaagatttttttaaaagctcatcatgtcattcaaaaacccatatgctgcagttttggcttccat

SEQ ID NO: 159347 - DNA, 520 bp, Homo sapiens
tcccaaagtgctaggattacaggtgtgagccaccgcgcccagcccagctgaagtattaaagggtatatctgcaatttacattgaaaggcataaagcaagaagatgaattaatggctggatgcataggttgatatgtactaaagcaagtataagaaaatgttaatggtaggtggtcctctacatcttcaccaatatttggtgtggtcagtcttttactttcaactggtctggtgggtgtgcagttgtatctcactgtgctttcaatctgcattttcctgaaaacagatattgttgaggatgattatacttattgtacctattacactgctggcattcttaatttgtgaaatgttgttcaaatcttttgcccattttgaagttggggtacttgtcattttattattgagttgtagaagttctttgtatatctcagataccagtcctttttcagatatatgttttgcgaatattaactcccagtatgtgacttgtctaggtggtgggtatgtggatgttcatg

SEQ ID NO: 159348 - DNA, 398 bp, Homo sapiens
cggcacgaggcttcctttgttctcctcttcctttgcttcttttaaaaagttctaagttgctagccaatcaagacaaatacgaatgtgaagtcccattccagcttgggcgacacagcaagactgtcttaaataaataaataaataaaagccagtttggcctcactgctttacggttgcacttctgtgtctgcttagactgatgaatctatttaaaaatgttcagtttagggcaaacatgtcttggtgtagggaagcacggcccacagctgggctagacttgggcagagccaccccacacactgcctatggagccaggccctgtgctttactgcatttaattcctgtgggccttatcgtgaccctatggtggagaaggtacaggggaggcacagatgaaa

SEQ ID NO: 159349 - DNA, 570 bp, Homo sapiens
acttagaggatcccccaaggtccttaagcaacgcggcagctgtgacacagctgcgccccaaagccggtgctctgctgtggtgctgctggtcacacaggagacgtgaggacccagttggtgacacacacagcctccacggactgagcagcagaagtaactctagggccagctaggatgccatcagccaggcccggtgaggagcgacaaccgcaccagggcccagagaatagggcacatgggtgtgctccccagaggggccgccaccacagctgccaggcacttctgtatcctggactgtggagaaggcctagtggggtaggtttcctagtcccatgctgcaaagctgcccaatgactaggcactcacacactcagcattcccctcacaggtcaccaggccaccgtcactttcctctctaaccctgccctctccagccctcgttactcccagtccactcctgaaacacaactctgctctagcctttgttacttggagatagaatagctgaggcagacggaaacacaggaggggcaggttcagaattcaggacaaaagtcccagtgagagaca

SEQ ID NO: 159350 - DNA, 585 bp, Homo sapiens
gttgactggtattactgtaaaaaggatttgttatctctgagcctaagagatgttgaaacatatttctttttttgtgaatgcattgatagatccttagtagccctattagcaataaaagacaaagaatatactttttatctggatttatgtggtgcctgtccacacttgattggtttctgtttgttttctgtttatttgcttgatttggcaatgcactcacacactctttccgttgtgggatggggggatctcatcaggatttgaaacagctccaaactgactctctcccacatagccctcctctcttccatggaaaacacatgtacctattttcatccagacaaactttgaaaatgaaattcaatttcaacacaacactaacttttctttgctctggaaaacccattgtttatcctctggatataccaacagaaatcagataccatcccactctgctaggctcactgttggcaacacataagaagctcttcaaggtgcctgtggaagtccctatcactatagttaatttaagctgatggtaaggcaacctcatacatttctctagaacttctcttacaaacttcg

SEQ ID NO: 159351 - DNA, 325 bp, Homo sapiens
gctggctgttttggaagtattcacgtgttcgtaatcagtccaatgtgtgtaaaatatctatcaatttaagggcaaaagaataagcagtagccttagctgagaattacccagctgctcaattacttcattttcaaaatgtccgttaaagggggtaacagcagagagaatgtctgcaattaccatctaagttttgatatgagaaataggcttgctgatgactgggtttcaagtagagagttaagtagtccttaaatctcatattctcacctattctaaatctgaatagaaataatgcaaatgctaaaaatataggcttttgatggaa

SEQ ID NO: 159352 - DNA, 561 bp, Homo sapiens
actcacatggttgtgctactgaaataagacacaagtagagagcgaaaggccacatgaaaccatgggaaaacattacagctctctctaacactgaagacttatttcaagcctccttttaaaaaaaatcacttggtaacagctttattatctgaagacaaaaacagagcttaaaattcacttaagcactcgatcttgtgctcttgtgctctatcaatattttatcctttcatggccacaaattttagaagcaataaaccaaaggacaactttcacatatgctgaaagtgtctacttaaccttaacaagttgtttctcatataacaatatagaaataatttgagaactgtcacagtgtgtctaaaaaacactttagtttcatatttaagtacaaaatattctacaataatttttaaaaacaacaataactagttagcaaactgaaaaggactttaagtatccttgaatttcagctagagatattttctaaaatgctataatgatcacatctaaaatataatgttctttggtccattgctctaaatgataaaaaaaaaatctcac

SEQ ID NO: 159353 - DNA, 656 bp, Homo sapiens
gatgttctgaatgccagtgtccacctagtggagccttttctttcgtcacggagaaaaccagggcccagcttgttaagcaagttgcccacggtctgattagagcttggcctcgctgcctcacatcaccctccttgaactgctaagagccccatgctcctggtctctgctgggatagttctggctcaaaacccagccctgacgaccttcttccagagactcttcctcctgtcccccaggtggatgcagaggcccccatctgggctttatcacagcacttggcatggtatcaccctttgctcacattcattcatgcacattaaatatttagtgcccaactataatgttcctgggactgtactaggagccaggaatacaaaggtgacaagaaagagtcctgatgtgtgcaggtttcattacagtgtgtctgtttgtctttaggacactgcaatctccttgctggtggaaccctggcctcggccatctgtgtagcaatgcggcaggtgtgcaggcatgcggcaggtgtgcagcaatggctgcctaaaatgtatacctctatggctacgatccattaccccacagttgtactggactccgacccatcctaagagcaaaatactgaacccagtattgcatgagacatggtattccctaacccc

SEQ ID NO: 159354 - DNA, 154 bp, Homo sapiens
acttttggatgtagcttatttattctgaaagtctaataactttgtttattagttctaatagttttttgtaaagtcttaggcttttctatacttcagatgttgtatagaaataaaagattattatacagggataatttacattccttttttccaa

SEQ ID NO: 159355 - DNA, 113 bp, Homo sapiens
gtcctagaaaagaaatggttttcttgcatcttccagcttccttgttcatgtctttttctatcttcaatggctgatcaagcccttctcgtgacgtcttctctctggttctgacg

SEQ ID NO: 159356 - DNA, 409 bp, Homo sapiens
ttatcatccacactggcacctttttgagagaggttggggagcaggtaattatgctgggacaataggcgtatgtcaagatatctggtcaccctatctatgatctgtcacacttagtactttctaaaattctcgggcctttgcaccttctttttatcaacacttagttctatgttactgaatatttcttaattaagtgcaggaaagaaaataaccattttttctccttttaaagaagcacacacacctttcttttattggtattacattccttttcccagttggtgcccctgttggttttccaaattgtcttcccatccttatcctacctcccaatagagtacctcatcctatagtgttattataactacagaaaatatattttcattccttccacttcatgctttcagct

SEQ ID NO: 159357 - DNA, 285 bp, Homo sapiens
gttgaatcaaatatctaaataaagtgaatctggaacatcctagtgtccacatcaaaagcactcaatgaagttggatgggggagtggtagtggtggtacagcaacagggtagcctagttaggttgcacaagcccatctaaacacgtgtgattatctgattagaaccaggaaactggttactagaaaaagtaatttagtgaactgtagaaagaaaatattacatattgaagcacctcacaatgacttaacaccaattttatttgaggaatttctttagtgttaaaat

SEQ ID NO: 159358 - DNA, 301 bp, Homo sapiens
acaaatgtaagcctttaccctaaggagtgtatttttgtctctttatgtttgctgtctgactgatgctttcccaagaaagggagaaaggaaaaggggagggtaattaagtgctttgattccaaaggctttctcttctagctgctgctaggctaggtgtagagtaagagcaatcagtgacgataaagacatcagtcaaggagttaagtcagaagacgtttcaagatgacagtaaatcaaagaactgcagataacagacagctgactgtttaggggcttcaccagtgcacaaccgacagaagag

SEQ ID NO: 159359 - DNA, 355 bp, Homo sapiens
gtgtatcaatatctatctatctatctgtcaccatattaatatctaagagattaaaggagcaaacattaacattgtcctactaggtataatggattttagcctgagtatcctaggctgcatctgctggaaagcagagcctgatgcacagattataatgttgacacttcgaggggtataaatccaagcagtgattgaggaaaataggtgatgtgaggcaagaaaagatgtacagcgattgtgttgctgtgctggccaccacttccgtacaagttcagagacattcagttgcaaagacatttaagcatattccctctgcttatgggaacttttctaaaaggtttgtaagaggaaacgg

SEQ ID NO: 159360 - DNA, 400 bp, Homo sapiens
atcagtcggcccggttacccaggctgtggtggaatggggtgatctcataccgcaactctgcctcccaggttctggcgattctcccgcctcagcctcccaagtagctgggattacaggtgcaggccaccacgcccagctaattttttgtattatgtagtagagacagggcttcacctgtgttggtcaggctgacctcaggtgatccgcccgcctcggcctcccaaagtgctgggattacaggcatgagccattgcgcatggcctatcttctcatagtttctatgggttaggagtccaggcacaatttaactggttcattaccttaggtcttacaggctggagtaaaggtctcatctgagggcttgactaggggagattccacttctagccttcctaagggc

SEQ ID NO: 159361 - DNA, 752 bp, Homo sapiens
gagttccgtacagggatatgtacatgggtattcattgccatattatttgtagtggcaggaagttggtgacagcctgtgtgttccacatatcagtctgaatgtagataagtaaaatttgtgagtgctcatactagcttttctagtgctaccatatcaaactgccacacactgggagcttgaaacaacagaaatttattctcttacacttctgtttaaaatcaaagtagcagcagcaccatgattctttgagaatctgggtagaatctttccttgcctatttgtagattatggtagtagctgttaatccttggtattccttggtttgcagctgcatcacttcagtctctgcctcttgtcacatagcattctccctctgtgtttgtcttcacattggcactttcctctttttatgaggacactagtcctattgaattaggccccaccctaaagacctcccttaacttgcattttcaaagaccctatttccaaatatggccacgttcacaggtatcagggattaggacataataccattttaagaggcacaattcagcccacacacagagactatgtagcaatcagaagcaactctttagatttatgggtagtacagagcagaaaacttaagaagcagaatgagatggtaagtagcaataacactaatttaaaaatccatgtgtattagggttctctggagaagcagaactcaataggctatattcatagggagagagagagacactcaggagagc

SEQ ID NO: 159362 - DNA, 192 bp, Homo sapiens
caaattatattttattgtaatcatttgttgactatataaaggatttttttacttcactataagcaatagattgcttttctctacagattaatgcaatttttcatctcagatttcaaaattgagtttttctacttttgtggatttttatactttttaagctaagtaaaggaacaaataagtagtaacactcca

SEQ ID NO: 159363 - DNA, 368 bp, Homo sapiens
aaatttgagttttcttcttagtctgcttcttactgctgttttgccaacatcttctgtgctttcttacgtaagctctctctagtagaaataccattttcttacctgacatttactctttccttcaaggcttagctgaagtctctcacctccatcacacagtattctcagactggagtaatttatattgtaaatatgacattattatctgcacagctcactttgcaattaatcatcctgccttcagtgataccaaggaggccttttctgacctccttcagggagagtcaagttcccattctctgtgttccaatagcaccttacctgtcccacagtgcttacctgttgtagcacctagtacactgcattgt

SEQ ID NO: 159364 - DNA, 259 bp, Homo sapiens
agcacagttctgacacatagcaagggctgataaatattagcaattattctaattactgctgggattctgacactgttggagcattgcccacaggagattgcagtcttgttgaggaaacaagataaaacacataatatattttaagaaggaaaccattcagaatcaaatgttcaaatataaagatatgagcagctctaagttattaaattttcctagtatagtacttcctgtatcataaaaagattttgaatattcatgc

SEQ ID NO: 159365 - DNA, 284 bp, Homo sapiens
ccaaaacactccctccgctcccacttcacttagagtcaaggccaaagtctccactcaccatggcccaccgcagttggattctcagctcctccctgctcccaattcccatctttttcctcctccctccctcctctgcagccaccctagccacaccagggtcctagaatctgttccctggagatgtccacgtggcttgctccctcttctcctccaggtctctgctcagatgccacctcctctgtgttgaaagattcctttagtccacttaatttttcatctcagtg

SEQ ID NO: 159366 - DNA, 322 bp, Homo sapiens
cgatcgagctcggcccgacgtatctctgggggggagggtaggtaggagtggagacccttaagtagtatcagcactgttgtctgatgggagtgtgaatctgaacacatgaagctccagtctcagtagaacagtaagaaatcctaagtaaggccagccgaatgttttgttttttaagatggaagatatcccagcactttggcaggctgaagcaggtggatcattccagcttgggcaacaagagcgaaactctgtctcaaaaaaaaaaaaaaagaaaagaaaaaaaaagagagaaagaaaccctaggtaaaagtctgagccccac

SEQ ID NO: 159367 - DNA, 222 bp, Homo sapiens
tagggcaggtggaaggggtgatcatagcaggcagggcaaatagaatcctaagcgtggaaaactgccccatgaagactcagagactttagcagctcgatttgtttagggagttcaagcagtgtgatatttgggactgataagttgggggaggggtagaggatgagggtgaaaagttgtggtggaaaggaagagcatattatatttgctgtcttaggtgttatt

SEQ ID NO: 159368 - DNA, 851 bp, Homo sapiens
taagaactcaatagttgatatctactagcgtagtttaatgataagtatagcaataataaatatttatttaatgctaaacatgtttcaaatgttgtgttatgaaccatgatttttttgaaaaaggagtaactcctgacattgaagagcttatatttcctggtaaacagcgcagatatttaagtgataattacaatataatgtgataactacattcctagtaatactatgatattttgtgagcacggataatgtgttgctttaaaaagataatcagcttcataaactagattctaaattaacaagcacagtgctaacactcccctgactgaacagttatacaaaaggctaagggtcttagaatttattgtctttcttgctgaaagatgattctaataacaataaggttttccccctcctataattttgtgtttccaaaaacaaatggtgaggaaacaatagagtatgtttaccctttctggactcagggacagggtctctaatttggtctctgatttggacagctgctatttgccttagaccttttaggttgtgtttctaaagactgaggctaaattgaacatgacagagaggattcaggtgaacagattagctcatctgtcttccatcaggaaactgtgcccacagaggagacatttctcttcaagactgtgtacgtaaatcagtagcagtagtaagcttttatagggggaaaaaagggggccttacagggaggctcgaggagggattaagcagaaagggaaaggtaaaggccaagcgaaaaaaagccaaatggaaaggggcgcaaaaaagggtgacgaaaacaaagggggggacccaccggcgaggctaga

SEQ ID NO: 159369 - DNA, 251 bp, Homo sapiens
agcaaaaagggaggcattaaaaatatgcaaacagagaataggggattacaacaaagggttaacaggaaagagttgaaagctagtgtaagagtcacaaccactgactgatgaaaaactttgctttcattccatgcatttgacttgtaaccatgcaggtaatggtttcatgttgccatgaagtattaatatatttagtagctttgttctctccaatattattagtttattctaaaaagaggagtacatttttc

SEQ ID NO: 159370 - DNA, 413 bp, Homo sapiens
ttccaagccaaagaggttttcagtcccacccactgaaatcatccagtcctttattcacctgtgtcaacccggctcggaggtgtggcctgcgagatccttcatgcaatcaagaagtcaggcctccacctggtcctgggggtcatctgaggcccgcagttttggaagaggaatgttttctgccagcagttcccacagacgggctggctccccactgtggggacatgcaccatgccctctgtgggcctctgtttttcatccctgaattcatcccccacagaatggttcagttgtcatatctagctatctaataagcttgagggcactgtgtcccctaggggatgcccacatgcctgaccatgcaggctgatgcagtgacaagcacaaagtatcgtgattatagttcctgctctcct

SEQ ID NO: 159371 - DNA, 445 bp, Homo sapiens
gtgacagaggcttataaaggtagaaatatatttatatttacttgaaaagtctgtgtaaactatcttgagattaaatggaggctgcaaaatcactgtgtcccagggctcctttgtcttgctctgctcttcttctatgcagtttctgtattgtgggcgaggatggttaccattgtgtctgctaataagaagaaaaagagaagggcattctctttacctttaagaggagtttgtgtatatcactttcactcagatccctctggctctaactttgtcacgtcacaaccagttgcaaaggaggctgggaagtgagtgactctgacctaggcagccatatgttgcacttaatttttattactgcataagaaggagagaacagattctggggagatagccagctatctgtcacattaaggtttgagtcagatttattttcattaaaaaaaaa

SEQ ID NO: 159372 - DNA, 317 bp, Homo sapiens
caaagcaggataaactcaaagagatccacactgacacacattataatcaaattgtagaaagctaaagacagaaaagcagcaagagataagtgattcatcctgtacaagggatcttcagtaagactaacagttgcttatcagaaatcacggagtatagaaggcagtggtggtgtgctgggcatggtggcatgtacctgtagtcccagctgactgaggctgagacaggagaattgcttgagcctgggaggtggaagttgcagtgagctgagatggcgccattgcactcccgcctgggcgacagagcaagactccatctc

SEQ ID NO: 159373 - DNA, 443 bp, Homo sapiens
accaggtccccactgtgtcaaggcggctgttaatactcaagtcccctcctccactcctgaacatgagagttaaacaaagtcagctacagtctcttggtccataacaacctagggaaagcaaactacagaaccacgttagaaatgcttcacgtcttttacctcaaaatacctttgtttagtaaccccactccccgacacaggccccatagctctgttttctgggttctgacaactagtgccctaagccagaggccaggccctaaagagacaacctaggcaggcttgagatgtttctcccacgacctttccaaatgattccagcagaaagccagacccgtctctactaaaaatataaaattggccgggcatggtggcacatgtctgtaatcccagctactcaggaggctgaggcatgagaatcacttgaaccctggaggcggagg

SEQ ID NO: 159374 - DNA, 311 bp, Homo sapiens
gattcccaggtgtgggatacctgcgtcctccaccttcctaggtaatgcctgtctgtctgtattgcatactctatctgccatggaccagagcctctgcttctcctcacctcattagtacttaccttgtttgatttagaagtctttgcctatctgaagggcttaaatggtatttcattatggttttaatttgcattttctggattacaaatgaggatgaacctgttttcatgcttatgggccatatgcatttcctctattatgaagtacctgttcaagtttcttgcccattttcagagggtagtttatctttt

SEQ ID NO: 159375 - DNA, 4142 bp, Homo sapiens
ccggccccggccccggccccggccccgccccggcccggccgggcagctggtaggtgccgtgcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatctttttcaaata

SEQ ID NO: 159376 - DNA, 2632 bp, Homo sapiens
ccggccccggccccggccccggccccgccccggcccggccgggcagctggtaggtgccgtgcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttgg

SEQ ID NO: 159377 - DNA, 800 bp, Homo sapiens
cgacccacgcgtccgccacgcgtacgcggacgcgtgggtcgacccacgcgtcggaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatctttttcaaata

SEQ ID NO: 159378 - DNA, 373 bp, Homo sapiens
  misc_feature (6)..(6): n is a, c, g, or t
acattnaactaaaacccctacgcatttatatagaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatctttttcaaata

SEQ ID NO: 159379 - DNA, 269 bp, Homo sapiens
gcacgaggtgctctagtgtttttccctgagagaagcgtaagacaaacagaagtcaaaaagtagtcactgggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatctttttcaaata

SEQ ID NO: 159380 - DNA, 673 bp, Homo sapiens
gtgggatgccctggctgcatgaatacggcacgagcttaaagatataataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggagtgaaaatatggagtcgttacaattgggaagtcaagcattcgtatgtccacggagatgggaccaattgcttctaaatgaggagggggaaatggatcttatgtgtgggatctcgggccgtctttaatagacctagcgaggggaggaacgactttggtgaaaggaaggagtctaaatctaataggaggttcccggtggaatgaacttttctcgaataatgtcc

SEQ ID NO: 159381 - DNA, 448 bp, Homo sapiens
  misc_feature (421)..(425): n is a, c, g, or t
  misc_feature (443)..(447): n is a, c, g, or t
ccggccccggccccggccccggccccgccccggcccggccgggcagctggtaggtgccgtgcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggnnnnnaatccttccaacctcgannnnnc

SEQ ID NO: 159382 - DNA, 4088 bp, Homo sapiens
ccggccccggccccggccccggccccgccccggcccggccgggcagctggtaggtgccgtgcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtagaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatctttttcaaata

SEQ ID NO: 159383 - DNA, 3894 bp, Homo sapiens
ccggccccggccccggccccggccccgccccggcccggccgggcagctggtaggtgccgtgcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatctttttcaaata

SEQ ID NO: 159384 - DNA, 4088 bp, Homo sapiens
ccggccccggccccggccccggccccgccccggcccggccgggcagctggtaggtgccgtgcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggcaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatctttttcaaata

SEQ ID NO: 159385 - DNA, 4088 bp, Homo sapiens
ccggccccggccccggccccggccccgccccggcccggccgggcagctggtaggtgccgtgcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaattaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatctttttcaaata

SEQ ID NO: 159386 - DNA, 3668 bp, Homo sapiens
tcccatgccaataacctccagaatgaaggattttttttagagaggtggggatatctaaaggtttttatgacgcacggctgtttgcaggctctaactaaaggaccattgtttatttgatgttgatttaagtagtggatccttagagatagtggtatggcggtcttgaattgtatcaaaaatcttggttttctctaggcaattttttgttccaattcagttgaatactcttcagtggattcagaccatgaaaaaataagtcaccaggggaggatagctgaaataattcctaaggcggtgcctgttttaatggagaagatatggggtggagcctgcgttttaaacaaacccagatctgatgcaggatgtacttaactacgttgagaaaaactgatctgcgcaattgaggcgttactgaaatattaggtggtggagatttgagaataagggttttcgtcttttacctcatgggaactctggaagtccttttgttaggataaatcctaataagaccaagatagtactgtaaaatgaagtttaattatcatgggtccccgcttaagaaactgaagaacttattttctttttttgccccggggtgaataataattggtttactattgctttagggggaaaccttagatattttaatttaccttctctctggatagtagtgttgttaagagagcagaaacccatacttgaaaatgtgcttttcttttttgttttctaggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatctttttcaaata

SEQ ID NO: 159387 - DNA, 3614 bp, Homo sapiens
tcccatgccaataacctccagaatgaaggattttttttagagaggtggggatatctaaaggtttttatgacgcacggctgtttgcaggctctaactaaaggaccattgtttatttgatgttgatttaagtagtggatccttagagatagtggtatggcggtcttgaattgtatcaaaaatcttggttttctctaggcaattttttgttccaattcagttgaatactcttcagtggattcagaccatgaaaaaataagtcaccaggggaggatagctgaaataattcctaaggcggtgcctgttttaatggagaagatatggggtggagcctgcgttttaaacaaacccagatctgatgcaggatgtacttaactacgttgagaaaaactgatctgcgcaattgaggcgttactgaaatattaggtggtggagatttgagaataagggttttcgtcttttacctcatgggaactctggaagtccttttgttaggataaatcctaataagaccaagatagtactgtaaaatgaagtttaattatcatgggtccccgcttaagaaactgaagaacttattttctttttttgccccggggtgaataataattggtttactattgctttagggggaaaccttagatattttaatttaccttctctctggatagtagtgttgttaagagagcagaaacccatacatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatctttttcaaata

SEQ ID NO: 159388 - DNA, 4324 bp, Homo sapiens
ccggccccggccccggccccggccccgccccggcccggccgggcagctggtaggtgccgtgcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatctttttcaaataaaaaaaaaaagggggggcaaaatttccgaggcaagttaggtcccgttctggcaagggcaaggggggataaaagaggggggtaaagcggggaaggcgggttggggccctcgggggatgcacaccagaagggaatagtggacccttgggtgtttgtataataacacatatatatagaaggacta

SEQ ID NO: 159389 - DNA, 5301 bp, Homo sapiens
ccggccccggccccggccccggccccgccccggcccggccgggcagctggtaggtgccgtgcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatctttttcaaataccgaaaaaaacacaaacaaaaaacaacaacaaaaacacaacactgtggggggcgaggcgcgcgcggcgcgcccgggggaaccaggctttcttagggacacatatcgaggagaggggcgacgcgggggcccaaaaaaaaggagaagagcggagacactgtggcgccaaaacgagagagtgatagaacacaaaggaggaatacagagggagaaaagagacaagagggcggcgggaaatatccacaccacaaaaaaaaaaaaaaaacagcccccgcgagggggagaaacaccaagagacagcatattagagaaagcaaagaaaccaacagagaggagagaaagatcagaggaggggcaatatcgaagggggagcagtacaaatctaaaacagagagacaccaaaaaggagaagaccgcgccaaaatacaaaaaaaaatataaagcgccccacccgagcggggagggggggaaaaaaaacaaaaaagaacaaaaaaaaagacaagagaaaaagcacagacacgacaagaacaacacgaagaaacaaaaaaaagaaacagaaacgaaaaaaagcaaaacaagaacaaagaagaacaatcaagaaggggacaaaaagacaagcagaaaacggaggaagacaaaagataggcaagaagaaggagaagaagagaagaaccaagcaaaagaaggggagaagcgcgaagaaaagagaaacgaaaaggagaggagaagagaaagagggaaagaagaacaaaaaagaatgaaaagagcggaagcaaaagcaaaagcgacagggagcagcaggaacggagacgcagaagaggaaaaggcagcggagagagaaagacgcgggaaagagaggaaaagaaaagagacggggggggggcagcagaggagacgaaacgaagaagacgagaaacggacacgaacaggagagaaacgaagagaagaaacgccaagaaagaggaaagaagaacgagcgagagggcagaaaaaacacaacaagacagaagaaaggtaagagaacaaaaacaaaaaagaacaaaacgaccaaggaaaagaggaaacaagagaagaagggatgaagagacaagacaagaagacgagacaggaaggaaacaacaaacagaagaagacaagagagacggacaggccaaagagaga

SEQ ID NO: 159390 - DNA, 4555 bp, Homo sapiens
ccggccccggccccggccccggccccgccccggcccggccgggcagctggtaggtgccgtgcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatctttttcaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccttgtggcccgcttggcccaagcgatttttaacttgggcaaggtttatcattgcgcccgaatttggggctaattggccaatttgcccttatggggggcggtttaccattcaatggcccgcgttttaaaaccgtcggacttggaaaaccctggggttcccaaattaatcggcttggaagaaaatccccttttcgcaagttggggaatttccaaaaggccccgacccgatcgccttttcaaaacagtggccaaccctaaagggcaaatggaaattggaggcgttaatttttggtaaaattccggtaaatttttggt

SEQ ID NO: 159391 - DNA, 4177 bp, Homo sapiens
ccggccccggccccggccccggccccgccccggcccggccgggcagctggtaggtgccgtgcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatctttttcaaatagcctctttttccttccctctcttaggcaaaccttt

SEQ ID NO: 159392 - DNA, 2232 bp, Homo sapiens
gaagtcagaaggacatatctagaatagtgttattcgaagccacacagatcacccttcgtgtcttcaattctgaggagctgcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatctttttcaaata

SEQ ID NO: 159393 - DNA, 4099 bp, Homo sapiens
ccggccccggccccggccccggccccgccccggcccggccgggcagctggtaggtgccgtgcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatctttttcaaata

SEQ ID NO: 159394 - DNA, 4092 bp, Homo sapiens
ccggccccggccccggccccggccccgccccggcccggccgggcagctggtaggtgccgtgcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgcctttcttttggataaaagccgttttaactgaagtgggataatatctcattgtagttttgatttgcacttatttgatgatcagtgatgttgagcaccttttcctatgcctgtttgccatacttatgtcttctttggagaaatgtgtatacaagtattttgcccatttttaaattagattgttagatttttttcctgtagagtcgtttgagcaccttatatattctggttattaatcccttgtcacatggggagtttgcaaatattttctcccattctgtaggttgtcatttcattttgttgattgttcccttcactgtgcagaagcttttaaacttgatatgatcccatctgtccatttttgctctggtggactgtgcctgtggtttagtcggggatcctctatc

SEQ ID NO: 159395 - DNA, 4184 bp, Homo sapiens
ccggccccggccccggccccggccccgccccggcccggccgggcagctggtaggtgccgtgcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaattaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggttggtttatgtttggtttggtttttgttttttttggtggggttttgttttgttttttggtgtttttgtgttttgttgtttttgtgtgtgtttggtttttttttgatagtttgtgtggttggtgtttgtttatttttgtgtttataataatgttatatttgtataaggattttgtattgtgataaatttatgataatataatgtttttagataatttatatttaataggaatgtttgttattgtagtttttatttagtgtttttaaattttttttatatttgtagttttgtatggataaaggttatattatgatgatatgtatagtttaatggttggatttttatattaattttgatgattttatttatgtagtattttaaatttatttttatatatttttgtattattttttatgatattgtatatatattcc

SEQ ID NO: 159396 - DNA, 3376 bp, Homo sapiens
ccggccccggccccggccccggccccgccccggcccggccgggcagctggtaggtgccgtgcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatctttttcaaata

SEQ ID NO: 159397 - DNA, 1298 bp, Homo sapiens
gcgcggtaccccacaccacctgagtcacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatctttttcaaata

SEQ ID NO: 159398 - DNA, 1100 bp, Homo sapiens
ggctacccagaggtccctttctctgatcgccattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatctttttcaaata

SEQ ID NO: 159399 - DNA, 1013 bp, Homo sapiens
ctgctgcggtcgactctgaggacccctgccagagaccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatctttttcaaata

SEQ ID NO: 159400 - DNA, 2753 bp, Homo sapiens
ccggccccggccccggccccggccccgccccggcccggccgggcagctggtaggtgccgtgcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaa

SEQ ID NO: 159401 - DNA, 1014 bp, Homo sapiens
aggatttctgcagaaatcccccctttttgccaaaaaaccttaagaattttcaaaggaaagagggggcttttaagctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatctttttcaaata

SEQ ID NO: 159402 - DNA, 938 bp, Homo sapiens
ccgaggatccggagatgtcacgaggcgtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatctttttcaaata

SEQ ID NO: 159403 - DNA, 2877 bp, Homo sapiens
ccggccccggccccggccccggccccgccccggcccggccgggcagctggtaggtgccgtgcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtcctcactacatgccatggggatccatctagagtctacaccag

SEQ ID NO: 159404 - DNA, 378 bp, Homo sapiens
gcggccgcttactactactaaattcgcggccgcgtcgaccgaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatctttttcaaata

SEQ ID NO: 159405 - DNA, 642 bp, Homo sapiens
ccggccccggccccggccccggccccgccccggcccggccgggcagctggtaggtgccgtgcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgcttcccgagaggctccggctcgtacccg

SEQ ID NO: 159406 - DNA, 1428 bp, Homo sapiens
gcacgaggtgctctagtgtttttccctgagagaagcgtaagacaaacagaagtcaaaaagtagtcactgggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatctttttcaaataccgaaaaaaacacaaacaaaaaacaacaacaaaaacacaacactgtggggggcgaggcgcgcgcggcgcgcccgggggaaccaggctttcttagggacacatatcgaggagaggggcgacgcgggggcccaaaaaaaaggagaagagcggagacactgtggcgccaaaacgagagagtgatagaacacaaaggaggaatacagagggagaaaagagacaagagggcggcgggaaatatccacaccacaaaaaaaaaaaaaaaacagcccccgcgagggggagaaacaccaagagacagcatattagagaaagcaaagaaaccaacagagaggagagaaagatcagaggaggggcaatatcgaagggggagcagtacaaatctaaaacagagagacaccaaaaaggagaagaccgcgccaaaatacaaaaaaaaatataaagcgccccacccgagcggggagggggggaaaaaaaacaaaaaagaacaaaaaaaaagacaagagaaaaagcacagacacgacaagaacaacacgaagaaacaaaaaaaagaaacagaaacgaaaaaaagcaaaacaagaacaaagaagaacaatcaagaaggggacaaaaagacaagcagaaaacggaggaagacaaaagataggcaagaagaaggagaagaagagaagaaccaagcaaaagaaggggagaagcgcgaagaaaagagaaacgaaaaggagaggagaagagaaagagggaaagaagaacaaaaaagaatgaaaagagcggaagcaaaagcaaaagcgacagggagcagcaggaacggagacgcagaagaggaaaaggcagcggagagagaaagacgcgggaaagagaggaaaagaaaagagacggggggggggcagcagaggagacgaaacgaagaagacgagaaacggacacgaacaggagagaaacgaagagaagaaacgccaagaaagaggaaagaagaacgagcgagagggcagaaaaaacacaacaagacagaagaaaggtaagagaacaaaaacaaaaaagaacaaaacgaccaaggaaaagaggaaacaagagaagaagggatgaagagacaagacaagaagacgagacaggaaggaaacaacaaacagaagaagacaagagagacggacaggccaaagagaga

SEQ ID NO: 159407 - DNA, 4089 bp, Homo sapiens
ccggccccggccccggccccggccccgccccggcccggccgggcagctggtaggtgccgtgcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatctttttcaaata

SEQ ID NO: 159408 - DNA, 4493 bp, Homo sapiens
ccggccccggccccggccccggccccgccccggcccggccgggcagctggtaggtgccgtgcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggtaagggggttcattaatcgccaaggcctcactcccttttttccatctctccccggactcacccgccaagggtgggttggaaaccgaaacgagtcagtgttgaaacgtgtctcatcctattcctgaagccagaatattctggccatgagtcattgtttccgcccatcttgattcttttggaaatggcagctcttgttcaaagaccggaaagggtgggatgtcaatttcaagtggggtcaacctgagttctgtaaatcccagtagcgattttcccgccgcgggtgggcaggcgaatcttgcgccggtttagacaaaggaggccgtgaggacctgcatgcttttctttctcaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatctttttcaaata

SEQ ID NO: 159409 - DNA, 3220 bp, Homo sapiens
tgagagtgactctacaggacctaacgtcattcttgcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatctttttcaaata

SEQ ID NO: 159410 - DNA, 4177 bp, Homo sapiens
ccggccccggccccggccccggccccgccccggcccggccgggcagctggtaggtgccgtgcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatctttttcaaatagggataccaggggtaagatcctgctagagtcaccg

SEQ ID NO: 159411 - DNA, 2548 bp, Homo sapiens
tcatacagcatacgtttggagcgcgtgcccagtcaggtaacatgaacatggctcgtagtggtaatcataagagatacctggtgcactagatgtacgctgctgtgagaatatcttcaccacagattaaataagaacgtcactcgagctgggtaaagcccgacgacgtatctggaaccaaggtcacagcattggacgctcctgacgtgatcttatgactggcactctatactaactatggagatccaagtcgcagcgtcgtatatcgaattacgtcccggtcagatttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatctttttcaaata

SEQ ID NO: 159412 - DNA, 3896 bp, Homo sapiens
ccggccccggccccggccccggccccgccccggcccggccgggcagctggtaggtgccgtgcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaagggaaacaccggtgtctccctttgtctcagacttatttcccttgcagtcatgtaaagtggattgcttctgggacagaaaggatcatgtccttgccctctcttttctgccagctcatttaagtcctttgccattctttctttacgtaatcttgtcatccaggcttgaatctctcttctattcttgtcagt

SEQ ID NO: 159413 - DNA, 3878 bp, Homo sapiens
  misc_feature (3624)..(3624): n is a, c, g, or t
  misc_feature (3714)..(3714): n is a, c, g, or t
  misc_feature (3718)..(3718): n is a, c, g, or t
  misc_feature (3720)..(3720): n is a, c, g, or t
ccggccccggccccggccccggccccgccccggcccggccgggcagctggtaggtgccgtgcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaagggccccaatttccaaatcaatanggatgactggtgaaatacagccagggacctaagtggaaatttgggcttggggccattaaggcttaagacaacccaaagggttttggggtngtancnttggttgctctctatggcccctttcccttccctttatcttctttctcttttctcatcatcccttgctcctcattatattctttctcctttcagtactccacttcttttccttagcttctctcttcatccccctccttctctccttcttccccctcccg

SEQ ID NO: 159414 - DNA, 3309 bp, Homo sapiens
ccggccccggccccggccccggccccgccccggcccggccgggcagctggtaggtgccgtgcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatctttttcaaata

SEQ ID NO: 159415 - DNA, 3117 bp, Homo sapiens
ccggccccggccccggccccggccccgccccggcccggccgggcagctggtaggtgccgtgcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtgaaagtctccgtcgactgggatcactctagatcgaccacaacatg

SEQ ID NO: 159416 - DNA, 3166 bp, Homo sapiens
ccggccccggccccggccccggccccgccccggcccggccgggcagctggtaggtgccgtgcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccttgtggcccgcttggcccaagcgatttttaacttgggcaaggtttatcattgcgcccgaatttggggctaattggccaatttgcccttatggggggcggtttaccattcaatggcccgcgttttaaaaccgtcggacttggaaaaccctggggttcccaaattaatcggcttggaagaaaatccccttttcgcaagttggggaatttccaaaaggccccgacccgatcgccttttcaaaacagtggccaaccctaaagggcaaatggaaattggaggcgttaatttttggtaaaattccggtaaatttttggt

SEQ ID NO: 159417 - DNA, 356 bp, Homo sapiens
agtaaacttacatatctgctagattcagaaagcactgaaactagactaacaattcatcagcagttaagtaagcactttactgtttcccttatatttccttcctcctcctctctctcaacccaatttaatggggtctgagactgaggctagcctagagaagaaaaggggtgaaggaatactgaggagaaagagggaagctgaccactctccttccatgactgcagggctggggcaggcccctgttggaggagggaagaaagctcaattctaaatcaactccagtgtttttgctagtacataatgctggacgtttcaggtactgaattatctggtgtttttaacctgaatgttttgtt

SEQ ID NO: 159418 - DNA, 447 bp, Homo sapiens
aaccgacaaaattgtgatgctcgttagccgcgtgttaaagtgtgactgattccaatgtacaagagtccacatgaagtcattctagtagtaaatcgtcagatcatatctccaagtcgtgactagcacagacctagcagtaacaattcatcagcagttaagtaagcactttactgtttcccttatatttccttcctcctcctctctctcaacccaatttaatggggtctgagactgaggctagcctagagaagaaaaggggtgaaggaatactgaggagaaagagggaagctgaccactctccttccatgactgcagggctggggcaggcccctgttggaggagggaagaaagctcaattctaaatcaactccagtgtttttgctagtacataatgctggacgtttcaggtactgaattatctggtgtttttaacctgaatgttttgtt

SEQ ID NO: 159419 - DNA, 606 bp, Homo sapiens
tgtactcttttttttttaaaacaaacaaacaaacaaaaaaaaaaccttccaagctctgtaagctttaggcgcccaagcccagctctgccctgctgtggcaagttttcgtttgggctacgatgttggtgccacatctgctgcatgtcctcagggggctctcatcccacagcagagatctgtcataggttagagccctccctacagaagcaacacctgaaaggcatccaggggagccagttctggggcaggctgaacctgcagcttcacttgccatgtaaattagagactggaaaggcttctctgacttcaatcttcctcttctgcaaaatggagataagaccttcctggaaaggttaaaataatgaaccataggtgaaactgcctggtctagccccaggcttgtcctgggagctcaggaaatgctgatgaaagctggatggagatggctcaggggagcccatgcctttcattgggatagtctgtcctgctgtctgtcaaattaacctgctgtgtgccaggcctggtattaggctctgggatacaagctgctggggtgaggtggtcagacgaatcaagaggtgaaagtggttataaactgtggagcac

SEQ ID NO: 159420 - DNA, 398 bp, Homo sapiens
agaagacgcaggagcaggagaagaagacatgggaccaggaggagaagatgcgagaggaggagaggatgcgggagcgggagaagaagatgcgggaggaggaggagatgatgcgggagcaggaggagaagatgcaggagcaggaagaagaagatgcaggagcaggaggagaagatgtgggagcaggaggagaagatgtgggagcaggaagagaagatgtgggagcagcagaggctgccggaacagaaggagaagctgtgggaacacgagaagatgcaggagcaggagaagatgctgggagcaggaggagaagatgcggggccaggaggagaatatgtggggccaggaggagaagatgtgggggcaggaggagaagatgtgggggcaggaggagatgcgag

SEQ ID NO: 159421 - DNA, 443 bp, Homo sapiens
acctctgcctgagacaccttacagctccgtcctgcttccatgtcattctgttccttttgtaaaatgtgaaccaggtctacagctcaatgtagcttaatgctatacctctataaggtttgttgtatgctaatccacaaatcaaagacaacaattccttctagaccctttaccctgatttggagttcaaaacaatacagccagcataatcagtagaccatatttatataccctttccttatatttgtgcttttgttttgttttaatggagagaaaaatcaacagtagaaaccacttacaagattacttactactgtagtgtggtataaagtaaaagattttacaaaattaaaaacatagtgatgggaaaatatggttagagtcaaacagtctgatttttttttaaggttgctggttacagatcaatgtcatgaacaaacagtaat

SEQ ID NO: 159422 - DNA, 100 bp, Homo sapiens
tctgcctgctctgcaagcctcattatccccattttgttaagtagctgggcctggagtccccacacaggttaagaaccacccaggggggaatgttatgttg

SEQ ID NO: 159423 - DNA, 426 bp, Homo sapiens
atcgagctcgagaccctcaaagcatgactccccgctagaatatttctatctggctattgtttttacttcttctttcccttatcatggttcattgaggtaagctagttaaatctcttggcccctttttctttacattcttgtgtgtctgtctctgtacccgctgtgtcatccttaattcagtatcaatggagaaatgccttgtccttcatcagtgcctatctgccttcaaaaccatcttgtcctcaagttttcccattcatctgttctcttcttcatccatgccagcacagatagtggatatcatctgtgtgccaggtactgggctaggaactggagctaaaaatgtagataggactgggcacagtggctcacgcctatagtcccagctacttgggaggctgggatgggaggatcccttgaacctag

SEQ ID NO: 159424 - DNA, 402 bp, Homo sapiens
tcctggcaaggtggaaatcaggatttgagccatgttgtgcaataaagtctccgaacatatttggcaaattagtattcctcgtctgcacttgcagcttatgaagattttgagcacagctttaagacagctctgaagttgggaagaactctggggtgcttttacctcatgggcagccacactgcctccactccaccttggaatcttgcttccttagccatctgaacacaagttctcttggttcagccagagccgggatcaggccaggaggttggctggtgacactgaagatgggaatattttccacaaagctgagaagtgatgaagggcttctggctcaagaaaatgtatgttcacattaaaaattcaaaactctcctgatttccacctgtcagggatttttaa

SEQ ID NO: 159425 - DNA, 412 bp, Homo sapiens
acccctcttgcctctcctaaatcccttgggaggtgtccccatgccctacacactgcctgctctgtcacctcaccaccctgcaaccagctgggctggctggttttcactgctgggaggtagatttttttttcaagaagtatgaaagtatcattggcatatagacagacctctgcactcagctggaactgggttttgaatcgcagcttcaggactcaataatgttgtaaatctctgaacttcttggagactttgttttaggaagacaggaccctataagacaaagtccctctgtgaggtccagcacagaaggcatctctcaccagggtccctttcttttcccttttctctcagcctgattctgtgctttctttcttccttttcgttgttatttaaacttatgcatgtaatttca

SEQ ID NO: 159426 - DNA, 199 bp, Homo sapiens
catctgatcccccattaaaaaataataataattacatagacattaaataacataccctcttaatattatgtaggttatgactcagacttaactttcgaggtaagaataacatttagtaaattactcttcaaaaataaaaatattttccagagcagttacttcagatcagatcaagcccagtttcttttttctttttttt

SEQ ID NO: 159427 - DNA, 214 bp, Homo sapiens
cagtttgatgcataaccttctagattctcatgtttgcttttgtaaatatatacacataggtagagcagtctattggtttttgtcatgtgtatctgggtgttaaatgaaggagtgatgttctacaacttgcttttatgatttaactatgtcttaggccacttttcctcctcccagggaagagctcttctctatggttttgttttgtttttttgtt

SEQ ID NO: 159428 - DNA, 461 bp, Homo sapiens
tttggtgatgtccctctagagaatgtcacctattagctaactttttggctgtgttacctcacagctctgacatcatcttatttctgatgtgcaccatcacatagcaaaatgaaatttaagttttaaagttaaactagccagagtttggattctagttccataattttctcagaaagttatttagcttttctgaaatgtgcatctgaaaatgagattactatttccttcatcactgagttgttgtaaggcttaaataagataaatacataatgtagccatctagcacctagcaggttctcaatatatgtttttgaaggaatgaaggatgggtgactaactgatgaaatgaatgaccttctctgtctctagcatctgtttaactctctcattttaaagcctgatctcaggctgagaagctgtgagataggaacgaaggggaatatacatgcatttctgcaata

SEQ ID NO: 159429 - DNA, 548 bp, Homo sapiens
gtgtatcataatgttgcctccttttgagaagactgaaaggaaaagtttaatgtatttatttcatttccatcctcagagggcagcaaaaggagagtagttaaaagtgtctgtgatgatctactattaagtcaaaaggttgtaaatagttacaatcctaattttcttttttttttttaaacggagtcttgctctgtcgctcaggctggagtgcagtggcgcaattttggctcactgtaacctctgcctcctgggttcaagcaattcttctgcctcagcctccagagtagttgggattacaggtgtgagccactgccccggccgtctccaaacttcttatttaatttgatgactaatttataacaccaagaattgcctaccacttatcaggcatagtgtgagacactttacttcatctgtaatgctgtcaccaaaaccctgaaagttaggttttggttttgtttacacacaaagaagctgaaactgaaagaggtagtttatcgagcatcacagagctagtagctttgattgtaaaccaaatatgactgatt

SEQ ID NO: 159430 - DNA, 470 bp, Homo sapiens
gcttggctggcctctcgggggtggcttttcaggaggttaagcccccgacaggattgacttccacggcaaagttatcttaggaataaaacagcagggaagaagaggagaaaggagacttggccaccggcatggtcagcagagagtgagaaggaacgttagcctgtcatcgggatacttgctcctgcagaggatgaggaggctgaggccagagaaggctgcacaagtttgcccgactcaggtggatgtcggtaagcgtgacctgggtgaggtgtgaaacccagcagggagggccacacactctactgtcaccacctccagcacgggggctgagcacctgctgcaccacggacacatgcactgggagacaggggagccccaggtggctgggaccctcctcctgggttctagtttagcacctaataagagcattcccaagtgacgcaaacaaaaccccattgaccccagagatt

SEQ ID NO: 159431 - DNA, 351 bp, Homo sapiens
tctctttggatgccaaagagtgggaggggcccagcggagtggtggccagagtaaccccccgccatcccatcagctcagacaagggtcaaagcttggggccaagcccacggctcaggaagggtttgccaggcccccagatcccctctctctgagatagctgtgagcaccagtgttggctggggtgaaagccgggtaattttcctctaagctgtcctccctccgctcccctccctgcctgctggtgctggctgtgagcacgtctgcattccagagcttaggagagagagaacctgctgctgttaaggttgaggaagtagattgctaacagctgctgtaggaggggttggatgt

SEQ ID NO: 159432 - DNA, 395 bp, Homo sapiens
ctcttctctttttagatctctgatgacacaaatgttagattttttttttgttatggtcccacaggtatctgaggctttgtttgtttctcttttagtctctgttttttagactcttgtcctaactttagattgattcattctgtctttttactcttccattctgttgaaccatttattattttagttattgtatttttcagttctaaaatttccatttgattattttcctatttctatttaactatttctccttccttccttccttcctccctctctccttctcttccttcttctcttttctttcttcttgttcttgttcttcttcctcctctttcttctttcttcttcttttcttttttttttttttttgagagacagaatctcactctgtcatc

SEQ ID NO: 159433 - DNA, 411 bp, Homo sapiens
gttgatagctgactcttgagggaaaaaggacggcgagtgaagacccaaatttggcattagtttttgcttggggccaacaggtatctgaggctttgtttgtttctcttttagtctctgttttttagactcttgtcctaactttagattgattcattctgtctttttactcttccattctgttgaaccatttattattttagttattgtatttttcagttctaaaatttccatttgattattttcctatttctatttaactatttctccttccttccttccttcctccctctctccttctcttccttcttctcttttctttcttcttgttcttgttcttcttcctcctctttcttctttcttcttcttttcttttttttttttttttgagagacagaatctcactctgtcatc

SEQ ID NO: 159434 - DNA, 550 bp, Homo sapiens
ccaggtggtgatgatgccactcatccagggatccatttggagaaccactgctttagtaatgtttcctctagtctttgggctgcaaatgtttctcataaaccaaatttcagggaatgacaaaccaaagaaaggactggtaaggatctaggaaaactgcataagtcagaacaaagatattcaaaccttttcattatcttttttctccctttggcaatgggaacatcataggaacccaggaaacgttgtgcatagtatttggcagttgcaaggtctgagaaagtctgctttggagttgaaagtttcttaggatacaatattgtatgtaacatgaaatgttaaatttattttttaaaaaggatgattacctcattttgtgaacataaaaggaaaatacaaatgtgacttaaatgggattgaatggggttcttattttaaaaacttgactttctgacttgatgatttctgtatgagctttgtcaggagttcaagctcaaagcttacgttattgtgtgtgtgtgtgtttgtttgtgtgtgtgtgtgttaggatctc

SEQ ID NO: 159435 - DNA, 920 bp, Homo sapiens
gagaggagctctgaagagctctgatcctcatgatcctcccaggcgcattggtaggagggcaacctaagctggtccatcaagcttggtgaaatggaaccgaacccctactgtattctgctctttctactgaacagttctctgtttctggacttccagtctccggaaaagtcagaacagaatgccgggaaattttattagttatctatttatctattttgtgggccagattccatggtaattggcttccccagctaggttttctggagagaatgaggtattagtgaaaagtttctactagccagagatgtgtgttctcaggaaatcaagactgatatattctggccactttcctgtcagctcccacacatgtaatgtacactgtcaacaggataccaaattcaggaggcagaatgtggtcttacggcctaaggtagaagcctggggttccacctgccttctggaacccataaggtattctctctagtcctgcattggctcctctctcatgctttccctgcctccccctccactcccctctcttctcacattcctgtgaacggaatgtagcttaatgcacagggtggcaactggaggatttgttggtggcacttctctccatttccttttctgtccttcctcctgctccctccccagctttcctgttactcatcttcaagcctccacttttcttcttgactttaggtattccctttactccctggtccacaactgctttagtgacggggcccctctctatgactgtttctcccctgtcaccccccagaagtcttaaggcactacgggtgaaacccaaagagttcagccacagccttccactacctcagacccagcccggcccaatcagagggagaggaagaactgctggtgaagggttctcctggtggggcctgttatcccca

SEQ ID NO: 159436 - DNA, 548 bp, Homo sapiens
gaaagtgggtcctgagcagataagagcaaggctgcgactccagggaaggcagtggacttcattctatcagcagtggcaactaatggcccagcgaatctgaatcctggctttgtcaccaaccagctgaggtaccttggcaaaaatctcttctctccaagcctcagtttcctcatttgtaaaatggaaataataatggtatctgcctagtagggttgttgtagggattcacaaaaaggctctatgcccagactaaggtaatcactcaagaactgagaactgttgttactgagcaatggggagccgctgagggctcctgacagacagggacacaagcaaagctgggctgggaaagcgctgacccagctgctcaccttcaccacaaagaagcctgggactcaagaagagtggaaggagatcctggatctgggccagctgcctcattgaaggtttctttgacatctcctgttttatctttttttttttttttttggaaacgggttttggccccgtcccccggtgtttgtttgcgcgggcccattcttggccca

SEQ ID NO: 159437 - DNA, 713 bp, Homo sapiens
  misc_feature (600)..(600): n is a, c, g, or t
gtgaatcctacccttcccgtgtactgaagatccagcgtttagttctcctttgatttcctctccctctggccacccctgcccccaatcgtaaaaggggtcagtctgctcaggcctgctttgatgggaccccgaaggccaggaaggaactggtcctgggttttctaagagctgggggcggatggaattctcctgcctgcgggtctttaaagactgagacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaagtaagttgtttggaccctgagagtcacccagactcggtgcccactgaccctgatcttttcatctgtttttttctgcctggatccatgagggtcactcttctctctgatccccagctgggcccaaatgccagggccagttgcttgatcccttgctccctgtcctcactctgaggggtggtggctgttggaatatggcataagccggactatctgggaatgtgggggaggggaggctgtgcntgctcccttttgcactgtcatccaccaggcacccccctttgctcccgaacagctgctaaaggttagggggaaactgattggagaaaggaccagaatgtttgtatgtgtggaag

SEQ ID NO: 159438 - DNA, 632 bp, Homo sapiens
gtttctggtctttcagttccggcttaacttgcaacagagagaactgcagttagacacatggaaggccttcggtaaaagtggagaatcccaacctagtcccccaaagtagctggcagaggcggagctaggaggagggcagagtggggtcaggaaggccccagaagggtggggcatgtgggagaattctctcctctctgttcttcgacctctgggagtgaatcctacccttcccgtgtactgaagatccagcgtttagttctcctttgatttcctctccctctggccacccctgcccccaatcgtaaaaggggtcagtctgctcaggcctgctttgatgggaccccgaaggccaggaaggaactggtcctgggttttctaagagctgggggcggatggaattctcctgcctgcgggtctttaaagactgaggtaacgcagtaggggagggaaaaagggagggcgaggggagaagggaagaaggggagggcagaggggaaagggccaacctgggtccggcgagggctgcggggctgggttttaggaaaagaagagctaagaggcgggtctctggggctagagggcgcccccaggcgctggaggggaaataggcagaggggcctctcaaacctgtc

SEQ ID NO: 159439 - DNA, 291 bp, Homo sapiens
tgtgcccagccacatttatataatttattaccatatattgttatagttttatttttagttgttgttaatctcttactctgcctaatttataaattaactttaccatggatatacatatataggaaaaaacacactatacggggtttgatactctccctggtttcacacatccatgggagtcttggatcccccccatcagataaggatgacctaatgtatactcaaaataattgaaagcagggtctctaagagatatttgtgtacttagtgttcataggtatagcccattga

SEQ ID NO: 159440 - DNA, 171 bp, Homo sapiens
ccagcttcatttccgcctgagccagatgtgaggatggccgaagtaaatgcctcttggtcagcagcagccggcgcattggtaaacggcattgtcaccgcttgaacagaggaattctcagcagagcactttcccaggggaggtgccgtctgagctgccgcatcaggaagggtg

SEQ ID NO: 159441 - DNA, 328 bp, Homo sapiens
caggaacaccccaatctctggaacctttcctgaggcctccattttcaggaattttgttaggaatccagataacagaatggccatagtggtgattatgttccttctacctccttttcatcagcctcgctcaccttacccttccagacatgagaaaacagtttcactacaatatccagtagatttacctaattggtaaaataagaaaggccaaggaagttgctcttctcttcactcccacccctcctgttcattttgtttgtaacaatagagccaagtttcaaacaaatgtagaaaaggtgagcaatgctaatgatgtgtttcagatggg

SEQ ID NO: 159442 - DNA, 640 bp, Homo sapiens
gtacatggaaaatgcttagggtttgttgagtgaatgagcaaactgatactttgtaggagtggccaattttcaaatattttaggtaacagaaaacagtggtgaatcaactcaaaagatgaggtaccagtcaaatctcttcccttttgtcagtttctaagtagtattaaacttgagtgaactaagttttacttttttttcctttgctttgcttaccccttggtgagaggtaatggagaaaatatagacagagcaggaggaggaaagaaactcaatctcgaaatgactaagagcttgtggagcagcttgggagagaaccagctgggttattggctactctgtagttccaggtgtggggaattattctcatcaataccgtgaccgcctgccactcccctctgccctctttctttgtgttaattagagcaggggtctgcaaacattttctgtaaagagagtaaacaaatatgtcaggctttgtgggccaagagaaaacatcagcgacgttgtggaggtgcttacataacgacagacaaaacaaatttccatgaatttttatcgatgaaactccaaacatagtaatggggtacgattttctgtaacacaagtctgctaatgagaagaattgaattatttgagggag

SEQ ID NO: 159443 - DNA, 305 bp, Homo sapiens
ttggtgagatttcttccacaaccttcccgcaacagaccctagtgcttcctccagactcttttctaattgagatgcaaattaatctctctggctgattacacttcccttaaagctactgacaaatgcagctgtaaccagagtttgcggactttccaacaagtgacttcagctgtcagtatttgcatgctcagccaaggcccgcccgctcccagtctcagagccatggagagcttcctttaggcattacaagcctgttttatttatgtgtatacaatttacatacaattaagagttaaaaacaaaat

SEQ ID NO: 159444 - DNA, 399 bp, Homo sapiens
gccagaggcccatggcccatccatatcccgctggcctggccatgcaaacacagcaaaccacgcaacctctggccaagcctcattttccccacttgccatgtggagataagaatttctgtcctcctggctggatcctctcagggaagatcaactggatcaattagattagttggattatttttgtaaaatgaaaatcaagccagaagaaatttatgtattagtgctattctagcaagaactgacatactaaatgtccaaaagcacaatatcccagaaagtcactcaaacatactcttcccttattaatacttcaaaacaagattaaccctttggagccctggatcatgcccccaactctgggggattcaattattcccccatggtcaactctgatttgaa

SEQ ID NO: 159445 - DNA, 523 bp, Homo sapiens
cctccacagcaacttccttgatccctgccacgcacgactgaacacagacagcagccgcctcgccatgaagctgctgatggtcctcatgctggcggccctcctcctgcactgctatgcagattctggctgcaaactcctggaggacatggttgaaaagaccatcaattccgacatatctatacctgaatacaaagagcttcttcaagagttcatagacagtgatgccgctgcagaggctatggggaaattcaagcagtgtttcctcaaccagtcacatagaactctgaaaaactttggactgatgatgcatacagtgtacgacagcatttggtgtaatatgaagagtaattaactttacccaaggcgtttggctcagagggctacagactatggccagaactcatctgttgattgctagaaaccacttttctttcttgtgttgtctttttatgtggaaactgctagacaactgttgaaacctcaaattcatttccatttcaataaactaactgcaaatcactaa

SEQ ID NO: 159446 - DNA, 459 bp, Homo sapiens
aaacaattacaatggccctgcgcgggaacctccgtccattgcacttgctatgcaaattctggctgcaaactcctggaggacatggttgaaaagaccatcaattccgacatatctatacctgaatacaaagagcttcttcaagagttcatagacagtgatgccgctgcagaggctatggggaaattcaagcagtgtttcctcaaccagtcacatagaactctgaaaaactttggactgatgatgcatacagtgtacgacagcatttggtgtaatatgaagagtaattaactttacccaaggcgtttggctcagagggctacagactatggccagaactcatctgttgattgctagaaaccacttttctttcttgtgttgtctttttatgtggaaactgctagacaactgttgaaacctcaaattcatttccatttcaataaactaactgcaaatcactaa

SEQ ID NO: 159447 - DNA, 130 bp, Homo sapiens
gattacatgagcgaatccatgtagagtgcccagcatggagctggcaggcagggcacgggctgtgagtgttgctggggtgatggtggccatggtgaaatgggaaaaccctggagtcagggaacctggattt

SEQ ID NO: 159448 - DNA, 438 bp, Homo sapiens
aaggtctatactcctcatgtgtctcatgtggatagcagcaacacacaggccctgcaggtaccatggtgccccccagctactccagccagccttaccagagcacccacccttctaccaatcctactcttgtagatcctacccgccacctgcaacagcggcccagtggctatgtgcaccagcaggcccccacctatggacatggactgacctccactcaaaggttttcacaccagacctgagcaagccaggcctggttgcttctggttagttgaggtatatggaggtctcctgtgttaccctcttcccatgcatgtcccctcctggttccccttctttcagtcccagcctgaaacccaccatgtagctgctaagcgtgctctccagacaaggccagctccatccttccccgctggcccgcacggattttgaggacttggc

SEQ ID NO: 159449 - DNA, 285 bp, Homo sapiens
tggatacacaaatacttaccatggtaatacaaaggcctacagtattcagtacagtaacatgctacacaggtttgtaacctatgagcagcaacaggccatgccatatatcctatgtgtgtagtaggctatacaatctaggcttacctaagtatactgtataatgtttgcacaaggaaatcaccttacaacacatttctcagaatatatccccatcgttaagtaatgcatggctgtaggttaagacttaattttctaacagctaaagtacagaaacataactgattg

SEQ ID NO: 159450 - DNA, 1176 bp, Homo sapiens
tgacaccagtctcccgaaagaattagaggtaactgcttcctgtgttctaggagcctttcaagctaacagaaggtaatataaatataaggggtactgataaaaggaaatgtattaatagaccttttgaacatcaacttgttgattaaatctatcagtgcagtatatatacaaccttgtcagacgagtagctgacaaaggaatctccctagtacaacttgtagcagtactattataaagaattcctgacttgacacattttgatgaagttggttgaaataatttgttgggtttgttcaatttttggtgtcatttatataaaaagaataaagaagaatgtgaatggtaggaagtcaggggagaggcatggcagaaacattggtattcactagaacttgtatttttctagtgcatgtgaattggactcatttcacaaataacatttacagtataagtcactgaaatgcaaaaaaggaaagcagctaacacgagacatttatactttatgctcagacattctggtagtagaggagggctaggaccctagagctgtgtagtaaagaattgttgagtatcgttcagtttaggtaccacgaaggtggtatctcctgctctgccaccaatagaaacttgaagttaaaaagaaaagactctgagagcgctgatgctggagagatttggctgtttacccctctgggattggattcggtaagagtgcaattaattgccctgtaaccatagagccagaggagagggactaggtgctccgggctatgctctaggaggtgtgaggtgctttctatgctgtttataccctaggctaatcctatgaggtagatagtgttgggctttttttgtggatgatgaaacagagatgcaaagaagttaattcccttgttcaaggccacaaaattattaaatgaacactaggattcaaacctgggtctgtcttagatgactgaatctgcggaattttcccagctgttttgttagtcttgatccgtgtagatcatccttccaaaaacttgtgtttctaatcaagtttatgatctatagttgagcgtctgtactaaatgggtcgagtgattacatgggtaaatgaaattgatagaactcatatcattgtgctgaattccctagcaccatttaataagatgcagtcttgctgaagcacggcca

SEQ ID NO: 159451 - DNA, 499 bp, Homo sapiens
tcttaagaacccactttactacccctacccccaagtccccagaaaatactcttctctgaaacatagtcttctctctggaaaagtgggggcaggtgaggctgggaggtccactttggatacaagcctgagttgctgaaatgcgacccggccggcagacccattcaatacgccccatcgtccaaacatgcctgggtaggtaatggagacgaccataacagaaacgtgaattctaataaacactcggccaggataaaggccacttctgagcacgttagctctgtggttgagagaaaagatcggattcctggatcgatgcacagtcaagcactgcctccaccaatgacaggacggttcggccctttactaataatagcaagcggccttgtcctcgagtgttcaccagagtatgtggatgatgcttaggctaactagacggaacgtccaccagagcgcaccacgccatctgcccagccacaagcgcagctgcccggaaactggg

SEQ ID NO: 159452 - DNA, 276 bp, Homo sapiens
ggaattcaaaatgaacaaagagagtccattaatagtactttacactttaaatacttaggaataaattttgagagatgtacacaatctttctgtagaaaatgtaattatcttattagaagccataaggaaaatttagctaaatgaagagagacgtcaggtcctggatggaaagattaactactgcaaaggtatcctttctcaaggtaatgtaaacatttagagttagaatagtaattaagttaataaggttttattctaaaatttatttgctagtta

SEQ ID NO: 159453 - DNA, 818 bp, Homo sapiens
gagcatggaatctgataggcagctccatgatgctgtgtgattggcaggtagatcctcgtggggtagaagccatgtgttccccccacttccccagtcttctgagggggtctctcctgctcctttaggcaggatggggcattcttggcccactgctgcccccttgcggtctcataccttgtatcccgatggctgcaaacgtttcaactgcaagcttaaaaatgtagagtcggctgagtcctcaaagtgcccggggagagcacagaggcggtagagggttcaatgatttgttcaaggtcccagccgagacactggggagcaccctgcttcacagctgagactcaaggactggggggcctcaggcctcctgccaagaaaggcagtacagcctcaaagtacccctttctggaagagagagaagtacatttactgagtcctgctgtgtcccatgacagctaaactaaccacaaggatgacgatccctttttatagatgaatgtgaaggggacttaccaggtctctttcctcctggtccctaggagaccactaggaatacatgggatgcttctggttagcacaatgattgcaggacacctgggcattcaggggacagggccagggatagcaaacacctaaaatgcataggacagtcctacccagtgacaaatcatctcaacaagaatcccggtgccaaccctgttgagaaacaccatgccctgggttcaaatcctgactcagccacttccatcccctaccctcttggactccaacattgcctagagggccaggcatgaaataaaggacagatgagtgcctggcac

SEQ ID NO: 159454 - DNA, 176 bp, Homo sapiens
gtgggaattcaaatccgggagtcctgggataaagtgctgactgagaaatcatgggacctcttgggatccctgcagaatctcccaaggctcttggcccaaagcctgaagcactttagagaaaactgacggacattctactgcacccaagtccagacttccggatcaaccaagtatgg

SEQ ID NO: 159455 - DNA, 423 bp, Homo sapiens
cacaacatacttctaaataagccagtgatcaaagaagaagactcgaggaaaattttaaaatatcttgaactgaacaaaaatgaaaatataggccgggcacggtagctcacgcctgtaatcccagcactttgggaggccgaggtgggaggatcatttgaactcaagagttcaagaccagcctgggtaacacgatgagacccgatctcttaaaaacaaacaaacaaacaacaacaaaaaaataaaaataattttaaaatgaaaatacaacgtatcagaatttatcggatgcagacaaagcagggcttagattagggaaatctataccactatatctttacacaaagaagaaaggtctcaagtcaataacctaagttctcacctcaggaaactagtaaagatagaataaaataaacccaaaataag

SEQ ID NO: 159456 - DNA, 268 bp, Homo sapiens
gcttaatttcctttcattaaaatgttctaattacagatcaccttaaaaggtcatctggtttctcaagaagtgagaggttttttttttcttcttaaattgtcctagagaaccaccttggtgaatcaataactgctacttttacctactataatagcaagaccttaaaaggattcttttctttccttttaacaataaatacttataatagtgaaaataaagttctttaattaaacaaaggtaataccaagctataaaatttgcccatatg

SEQ ID NO: 159457 - DNA, 280 bp, Homo sapiens
aattaaacctcattcctttataaattaccaagtctcaggtatttctttatattagtgtgagaacagactaataaagctatctacagagaggaagaaaaagaaaaaagtgaataaaccaatctcacaggttaaaatgagatgtgtctgagtaaattatctcaaagtgaattttcttgaagccaagcaatagaagggatactacacattgatggttcagtaaacccgtgagactcccttaactcctactcaatgcactactggttttaaatgtacacacacg

SEQ ID NO: 159458 - DNA, 632 bp, Homo sapiens
cctcctcaccgtgaagaggatgtgcatcttgtttctttgcggaaaagggtcatggcaagactgactaatgggtgtgatgagtgggtcagaagacagagttctggggtgaaggtacaagggtagcctgggaggtgccctgatccctgaggtaagccaattgccacacgccccagctgggggactaagaaaacagcccaaatgctcgtggtttgagagaaacttcagagccagctggcagagttaacttgtggcgtgactccccaggaaggctgaggtgggaggaatccaggaccaaagacagatgtttccctggggatgtgcttggagttcacacaggggaaggccaggagtcaactttcttctaaggcaccagagacatctccaacccatcccacaggtatccaagtctcctaagggtcaacggacgcacagcatcccccagaaagggagaacttgccaaccctactccaggcctctgcatttgtgactcttgccagttccaatgccttcctctggctggctccttctcatcagtcgggcctcagctcaaacctccctagagtggccattgctaatgtacccccaccctcggccaagtcatcctctacctccaatcacctgttgggttttcc

SEQ ID NO: 159459 - DNA, 644 bp, Homo sapiens
acttccaggactatccagaataattccctaaataaggcaatgctttaaaaaccagccagccaaccaacaaacagcaacaacaaacaggatgagagttgggttctcatatctgattcaaaagcacataaacaatggaaaataaagtcttggttacccacatgatatggaaggggaaaatacctacagcactgaggaaaaaatataccctactgtcactaaatgattcttagcatgagcagaatgggaggtggcacattgtaagactatgagggtctacttgtcagggtacttctggttgtaagtgaaacacttcaaaataatgttggtttaagaaaagaagacatatattaggtcaaagagttgacagatcctgagtggtttgatttcaggcatagctgtatgctggcactcaagctgtgaggatagaaatctgcctctttttatcagctgtaatttctgtgtttatcactgaaaggtccacccttgcatccatgtagaaataatccagaaaatagatacttgttcccagttgttccagtgtaagtcctagggctgattcatacagttctagccagatgctaatatcagtttgggtcacatgcccattcctgaagccagaaaatagaacattctccttggccagg

SEQ ID NO: 159460 - DNA, 426 bp, Homo sapiens
ttctggggctgacagagatttgaattctccctggcatggaggtcttcaggtcctgccaagtgagtgacctcccaattgggtctccagccacccccaccggtgttcttgggatgacagagatttgaattctccctggtatggaggtctcagcgtctggcccagtgaaggacttcggcctccagccacccctgccagtgttttggggctgacagaaatttgaattctccctggcatggaggtcttgaggtcctgcccagtgagggacctctcaaccgtggcctccagccacccccaccggtgttctcgggctgacagagatctgaattctccctggcacgtagttctcaaggtcccgcccaatgagtgtccttttagctggggtctccagccaatcccactggtgttctcaggctgacagtgatttga

SEQ ID NO: 159461 - DNA, 491 bp, Homo sapiens
gatcgagctcggtcctcacccacaaacccctctctagccctcttagcacagggcactgatataactcactttcagcttgtttctctttgtctcccagcccctagtagaatgtcggctccccagacagggaactttgtctgttttggcctctgctctgtccccagcacccaggacagcaccggaacacaccaagcactcatgaaatacagagagatgccccttggcttaccacgggctcatcatatcccataaacccagtaagatgagaagatcaaaagtcaaaaatgcattgaatgcacctaacctagcaaacaccatggcttagcccagcctgccttaaacatgctcagaaacctgcattagccttcggccaggcagagtcatctagcacacagcctggtgcatcatagagggctggccgtctcatgtcattcgctgaatgctgtactgagagtgagaaacagaatgggtgtgtggatactggagggtgt

SEQ ID NO: 159462 - DNA, 149 bp, Homo sapiens
attttggaaatcacaccggtatatctagtggctttcctgggtgtatgtggctcattactgattataattttctttgggaattttagtttaaggggatggggtaagcactttcaaattctttgttgttagtagttttgatggaggatagg

SEQ ID NO: 159463 - DNA, 734 bp, Homo sapiens
acagggcacatccccacgtcaatctgagtccgagaggctccccagagcaggggacattgcagcagctgacttgacttgggaaggtggagtcagtagtcaatgcggaggagggaattccaagagggaactggatatgcaaagacacagaagcgggcagctggctgcactggggaaacaaccgatagtggtacatggggaggaaggaggacaaggaaggagaggcagggcctaaactgagcctaatgccaagaggacaagcagaggaattttggtgatgcttgactttacacatcctaaccagtgtccaggatgattccagcacaggggaggagtgtgaagcaccctggagggtgggaaggaggccggaaaacagtcagtgttccattgtgcccttttgggcctgcgtccatctatcttgggagacaggtcttaggaaaagaaagattttattgcatctcccccttctcccaagttaacaagtactggtgggaggagttcagtaaatatttaagtttataatagaaatgacttattagggtaaacgtgagtgttgacagaggaaatccacagggaggccttagaacctgcctgccacagaagcgctgcagaaacgctgcctgttgctcctattcctattattgtttacactgaagaaagaattggggtcagcctatatagttcagtgccacattcgtataatcaaggcatcctttttatgtgatgagagcattggg

SEQ ID NO: 159464 - DNA, 387 bp, Homo sapiens
agttatctttcaattttaactttacctagaaactaaaagatacatttctcagcactgagtcaatttacagatgaatacatgtgggtaatttaatgtatgtgaagtgaacttcaaattcgattttcaatatggactaagaaattcaaaaatacttgtatgaagagaaatgccatatttaagcataagaaaagttaatgtgtttaaaagaaaacaacttacaaaaaaaaaaagacaaaaaaaaaaaagaaaactttccaagtagcaattctagcatagccaatagggaatttaagaaatttgaattcattcatacaagtttattcaagtatttaccaatttctcttaaaaaaattaagaagaaaagaaaaaatagaataacttactcta

SEQ ID NO: 159465 - DNA, 277 bp, Homo sapiens
attccaggttgccagtttgtcagttgtgggatcatttggcaatctagaggagggccttggagtgccctctgaggttgctgtcccagctagtcccttcctcagtcttttttttttttttttttttttggggaaaatgaatttccaacagttggctcaggctgtcctcaaactttctgaccctcaagcactctcccgcctgtgcctacagtcctccacaaagtgtgcgggaactttacagcgactgtttgccacacatgtgctgtggtataatttttcc

SEQ ID NO: 159466 - DNA, 385 bp, Homo sapiens
ttcaactaaaaaaagcacaacatacttttaagttagtgtctgctattatttttctgaaattttatgcctgctgccaagtactgtgtattttaagaaatctctcattgaaaattacttaaatgaaacagtaacccacaatccttccagcaaagattgagcaaaaattgatgctggtagacttcaaggaggacgtatcctagagtctcaaacagaaatggaagtgacactctttaggggatactgttgtgctctggagcattgcgtgtcatcttaaaaaatccttgagctgccatcaaaagagaagacaggacaagaggaagtgaggaggcctgctcttgttcccatatttcccactgctctcccacaagtattcacttctccatgg

SEQ ID NO: 159467 - DNA, 521 bp, Homo sapiens
ctcatcctccttcccctcctgctctctttgttcatccttttggataaggcctatgttacactgcccatatgtcacgcactaacttcatctccaatttctctccaacttgtctcctgagctgcaatcaagataatctacttgctgtaacctggaagtgacttactcacaagtacctttgttcatgattaactatttatcagcacaatcctccctactttgtctctgctaacccatagctaccaccaatctcaagtcccctcttttgtatgtgttggaaagtatataacttaactacatatcattgttttcatcttataaccttatttcttttgtatttgtctcacagtgtgtattacagtgtttcctaactaaggccgtatatcacaatcacctatggagcttcctaaaaaatacgaaggcctggccgggcacagtggcacatgcctgtaatctcagcactttgggaggccgaggcgggcaaatcacaaggtcaagagatggagatcatcctggccaacatg

SEQ ID NO: 159468 - DNA, 557 bp, Homo sapiens
tcagtcgcccaggctggagtgcaatggcgctatctcggcgcccaggctggaatgcagtagcgcgatctcagctcactgcaacctctgcctcccaggttcaagtgattctcccgcctcagcctcctgagtagctgaggcaggagaattgtttgaacctagagggcagagcttgcagtgatccgcgatcgcaccactgcactccagcctgggtgacagagcgagactctgtctggaaaaataagaataatgaggaggaggaggaggaagatctcaaataaacaacctaactttacacttcagggaacaagaataaaaacaaactgagcccaaagttagcataaggaagttaataataaagattacagcaaagataactgaaatagagaacagaaaaattaaaaaaaaaactcttgggaggccgaggcgggcggatcacgaggtcaggagatcgagaccatcctggctaacacggtgaaaccccgtctctactaaaaatacaaaaaattagccgggtgtagtggcgggcgcctgtagtcccagctactcgggaggctgag

SEQ ID NO: 159469 - DNA, 457 bp, Homo sapiens
gctatgtttccattttctacttttttatgcttcttctcttctgttccttcagtggtggtagcgcggatgttcaaattttcagttctcagtaaagattgtatagacagtcccacggtcttcaggtttttactctgtgctacccaaacctacagtaaatactataaaagaaaacttattcaaacgtaatctttatctgcaaaaactttattgaaaaacgttaccatttaactattgctgtaatatagggggttccttgaaatatgataacctgcttgttatagctacttcagcagatcttatcctgttgcatagggtatcagcatatgcttaatcatttaggtatattattctccctttatttctttctatgtaaacatagaaaaggtatagtaatcatacatagaactgacatgctaggtattggaatttttgcttcagccctgcaaacaatctttca

SEQ ID NO: 159470 - DNA, 273 bp, Homo sapiens
attctacaagttatgaggaaggttaaataaaaatttctaataggaaaagaataatctttggagccaaattgtcctggatttactagttcagtcatgaaaaaaaatgtgcactgaagattgtctgtgatcatgagcaacttgagttttgttgtcatctgtgttacaggcatatcaatgcctacatttggttgccagtttccaagatggtccccaatgatcgtcatcttctggtattcatgccattgtgtagaccctgcccatattatgtaggga

SEQ ID NO: 159471 - DNA, 400 bp, Homo sapiens
cattcctttcttttttcggttctgttgagctagttctggcttgtgtgaaccaggcttttaccttttagctcctgtgtgtctgggctaagtgaagtcatagataagatttttactgaggctttgaaaagactgcacattgggccttgctgtcacttatagaatatctcagaaaggttttgcttcttgaggatcatatgaggatgtgggtggggtggggcttggctgtgacaggcaactgtgggacctcagctatctttttattcatgcctccccctgaatttcagaatttgcaggtccatgagcatgccagtattaaatccctggcactattctttgaacatgcccaaacaggacagagctttgctctatgagaatgtggtatttctgggtaatagttgat

SEQ ID NO: 159472 - DNA, 615 bp, Homo sapiens
gcaaacttgggttgggggctatgagctgagctcatcaatgaggtgggcacaggagagcattccagtgtgacgacacggcatgtgtgcctggatgaggctgcagcctgagacctgggcgacgtgcatgggaatagatgacgactttacaatctggtttctgttaatcaggaaggagaggaaggaggaaaaagaggagaaggagaaggatgaagaggaggagacacaagggtggaagaagaaaaaagaggaggacagatgaggagggggaagaggatgatggaggaggaggaaaagatgcttttggtttctgtgagctgtatatgatttctcacctggctattttgaaatattgaaaatggcactaagacccacccctgcctgctcctatctccacccagaatgaaccttcagagattttcagggttgagagcccaccatccccatgctagttctaaaggaagaactacttaattaggtcctgggtgaactggtcaagtcaccttcttagttttctgtttgtgaaatggggacaaccacttctacccatcataatttttgactcctgtcagctcatgttgaaaatggattcaccatggatgagtaacccagagtgtg

SEQ ID NO: 159473 - DNA, 209 bp, Homo sapiens
ccgagattgcaccactgcactccagcctgggctacatagcgagactctgtctcaaaaaaaaaaacaaaaaacggagtgcaatcctgagccctcctgagctcccaggtggggtgcacaaagccattgcaattgcactgaacccaacttcttcagcttcaagcttctcgttttctctctgggtcccacaaccccagcaacctctacactaa

SEQ ID NO: 159474 - DNA, 148 bp, Homo sapiens
tgactttaaacagcaccctccagtgatctgtgctgttcagtatagtgtgtacctgccacatgagcaatgagactggagagctacgttttaaatgttgtttaattttaatttaaatgtaaatggccacatatagctggtggctaataca

SEQ ID NO: 159475 - DNA, 561 bp, Homo sapiens
tataagttccactcacatagagcaaacattctcatgaatggcacttaagattttatttcttttatttgtttctagcttttgaattgtatcaatagccttaggcttgtttaataatatgcatacatagctgtataatatagaacaattagaatgggcttcaggttcttgaaagcacttagagacacagacagccacagaatgaatccatgggctgttctactcttcattttccatcaagcttgttgaccttagtcttttgacataatgtattgtggctaaggtttcggacacttgaacttctctaatcataaaatcgtggagatggtttagttctcatcacttttatctaaacatgatataatacatgggaaggttttttgatctttttatcactccgtgtgtagaaacagctaagtgtttgcagaccactgtcttctttcttagggtagatgttcagccttctccgctgtgccaaggacatgaataggtatatagagtcctatgcacaaagctgctttcttaactttaaatatttttcaaaatctatcttcttcatattgc

SEQ ID NO: 159476 - DNA, 363 bp, Homo sapiens
tatcacagaatccccacctgggggtggaagcttacacgtttgggtctcagctatgaaacagtttcctgtaagccatgatcacatcaggatatattatgatgacatgaatgccaatcaatactagatttaggcctggctctggtggacggtgtgtcttaaatgttcctttagcaaagctgtccaattattcctccccttccaagatcatgagtcagaatttgacgttagaggaggtggagccagatggctaaagagaaccctccagcgatagtcctctgcagcaacaccaaactcagctatccatgtaagaaagtatctacacaagagccaaaaaaccaggtgagagatcacagtatctggttt

SEQ ID NO: 159477 - DNA, 350 bp, Homo sapiens
agagttttcatatatttatctcaaaaactcctaatatataaggtgaatattcgttacataccaatgaagtattcatcagaaatgaaattaagtcatagccacagttatgaatccagatggccagctattatctcatactccctccctaaggtattaactttttaagcattcaaattacttttttttgtcctgtttccttccttaaactacagttttctatttctagcacaaaatacaaacaatttccaccacttttctacataaaaattttggccttagccataccactaacaatcataaatccagaagtttctagagcataaattaacaagtgcttatatgtaattaca

SEQ ID NO: 159478 - DNA, 467 bp, Homo sapiens
aagaagcattcaatacacaccagtctcccaaactgcaggcatttccatgcaaagtacctgacaaaacacttgggtacatgcttccattgttgaaatttaaccttgtcattgtccagtctcaaaatcagacaaactacctgtcatcaaagctaattattgccttttaaaaatcagatattaggccgggtgcagtggctcacacctgtaatcccagcactttgggaggccaaggtgaacagatcacgaggtcaggagtttgagaccagcctggccaacatagtgaaaccccatctctactaaaaatacaaaaattagccaggcatggtggcgcatggctgtagtcccagctactcgggaagcggaggcaggagaattgcttgaacccgggaggtggaggttgcggtgagccaagatcgcaccactgcactccagtttgggcaacagagcaaggctccatctccaaaaaa

SEQ ID NO: 159479 - DNA, 427 bp, Homo sapiens
gcgaattcactagtgattatccccgggtcttgggtacatgcttccattgttgaaatttaaccttgtcattgtccagtctcaaaatcagacaaactacctgtcatcaaagctaattattgccttttaaaaatcagatattaggccgggtgcagtggctcacacctgtaatcccagcactttgggaggccaaggtgaacagatcacgaggtcaggagtttgagaccagcctggccaacatagtgaaaccccatctctactaaaaatacaaaaattagccaggcatggtggcgcatggctgtagtcccagctactcgggaagcggaggcaggagaattgcttgaacccgggaggtggaggttgcggtgagccaagatcgcaccactgcactccagtttgggcaacagagcaaggctccatctccaaaaaa

SEQ ID NO: 159480 - DNA, 742 bp, Homo sapiens
attccaactagtatctttagctcctgacatgagctgttctactgtgggctcagcccttgtctgagactgtatccctatagggtcccggtcttctgttgacccctcaccttctgtgggcctgggcatggacctctgatccttccatctgaagaagctgtcaaaataaaagtccatgcttccgggaatcaggaagtcgcctcaaggcaaaagtagctgagtgtttctatatctgttttgttttcctttctatcttctctttttggtgggtaattcttcaccatcttgttgattctttaagtcttagcataacacacattttaaaaatccagttgttttagttgctttctgtcaccatagaaggtcaccatggttctcagccctgtcggacctggagcctggtaccatgaccagggacagggagtcctcatgccgttttaagcagtggtgatctaagttttatttcttaggtgagtcaaggtcggaaaagcttgagacccctgctctaggggctgtacctgtccctttctgccttttctcctgtctggactagggttcgaaggggctggtgggccatgtggagaccaagtagctgacaatccccaggacctgtgggctcagacacagggccctgcacctctcagcccttccggtctcagctcagcacctcccttgcctggcccctctttcctgcatgagctccctgcccctgccaggaggaacctctgtcctgtttctagatgcg

SEQ ID NO: 159481 - DNA, 103 bp, Homo sapiens
tcccagattctgctgcctttctatttttagcctctcctaatatccaataatttcccagttcttccttttgttctgtatctagactctatcctaaagttatgtc

SEQ ID NO: 159482 - DNA, 388 bp, Homo sapiens
tggcgttcagaggatcccccaagcgctgctcacatctattctggaccaaatcaccaagaaaagccacagctctctcatttctcagatgttacacacattaaagagcacaacacaattacaacgcaaatatgaggcagaaaaaaaaaggacgctgtgaaactgaaaatgttatagaagatgggcaattgtacaagttcaatggacattatgttgaagaatactggaagtatgcccatgtcaaactaggatctgggtgagtcagactaagaatttaagaaggaaaaagcaacagggacctaaaacccactttaaaggaaaaggatctccatttcaaccaatttggagagagctctgggaaaactgcttaagctctggaacatgttttgcg

SEQ ID NO: 159483 - DNA, 158 bp, Homo sapiens
ctggaattcagaggggagaacagcatccattgagacagcgggatccaaggcctagtcggggttagggagtgggctagcgaggagcccttggttccaagagcaggaggggaagggagagagaggacacaggaaggcagggccggaccctccaggaggct

SEQ ID NO: 159484 - DNA, 437 bp, Homo sapiens
cactgccacacgtcaccccttccctgagtacgtgtcctcccggtgctcagtgtctcctgtatggggcagtgacagcaatggtggccttcagggagcagctcagagtcctgtcagtgatctggctgctgccaagggccgtcccaaccccaaacttggaaccctcatctaagcaaccctcagagatgtgatccctgagacctggcaggctctgtggcccagacagagaagaacagatggtgacacttagtctgggcttcctatgagcccggcacaggtctcaacgctttacacagacgaactcgtttaatcctccctccaccccagcaattagtctcatacaaaggacaaagaaactgagggacagtcatgtcaagtgatttccccaggactcgtcgaaagtatatggcccaggctcacacctgcaatcccagcacttt

SEQ ID NO: 159485 - DNA, 286 bp, Homo sapiens
agattcctagaagactatgagttctctacaaacgaaacttgcaaaaccaaccattcagctattcaaattttataaacatcatctatgaagatataaaaggcatgcttatcaaagagacctaatacaaagctgggagaactaacacaaagtctctggctaattaagattaaaataatgtctgtaaattgaaacaatgctaaatgtaataaagtggaacataattggaataaagccctgaattcaatatttttaaaacactgcataagcataaacttccagtaaaaat

SEQ ID NO: 159486 - DNA, 321 bp, Homo sapiens
agctgggattacggcatgaggcaccatacctggctccagaagtgccttctaatacaatgaagtgcttttctggtattcatgttaaaaatgcatgacccaaaactgaggggcattctacaaaatagctcatctgcactcttaaaggagactaaagaaacacaacaacctgtctctatgaaaagcacaaaaataaataagtaaatcagccatgagcagtagcacgtgcctgtagtctcagatacttgggaggctaaggtgggaggatggccttgagcccaggaggcggaggttgcagtgagccgagatggtgccacggtaccc

SEQ ID NO: 159487 - DNA, 336 bp, Homo sapiens
caccctgattacaagataacataaacaatttatgtaccactaggaaccctaccaattaaatgaattcatcttgattccaatgacataaaaatgtaggagaaaatgtgtcttttagattaggtcaattttggcatataatttaaatgacaactgaaatacaaaactcacctctgttggtctatgagctactttctaataaagcaccatagaagcttaacagtgtttgaaaagtactaatatgttaatgttatagcagtaaacttgacctcgatattttcattttaaaagtttattattattactattttttgagatggagtctcgctctgtcgccca

SEQ ID NO: 159488 - DNA, 215 bp, Homo sapiens
tcagtcaaggagttaagtcagaagacgtttcaagatgacagtaaatcaaagaactgcagataacagacagctgactgtttaggggcttcaccagtgcacaaccgacagagagatccaatgaagggagggactgccccagagtccacttcggcccaccccactcacacttgacagcctggcacagctggaaggccatgtggcgcacttggtggatg

SEQ ID NO: 159489 - DNA, 256 bp, Homo sapiens
tgtagaatacaattaaagttaatcattaacaagatggacaggtagctggatgttgtggcaatgtcagactatagtttctaaatacatctttcaacctctggactcatcacaggtaagtcacaaacagtccacagatcaccactagtcactcctctctggcatgaagtcactcgcctgctgatcccacactaggacaatcatcaactctcattaggaggaggcctagggaggaggcatatgcagattgctcagcgct

SEQ ID NO: 159490 - DNA, 332 bp, Homo sapiens
aagagtcctccggaatgggtgactgtatagaaagcaatcgaatctttaatcacttttcctactttacacttcacgcagttcttattcctatccctgcttcatgcctttccaagagaatgttagaggcctctttcaattttcatttctcagtcttttccccatcccgttcagtaccctaaacttcgtcagttatttaaaataaccttttaccccctcctccccttcccaggatgtttcaacttctctggctctcttccccatccttacctcctccaattctttcatcctggtcctggcctcttaaacccgccaggggctgccctttgcctgtc

SEQ ID NO: 159491 - DNA, 325 bp, Homo sapiens
aagtttttctgactccaaaattccatgacaagtctaataacagttgctattaacaacgtatgattcttgcaaagcaatttcaagtctttcttccacatttcaggaagaaagcaattcatttcagcaatctaaaggaaacagatgctattagggacaaaagattgttagttgaccagaccgggcgcggtggctcacgcctgcaatcccagtagttcggaaggacgaggcgggcggatcaccagaggtcaggagctcgagaccagtctggccaacatggtgaaaccacgtctctattaaaaatacaaaaactagccgggcgtggcag

SEQ ID NO: 159492 - DNA, 164 bp, Homo sapiens
ggagtcagtccatttcagcattacctacaggctgaatgtacaaaattatttttgataggttaatctgagaaatctggctgaagtttagcctaattaggtaacggtttttgaaatatttggaagaagttgtccattcttcagtatgtttttacatctttatttta

SEQ ID NO: 159493 - DNA, 201 bp, Homo sapiens
aatatccagcaaccccatgtccctgtcctcaacacttgaatctttcttcctagccacgggaccagccccaccagctcgctgtgaggctctgcactcagcggtcagggaaacccagagcacgggctgccagcccaacgccagccacagggacatggagttgctggatatttctgccccttctcaccttgtcttgtccgtgcc

SEQ ID NO: 159494 - DNA, 584 bp, Homo sapiens
tgtgatcccagtgaggtgtgaactagaaaactcaaagcatgcctcacacattgcctgccaatgccttacacattcctgtcttctgaacatgttctatatgctttcgctgagccattacccgtgctttcctaccttccaccacagcaaaggcagcaatctggcattttgtgtaaagagcagtagtgatgccactcacttgagggcagagtgcactgacgtggtcctcccttgctctcccaccaacccttggctgtttataccacctcccacctggcattgccagctcttaagtacgtgtatctctgccttatttcactggcatacctcactgaagtcacagactctgtcttaatcatttctgaatctctagcagctggcactgtgcctcagtcatagtaggtactccataaatatgtgctgaataaatgaattattgaaaaaatgaaccaaacaatctattaatcagtgtgaaggggcttcctaagtttacatttctaattatgaggatgaagtttatgatgaagtgtgaagtttatgatgaagcatggcttttctgaacagagacattgcaatatttaaaacag

SEQ ID NO: 159495 - DNA, 136 bp, Homo sapiens
tgaaaggctgaggctgcagtgagctgtgatcataccactgcactctagcctgggtgacagagcaagaccttgtctgaaaaagcaaacaattttttaaaaagaaatgctataaataattgcatttgtttcatgtgtt

SEQ ID NO: 159496 - DNA, 134 bp, Homo sapiens
gccttcctgttttctttttcctgctaggcaactataaaagccccaattcttctaaccttgcaccctgcctgtaactccatctctctctcttactttctccattggttagctgaaagagtaggagtaagcactct

SEQ ID NO: 159497 - DNA, 556 bp, Homo sapiens
accagcgggagagcaagagtgcatgaaaacgctttttcttccccacacagggttatgaatgtgtgactaagcgcagaggattaggttgagcgtcaaaagtgatgttaagtcttttagtgtggttgactgggatggtgaagccactaaaagagggaacacagaagtttttgtggactttgggacacttacattcaggagaatcaaagggactgaaagagaactgggatggaggagaattagaggatggtgtggtgtttcccaagacatcccctgatcttgctatcccagcatctcctagaccttcccaagatccagcaactaaaagtataacacttgtcacaagaaggctaaggttggcctatgttctaatggggggtgatgtgggggtaagatggggagtatatgggaacacaatcacaaactaaagcttatatactaacacttttttgggaagttcaatgtcaaggaagttggagtgagcaggaaagggaagtgaggcaggaagggagacagcaaatacaagagagaacatgaagatgtgacgcggtgtattccg

SEQ ID NO: 159498 - DNA, 496 bp, Homo sapiens
gcatgcttgtgacttccgggaggacaagcccaggcagatcacgctcacgctctctccttctgtcacttcctcctacaaggcacgctgggccactctcctgcttcatctcaagagcacttaggggaacagaaaccactgaaatcagttactaggaggactccacggtgataagctcagcaatgagaaaaggaactgacatttccaacacaaattcacttatttagtcaataaatgttgagctgaaaaacaataaaaaggctttcaggctgaccacgatggaagcaccaggaagcacctcgaggatgctgggaggcagaggcgggcggatcacctgaggcctggagttcgagaccagcctggccaacatggcgaaaacctcatctctactaaacatacaaaaattagccggaaatcacttaaacacaggaggcaaagattacagtgagccgagatggcgccattgcactccagcctgggcaacagagtgaggctctat

SEQ ID NO: 159499 - DNA, 302 bp, Homo sapiens
aaagacacaagggcatacggatgtgcggagaaggagaggaattcgtctggttgaaattcagtgattctccataggcagttgcagttattatggctccagctatcaaattttactgacatttcccaatctgattctggtttttggttttttttggagacagggtttcactctgtcgcgcaggctggagtgcagtggtgtgatcacggctcactgtagcctcgacttcccaggctctggtgatcctcccgcctcagcctctcaagtggctgggactacaggcacgcaccaccattactggcccg

SEQ ID NO: 159500 - DNA, 466 bp, Homo sapiens
cacacacagctgggaaccctgggaagtcacagcaaactgactcaaaaagctcagagttggccaggcgcagtggctgacacctgtaatcccagcactttgggaggccaaggcaggtggatcacctgaggtcaggagttcgagaccagcctggccaacacggtgaaaccccgtctctactaaaagtacaaaaattagccaggcgtggtggtgggcgtctgtaatcccagctacttgggaggctgaggcaggagaactgcttgaacccgtgaggaggaggttgcagtgagctgagatcacgccactgcactccagcctgggcgacaaagcaagactctggctcaaaaaaaaaaaaaaaaatggccagaggtattcgggaaagtatcagtcacaccaagaccccagacaaaaaggacatcctatgagactcccaggagaggagggacctcaaggctgcgctctctgtgac

SEQ ID NO: 159501 - DNA, 110 bp, Homo sapiens
aacggctctactttccgacctggctgcactgcaactagcccttaaccaaggtgacctagcagccctcggtggctccatccacctgtggcttcctccctccaaggaccctg

SEQ ID NO: 159502 - DNA, 108 bp, Homo sapiens
gtgagtccacctggtgcagttatataaaataccagcacgcacgcaaaaacccttcttttggttttggttttccctctaaactggaagtagactcaggagcgagttttt

SEQ ID NO: 159503 - DNA, 277 bp, Homo sapiens
catcctcgtcctttggtgttatcacccaaaacacatctaaactcacaaggtgacagatattagagctacaaaagaaactttcggaaatgttcatctttattgttaaaaatttaaccatattaactatttattgccttaaggactagattccatgctgacataattttgtagctttgtttattcagtgatatctttgctatttcagggaccattggagctatttctgttacagttcttggaggaatcttaacagttctctttatcaggggtcagcaaa

SEQ ID NO: 159504 - DNA, 326 bp, Homo sapiens
cctttgttagattagggaagcaatgttttccgaatttagtggctttagcattacccaaagagcttactaaagattattcttaaggcctaggaatctgcattccaagagattcttgcacaccacagacattttcatgcaaatgattcttgaactacacttggagaaaccctgggctgtggactgctggcctctttccccttttcatttttagtgtggcacagaatatttttattctcttcttcccaagagttctgaagtagaagattgccctgtccccatgattcaagagttaatggcaaatttccgttcttttcttttcttttttt

SEQ ID NO: 159505 - DNA, 552 bp, Homo sapiens
gcagctgcatctctgcagtctctctttgctgtcacattttcacattgtgttaagaggacaatagccatatggaattaaggacctgccctatctcagtataaccttgtcttaagtcattatatctgcgatgagcctattttcaaataagatgtgaagttttggggctgagactttaacatatcttctttggggtaccaccattcggcccttaattgtatggtagcaagctttatgtctgtagtgtgggtgagagtagtatggttgtcaagcagtagggtaagaaagggaaggaaaggatcacaaaaatcaaatgactcatactgtattagatacttggaactctccagcctcgagactcaatgataaagattcaccgacgacctggggaagccctcttaattcggcagggataatcaagtacctcctgtgccagaggtccctcactggaaatgtttaaaaagttacatcatttattcttaccagcccccaaactcccttttaaaaagccctcagctgggcacggtggctcagcattttgacacttgtgatctc

SEQ ID NO: 159506 - DNA, 301 bp, Homo sapiens
ttttttccaggggcaaggggctcatattcacacagatgggagtccagttggtgagaaggtggcaggtggcacagcccccttatacagcatgccatactggtccactgtcagaccggtgatggccacagctccatcacccccaggctgactctggctcctgcctggctctgcccggccaccacaacccctgggaaccattcagaggcatcactggagggtatgtggttagtggagcagctggttgtggggaggtctcgtttctttggtggaaggcattcctgactcctctcatgaacaggtt

SEQ ID NO: 159507 - DNA, 363 bp, Homo sapiens
acgcctgtaatcccagctactcaggaggctgaggcaggagaatcacttgaaccccaggggacggaggttgcagtgagccaagatgacaccacttcactccagcctgggcaaaagagcgagacttgtctaaacaaacaaacaaacaaaaaactgcataacaatcttatactgacctacattcccatggtcataccatggatcttgtcaatactcaaaggaacttcatctgtaaaatcttaaactccaaatatctcattctcagatgagaatgtcttattttcacccttttcctatgctttggtcccacctaaactgttttcctgcattgttgaggcctcacttcctaattctcccagtgatcag

SEQ ID NO: 159508 - DNA, 444 bp, Homo sapiens
tggagagagtaggatggtttcgggggaagacgttgggtggcattccctggagagagtagaatggtttcgggggaagacgttgggtggcgttccctgcagagagtaggatggtttttgggggaggacgttgggtgacgttgcgctgagtgttttgggtttgcagttggtactgatcatcgcgtcctgtcctcattttgttggaattaaaaatacgttaatcacagaggtctggtaagtttccagagggaaggtctctgaagtggagctgggtactgccccagggttttggtggggttggtgagccgtagtggtgcagagggtgggctctggcaccaggtggcccgggcaggtcctggctctgcagctcacccgggcagctgtgggctggcagcctcctctgtctcacccttcttacatgtaatatgggagtcataacagtagcca

SEQ ID NO: 159509 - DNA, 417 bp, Homo sapiens
tagatttggaggggcagtgagcagaccagagtggattttttgtgaaggagagaaatgggaattgagaggacatgagatcaaattatgtaagctctttaaatcagaaggaagaatttgtactttaaggtgatgggtattgtgagctattggagatatggctgcaatacctgtcatctcttagtcaccagatctttcttccaacctcttcggtctgtctggttttctggtcttctgctaccatgaagtcagttgaatgttattcctcccccaggttgctccaggagcctcttaactgatctgttcacatgctctgtcttgccaccttccaatccattgctcacactgcagccaaagttacatttttattttgtgtttttaactaattcagattacatcacttcccagtttaatatgcat

SEQ ID NO: 159510 - DNA, 229 bp, Homo sapiens
tacaggcttgagccaccccacccagcctgaagtttattctttctttttgcttggttgaagcacaaccaagcaaaagaaatgtgtttaaaattatgatcacagaataagtgttacaaatttttcagtggtaacttaatccagatagtaataacccatacattaatttcttgcctttctcttgtatggagattatgcacaggagtttggaccttattctgtagacagttgg

SEQ ID NO: 159511 - DNA, 532 bp, Homo sapiens
ctagaaaaaccatcaaccctaaatgtattatggaaccagagaagagcccaccacagcccaaacaatactaaacaaaaaacagatctggggttatcacattactggactttaaattatactacaaggctgtagttagcaaaacagtatggtactggtataaaaataggcacttagtccaatggaacagaatagagaacccagaaataaaaccaaatgcatacaactaactgatctttgacaaagcataccaaaacatattttttagttttctgaggaaccttcatactgttctctgtagtggttgtactaatctgcattcccaccaaaagcatatgagggttctccttctcatagctttgacactgtataaagacactgtataaatacaactatatttgcctcttagggaatcatattgatcagtcttatggagaaccaggaaacttgcatttacttagttaaaaatgtatttgtcaagcattattttcacaccttgaaaacaaattttctacataataatttaggtaaaacg

SEQ ID NO: 159512 - DNA, 292 bp, Homo sapiens
gtttactttgacacccagtataactaaaaggatcttttgagtcagagattgagtaacttgccagagcctgtttggaaataaaccctgaggatttttcatatcagtggttggttatgcaatgtctgtggcaagccctagaaactaaaagaccaaaccttaaaatgttaaaaacaggaaaggcagttaattattatacataatttgttataaaaggaactataacttattaaagtcagatgatttctggccttgatagtttagggtttagagaagatactgttgtgtactataa

SEQ ID NO: 159513 - DNA, 509 bp, Homo sapiens
ttcatcttagggtctttctccacatagccctgtaccctgaatatctagctagaactgtgttccaaggaagtgatcataccgttgtcatctaatttgttgctgatgcagtagtttaatctgtttctaattttacttgtttcctatcagcctcaagctatgtaaactcctaggaatagcaggtcaggcagaggaactgtgagaagtcagagcagtttcctcccaggttctagcagcctgacacgaagagcaggttacagaggggatgttgtgagctttgagtcccgagatgtgttcccagaggccctaaggactccagtgttggccagggcagatgcaccctgaatagcttgcagaaatcctgcagctgtcttagctctgaggagtctgtgacctggagtaccttgggttaaaagaggggccatctccgggcggatcacgaggtcaggagatcgagaccatcctggctaacacggtgaaaccccgtctctactaaaaaaaatacaaaaaaa

SEQ ID NO: 159514 - DNA, 229 bp, Homo sapiens
gaagcttttgcttcacaaagcttttagtttttggcaggacaagttgagggggaaagggagaaaaattgggtagaatagggacagttgtataaacagtataaagcatcccactttgagtactttaatgtcaatatatttttcaaaaagtttatagtaattgttttttctatttttttgagccagagtctggctctgtcgcccaggctggagtgcagtggtgcgatcttgg

SEQ ID NO: 159515 - DNA, 352 bp, Homo sapiens
tatgttgcccaggctggtcttgaactcctgggctcaagtgatccacgcacctcggccttcccaaagtgttgggattacaggtgtgagccactgtacccgtcaagtgtttacatttcttacatgtagagcagctagaaagcaaagggttgattagtgtattcgaactccctgttttcatgttgtattaggttgacaacatggagattgcaggcatttacgtgtcctgaagaatctaacagcagaagagctggtgtatgtaaatgtgctgtgcttggccttcccagacacaaatcactgttaaactggggaaggaatgggaactgtgagggcactgggtttgtggggacttaac

SEQ ID NO: 159516 - DNA, 572 bp, Homo sapiens
ggggaggaagccctgccgttgagagataaagtggcaggaagtccagtggggcactggctgttgtcagagcatccacgtgaagacgctggccaccctgccagcatcttatgaacaggggtaggagagggtgctggatttcattccccaaacccaaataagatgcatttgcttctgccgtctgggccagcagcattgcactgacacgtgcaattcatttcacctttcctttttggtgagctgtcttgcaggacggtcctcttcatgtgctcatgctgtgggtggtggaaagggtgggcatgccatgctaagctgctgagtccctgtgcccctctgctgtttgtagccagcattttacaggaggttaaacaaagaggccacagcatttgggagtggttttacaccacgtttgtgagcagaattatattcacaaatgcactgctttaacattacatgtagcctgcttcgagtgtgcttagttgatgcctgacaaactagcttttgttgctcattgtaaaggcttagagtcaggtccaccaggggacttacgatgggtaatctggaagtggacttcg

SEQ ID NO: 159517 - DNA, 233 bp, Homo sapiens
  misc_feature (32)..(32): n is a, c, g, or t
  misc_feature (36)..(36): n is a, c, g, or t
ttctggtggtgatgggtctggcttcttccacngganaatcctggtggtgatgttcccatttcacatactgagaaaacacagcagagaagctgtaagataaaatgactctgagaccacaccttgaatttcataccttgaatttctattgcgtcgctcttctgagaagcttggaacactcacccaaattgtgaaatgacttggccccgtcctcacagtcatactgagaccaggaa

SEQ ID NO: 159518 - DNA, 193 bp, Homo sapiens
ctggagctacaggcatgtactaccatgcccagctaatttttgtattttttatagagataggcttttgccatgttgcccaggctggcctggaattcctgagttcaagcaatctacccacctcggcctcccaaagtactggaatctctttttttggaatacgtttcaaagcatgtgatagacatcggtacagtac

SEQ ID NO: 159519 - DNA, 178 bp, Homo sapiens
tctcctcactccttttacaaaccctactagttttgaggctatattaattgggattacatttgcctacaaataacactaaaacatttctaaaaagtgatttaaacaagactgtttatttcattctcaagaatgtctcagatagtgatggtggagccacaggcttttttgtttccttgca

SEQ ID NO: 159520 - DNA, 221 bp, Homo sapiens
gccccctgcatgttcctatgtagctttcagaagactatgaacagtgatggaagtagcatacgtaacttctagatatagctttataacctttgcaaattttaacatacctctgtttctcttttttatttttttgtgagtgcagaactttggtgagatgtagtctccatgattctggcttcctaaacaaacattctctcacccattaccagttaatatgaaat

SEQ ID NO: 159521 - DNA, 944 bp, Homo sapiens
tgggttttttttgtaattctatgtattttattttatgcatttaaagtcattattctgaaaagggaatccataggcattcaccagataattgaaaggatccatggcctaagaacattaagaatattcatagtagcccatggctgttagagaatcagaaagccatggtggctcaggcctgtaatcccatcatccaggagcaaacctttgaaagtggtaagagactcaattccattgattatacccatttcgtggtgatcaggaagaagaatactcagtccagtcagagagcagggttgaagattatcaactgcaacctcctccttctgaaggaaaatgaagacatggagttgcaggaaaggatagtttcaaggcacgtggcaaattggcattggaatcaataaataccaccagccaagtctcctggagtcagtcttctcttcattataggacacaacttttcaatatcagacatgaagccggatgatgagagttcctgtctctagaagcacacaggtccactccaatttcttctgcatctcatagtccttgggatgatcccacagatgttggatgatgatgtaatgtggcactgtgcaaggcttctcatcatagggtccaggggccactcgatggccttaaggaggcgtactggtgggagctctttcctgggggcggcgctcaaggggtgggagatgggccccggttccggtccaatggggttggccatctgtggagcgaggaacggggccctgttgtggcatcgggggccgaaaacaagaagggggcgggcacaggcccaaacgcgaaggggaacacagttaggccccccggaaacaagtgcgcgggcgggacagaacaagaggccgaaggccctgggggagcatcaccatggaaagcaacacagcaccgaaaaacagggcacgaggaacaccacgaggggcaaa

SEQ ID NO: 159522 - DNA, 598 bp, Homo sapiens
gagagaactgctgaccacaagggctggaagaggtcaaggccttttgagttttctgatttggagcatcaaggcgtaatgaaacttaatatttattgtgcaccaactatcaggcactttacatgtgctattttatttaattgtgactggagtcattttggaggcttggaggctactgatacgtctggaggctaagcagtatctggaaaagaggaatcatggaaccaatcccaaggattctttaaggaagactctgggcttgacctaaaaatcagaagtcgggccaggcgcggtggctcacgcctgtaatcccagcactttgggaggcagaggcgggcggaccacgaggtcaggagatcaaaaccatcctggctaacacggtgagaccccgcctctactaaaaatacaaaaaattagcagggcatggtgacgggcgcctgtagtcctagctactcgggaggctgaggcaggagaatggcgtgaacccgggaggcggagcttgcagtgagccgagatcgcacaactgcactccagcctgggcgacagagcgagactccgtctcaaaaaagaaaaataaataaataaaaaataaaaaaataaa

SEQ ID NO: 159523 - DNA, 213 bp, Homo sapiens
tggggagttcaaggctgcagtgaactgtgatcacgccactgcattctagctttggtgacagtgagactctgtttcaaaaataaataaataaaaagggaagaagctagggagcccagatgtgtctaaacctacgcccaatggacagagctcaaagtctttgtaacactgtatacaaggaattcaccccaaacatattacctgcacagactttga

SEQ ID NO: 159524 - DNA, 344 bp, Homo sapiens
ataaaataagaattttaaacacacatgagggcctggcatatacaaaacattgaataaatagcagtgatctttttattgacatcagaagggggttggggacccagaggctatttgggctcctatggcatagctcttggaacgtgttaattttcaaggacaggggtttgcaagtcagagcaatgtcaagtaaagaacaggttctttgggaggccaggatatgctaatgggtgaacaatgtaagggaggcataataataatgccaaaggcctcctagagtacctgttcactgcacttttgggtctttggtttatatatgaagaaaatgaggtgcccccagaggggaa

SEQ ID NO: 159525 - DNA, 498 bp, Homo sapiens
gtaagaaaagcagctgtggtctcagtgctttgggaggccaaggtaggaggattacttgagactaggagtttgagaccagcctgggcaacataatgagacctcatttctaccaaaaaaccctacaaaaattagctgggtgtggtggtgtgtgcctgtagtcctagctactaggaagactgaagtgggaggatcgcttgagtccaggagttctaggctgcagtgagctgatcgcatactattgcactccagcctgggtagcaggaaagtgagaccctgtctctaaaaaaaattaaaaagccctccacatatgcagatttcacattcgagaatattcttttttagatccatgtttggttgaaaaaagctgtgtataagtggacccagacagctcaaagctgtgttgttcaagggccacctgagtatgttttcagtaaatgaacatcagaggcaagtcagataacacagcagaaatagagaagaagggtatgtttgtcaggg

SEQ ID NO: 159526 - DNA, 572 bp, Homo sapiens
tgtacccatgcacacctgagtctaagaactctgctgtaaggtgacattaaacagcacctgaagttatatttgagatgattactcagtaatcattgtacagttgattttcgtagtagggattcaaacactgaatagggcacagttttaattaaatctgtatttctcagttgaaactttattttagcagtacatgacttctatttcatgaatcataaatgtcatgtgtcttcacaaactgtagttctgaatttaatttattcaccattttgtcgtcaaaaagaagagttgatgtttttgaaagatgtaaacagctctgcacctgatgttctaaagaaataaaatataccgctgaacccagatcaagcctttgcactaaattaatgtgagtttgaatttctgagtttcagtagtaatattttctatctttggcaatcatttttggactgacgctcattacgttttattctctttgggctttattccatggatttgtaaaggacaccagttcgctttatttctggaagatgtaacacaaattaagtaatgtgcctttgattccaatgtaactgtgc

SEQ ID NO: 159527 - DNA, 172 bp, Homo sapiens
tgtgtgttatcaacacagtctctcatgcctttattcaattaatggttattaggcacctactatgcaccaagccttgtgcatttaaatgaaaagaagtgaaataaggggagtctggaatgtgaggagtggggatgggagtgcattgtaagttaaaatagagtggtcaggatgg

SEQ ID NO: 159528 - DNA, 370 bp, Homo sapiens
ctcggcttttttttttttcttaaagttcccaccagttctctttaaagacagcaccaaaactaaaactaaaaaccaatttaattttacttttaaagcactccccctttttttttaatttttacaataatgaagatcttattctaggatgaaaataatgaataggaaagagctgtttattcttccttcttcccacccctgaatattgaagtaaaactaaataacaatgaaagtgactaggaacagcagacaaggggaaatatgtcagaatgagaacatctcatgtcatctccagggctgggggagaaacatctttcctggtacaaggtcccggtaccgaagaaatacaatttttcaaaaagttctgtaagtg

SEQ ID NO: 159529 - DNA, 126 bp, Homo sapiens
tgccctcttcctgactgctcttctgggtgcagtgagcactctgaattcagactgactgctgagtacaccatttctgactgacagctctggtcacagacagtaggggatggtcccagctcacatacg

SEQ ID NO: 159530 - DNA, 512 bp, Homo sapiens
aatctcacctaaaagggcatctggaatgctgatgttccaccctcaaatctcacactgggtccctacccacggactaagccagggttctggaacaccagtggtccatccatccaggctctagaatgacaacagcctgttcactgcttcatagactgggttctaaaatattgccagttgacctccacattttttattttttgagatggagtctcgctctgtcagccaggctggagtggtgcaatggcacgatctcaactcactgcaacctccgccccctggattcaagcgattctcctgcctcagcctcagcctcccatgtagctgggattatagacgcacgccaccacgcctggctgatttttgtatttttagtagagacggggtttcaccatgttggtcaggccggtctcgaactcctgacctcaagtgatccccccgccccggcctcccacagtgctgggattatagccgtgagccaccgtgcccagccaacctgcacatttttaacattc

SEQ ID NO: 159531 - DNA, 656 bp, Homo sapiens
tgtcttagcagtcccagctagagtaagactccattcctcaagcccccttccacttgttagctttgagtccctaaaccaaatacatatgaagtctccagaagtctatcacctatcaacagagacagagttctcggtatatatagccactggagtccaacccagtaccagttgtcagccttaaggtcagtcaggcagatcagagccagtctagaggtcatttagtccagtctctatattttataggtgaggaaaccgagacacatacaattagtcaatttgggctaggcgtggtggcttacacctgtaatcctagcactttgggagggcgagatgggcagatcacctgaggtcaggagtttgagaccagcctggccaacgtggtgaaaacctgtctctactaaaaatacaaaaattagctgggtgtggtggtgcgtgcctgtaatcccagctactcaggaggctgaggcacgagaattgcttgaacctgggaggcagaggtagcagtgagccgagatcacacgactgcactccagcctggacaacagagcgattccgtctcaaaaataaataaatagccccatcccttccccggctcccccggtgtccgccatggccaaagcctacgaccacctcttcaagttgctgctgatcgggga

SEQ ID NO: 159532 - DNA, 286 bp, Homo sapiens
aacaaacccaggcccaagtagattctgctgcttttcaaaacacataagcaaagttctctgagtctcacaagttcactcttgtgagctccttgaataacaacaattattcaaggtcataaataagtttacattctgcagtcccaggagcattcctatgtcggttatacctcttgcgtggaatctctgcttaaattaaatttgtcatttgattttctctgagtgagaaagcccctttaaaagaagacttggagttagtgatggccccatattagttagttaacaccgg

SEQ ID NO: 159533 - DNA, 486 bp, Homo sapiens
gaacagaagagaaagtatgtgcttgcagatccctttaatggtatttccagggaaccagaaccaccttcgaatgaaacaccttcctccacagaaacatctgctattcctgaggaggaaatagactggatagagaaacattgtgttaagataaacaacgatcttctaatttccaaggtcttttattttttcttttactctgcctatggctctctctatccccttttgcctgtgtattacaaacagctgggaatgtctccaagccagagtggactactagtaggtattcgttacttcattgaattctgcagtgcccccttttggggtgtagttgcagaccgctttaaaaaaggcaaaattgtcctcctcttttctcttttgtgttgggttttattcaacctgggcattggatttgtcaaacctgctaccttgagatgtgtaccaaagattcgcccaacaactcaccccaccaatgcaagtcaccagtta

SEQ ID NO: 159534 - DNA, 337 bp, Homo sapiens
gatgtcctcctccccacagcacctgcccacaatatgtgtttaagacactcttccacatgatacagactaacaggaacatcactctacacaatcagaacctgcttgtgccgaagtctgaagctgatatcccagcccaggccgcatccctgaagtccagacctgatcttcactgaggcatctcacagatatcctgatggagcatgtctgaagctgagtgcccacatctggccctgccagacttccccatcccaaagacaacttcttctaactgctcaggccaaacccttggtcctccttgactcctctcctgcataccccatctagtccatctgtaaat

SEQ ID NO: 159535 - DNA, 187 bp, Homo sapiens
cttgaatgtcaggacctctgccagactctgactgggaggagtttggattggttacagagtaagttcagaattctcagtgggaccaagttgggtgaaccctatctggtctgtagccatgagtaggggtcctgcagtttcccacctgactaagggcaggttctcttctgaatagaacacttctcaatct

SEQ ID NO: 159536 - DNA, 653 bp, Homo sapiens
tgtaaacattctgccagcattgagagtcattgagtttcagcattcttaggaactgagtggtattatttgagataattgtcaattccttggctcgttggaaattcaagactgggtataactgagtagaatctgtgtttttgcttgtaacagaaatgagactgagatcctctttctgctctgatttttattttttacctcctcttctctcggatttaattctacttaaaatcatactggtcagttaagccgctgcagaataacagatatgtacctgacacgtagtaaatgtttgataaacgttaattactgttactggaatccagatgtcagctgggcttgtccagctccttaagctgactgcattgaatctccagtccatgtcctcagagcatctgctaatttgatgtttgtgggactctaccggcctctgccttggtgtctgctgctgtgcctagagttgttctgcactgagttgacccagatgtgaaatcacccctccttcacacaaaaccctcataataataccatgtgtatatagcacccacataaggtaattgctgtcattatccccactttgcagatgaggaaactgaggcagagaagttacataacgtttttcctagattatccagtaagtgcgtggtggagcggac

SEQ ID NO: 159537 - DNA, 201 bp, Homo sapiens
ttttctatgtttgaacattttcaaaagatgttactaaaataaaacagattcaacacattaaatttatatatatccataactccatacagatactttaaaaaaaactaacttcccacattagaggtgtttacatccaaacttcatagtctgaaaattgttaaaagactaaagttcacccccagttgatacagacaatctatt

SEQ ID NO: 159538 - DNA, 498 bp, Homo sapiens
tcgccatcttttgtctttctgtggagctgtcgccatgaaggtcgagctgtgcagttttagcgggtacaagatctaccccggacacgggaggcgctacgccaggaccgacgggaaggttttccagtttcttaatgcgaaatgcgagttggcgttcctttccaagaggaatcctcggcagataaactggactgtcctctacagaaggaagcacaaaaaggggcagtcggaagaaattcaaaagaaaagaacccgccgagcagtcaaattccagagggccattactggtgcatctcttgctgatataagggccaagaggaatcagaaacctgaagttagaaaggctcaacgagaacaagctatcagggctgctaaggaagcaaaaaaggctaagcaagcatctaaaaagactgcaatggctgctgctaaggcacctacaaaggcagcacctacgccaaagattgtgaagcctgtgaaagtatcacgcttcccgagttggtg

SEQ ID NO: 159539 - DNA, 255 bp, Homo sapiens
gactcttgcgtgtgaccttgatcaagtcgcttaacctctctgaactccaatttcaagtacaaataaggggcaagagccaaatgttccataaaaacactatttttaaaaactgtcttgggttctaagaacatgatcttgtaaagcatgtcaagatccttacaaggatcttgtaaggaaaaggttggtgtcgtggatgggccagttgtccaggtccttcctcgtgagctccatgagggcagtgcccttgttgggcct

SEQ ID NO: 159540 - DNA, 278 bp, Homo sapiens
atatcccagccctttaattgacacagttattcctagcactcattgttgtaatgacctgcagccaagacaccaattttctgctcctactgcctggcaacattgtagtaaataggactgcatcactcaaactacccaatagcaaagttagacttccacaaaaaggtttgtgcagacctaaaacccctcatctatttcactgtagctagaatatctctaaaaagacaaatcagattataaaattcccctgctaaaaatcttttactgattccccactgttg

SEQ ID NO: 159541 - DNA, 162 bp, Homo sapiens
ggaaactgtttactaatctttgattctccaggatccagcaggatgcctagcagttagcaggggctcaaaaaacggttttgtgaacaaatatttaaaagtgacactttaaacaaattaactaacagacttcctggatattgccaatagtgacactgtagcaag

SEQ ID NO: 159542 - DNA, 329 bp, Homo sapiens
agattgatggagcaaagacaagctggcacagctggggccaccctagatcatcctgctcccagcagagcctgcagccaactcacgcccttttgagaactaatgaagggctggtgctggagacatgaagctgggcctggaagggccagtagctctgcagcagcagctaatactccatttgcacgtccacaccctacttctccccttcatggggaagctgggcatcaggcttgtcacctccctctccctcatcatcaagtcccatggattctgtgccaactcagtctctgaggtgtatgtctccatttgcagcattcccagtccctttcctg

SEQ ID NO: 159543 - DNA, 465 bp, Homo sapiens
cggcggggttgggggaggctcagaaaaatgcaaccgctaaaatttctctggatggagttttcttcagtaaacagtagaccctgggaaacataacaggttccgaaaacttaattttgatgactgaaagtcagagaaacagccagctgaatcagctccttcttgggcagtggtttagcctacttatctcatatcagacctaagggtccagctgcttttccttggttctaaagagttctattctggccaggacccatcccgagacagacacttctgtctgcagccctgaaaactagaggtcaatggaagggctcaaattaaaggcccacagttgggcttacaactctccatggtgttcaagccttctcagaggagctggtgtggtggagccagggtcaaaggtcatagtaaatagaaagtagccagctttctgcctgcataacatcatcttgcctaaccagactcaaa

SEQ ID NO: 159544 - DNA, 435 bp, Homo sapiens
atggagataatgataatagaaaaacagaagtactggccaggtgcggtggctcacgcctgtaatcccagcactttgggaggctgaggcaggcagatcatgaggtcaggagattgagaccatcctggctaacatggtgaaactaaaaatataaaaaaattagccgggcgtggtgtagtaatcccagctactcggggggctgagacaggagaatcacttgaacctgagaggcagaggttgcagtgagccaagatcacgccactgcagtccagcctgggcaacagagcgagactctgtctcaaaaaagaaaagaaaaacaaaagtgcttctactcctagcaactctcaagagttgatgctcccacagtattgctgggttacccacaactatactgaaatattttatttctatttctatgccatgctcactcttattagg

SEQ ID NO: 159545 - DNA, 261 bp, Homo sapiens
tctattgatcttgtcaccttttcattttcccttatcccccttatgtattcacttccctatttaactctgctttgtcattgtcagatcatcattatcactctcaacagagcgagactctgtctcaaaaaagaaaagaaaaacaaaagtgcttctactcctagcaactctcaagagttgatgctcccacagtattgctgggttacccacaactatactgaaatattttatttctatttctatgccatgctcactcttattagg

SEQ ID NO: 159546 - DNA, 510 bp, Homo sapiens
gtaggaggtgggaaggacattctaggggaagcgaatatatgggtgggtgtcaggggagtcatgaagtggctgtcacactggacgggtgagaagggagcaggaggtggggtgatactgtgtgagcagtgcccctcctcaaggggcctgatggagctgctgggaacatgaagacaggacactcgggtcacccctcagaaagagccttctggcccagggtgaaggccggagatggagggcaggagagcctgggaaaggaggggcaggcggcagggagtgaggaggaggggtaggttactgtcagggtgagcggggtttcctgggtcagcctcttcctcagctgacggctgtggaaagccagcactcctgcctcctggacagacctcgcaccaggtcccgggcacttgcgggtgggcgtgctcaatggcagaacacgtggggctgagccctgtgagaggtgggacccagagagggggctggggccgaatgggtgtaaaggtggcaggtgacgcc

SEQ ID NO: 159547 - DNA, 598 bp, Homo sapiens
gcgtccgcccagctgctcctgccctggaaggcgcatccgcccagctgctcctggtcccaaccctaacctgcttctcagcctttcctgcatcctttcgcatagcgctctgtgcagccttgcctggatgcatctagttgaagcccctgcccccagtccctctctggaccctcttggagtgctgtagcgcctttggccttatgatatatcctctgccagatcctgccctgcttgaaactttgagctcctggctgtctggaatcccagctacttgccgactcactctcgcagttgggtggcacagttctttgtctacagacctgtgtacaaatagcagctcacttatacatagcattgaattggactgaaacttacagcatcgccgagggacccctgggctgctgggaatgacacccctttgtcatttgttgtgtgtgtgtatccatctggtcacgcagcacatctgcgttattatctattcacagacacctgtatctaccatgttcaggatgggtaaattgggcttaaattccccaggaactctagcatttagatcataggggtttgattcaaccccttttctcaagtcattggctgcaat

SEQ ID NO: 159548 - DNA, 607 bp, Homo sapiens
tgtcagggtgtgagggagcgagttagggtggcagagatggacagaggtagcagctgactaaatctcattggcaaaggctatttcagagaagtcgttttgtttcctgggtgcctttgtaaccagtccagaagaataatatttcataaattcacccacatgttagtatgggtggattgttacgacagtgagaggttttctgttcatacgctatatattcatgtggctctaaattctaaaagcatagagggtcatacagtggaagattcctccagctccattctctcatcatccgttcttactcccaaacctagctatcagtttcttatggaacagatttttttccctttttctactttccagtccagaagacccctgacattcattggtttagagtttgtgatttccaccttccaagagtgacctgagggctcctcacgtggtaatctggcagttttgcgggactggatttcagtgctcctctgtgaggctagcacaagggagcttgtccctcccagggtacaagccacctgctcagctaccccatgcccacgaggcactcatgtttctctttccttatggaccatgcagtgattcttacaaaggattt

SEQ ID NO: 159549 - DNA, 218 bp, Homo sapiens
ctttcttgaccatatcctttggtattttttttttatgtttgggatcttattatatattccttaaagattgtatattaacctatttgtttgtttgtaaactggctaatgtaaaatccactatagacctccctattttaagagatgctgcagtaagtccttttataataatccctattatgctgatttggtgaatctgtatgtatgttaggttttcttaa

SEQ ID NO: 159550 - DNA, 102 bp, Homo sapiens
gaactgattcagtgaagaaggaaaattaataacaggataaataagggagaaatgactcagtatttgaataggcagagaacttgaggcctagtgcatacatgg

SEQ ID NO: 159551 - DNA, 739 bp, Homo sapiens
ttctccttcaccttccgccgtgattgcaagtttcctgaggcctccccagccatgctgaactggttctgcaggatatacacgaagtatggcaccaacatctgcttctggtgaaggcttcatgaagcttccacccatgacagaaggcgaagaactgttgccagcatcatgctacaagcctgaagggaaggtctactgacagagaaggacagagaccagggaaacacagaaaaggagagacaaagccttgacataccaaaccagtgcctggcctacctatggacttctcatgccaacttgggagacatattatcaagactgaatcagagagttgacagcataccaggaagtgtcactgtatagtttggaagatggaaatcatactacttttttcccatgtaagcactccaggaaattaacctccaaatacaactgaggaataggcaccgttatggcttttttacagatcaataaactgatgaaatacggtgaagctatgtaagtagaccaaagatgtacaagaagacacacattgagcagaaaataaatttaagcctggcttctcaactctttatttaaccagagacggttctatctcaaacatgaggttctatatgaaagcaggagggaattaggaagtaaaatctggtgagcatttttcctgaaatattacagctgtcattctcagggccctcgtcctgagatagtggcaggttaagatattaaatttttatttctctgg

SEQ ID NO: 159552 - DNA, 347 bp, Homo sapiens
cgcaaaagcatacctttattgccataattctgtgtcactaagtagcctagaatgccagagaaggtgctggcatccatcccctattgtacctccagggctgagtggcagacaaaagagctttaagctccccttgcccaatcaccaaggtgccctgtgacttaggctggtccttccacttcccttctctgcctcagatttcctcacctagaatttgtgtctgaatgctgttacttctgagaagccaaattatgaacttgaccccatcccactgttttgctgacggatgaagaaactcttgcatgtaaggtttgacacgtgaggtatggaaatgaactattatacacata

SEQ ID NO: 159553 - DNA, 97 bp, Homo sapiens
aactgagtcagtcatgccaaagtactacaaaaattgatgaatcaggccgggcgcagtagctcacacctgtaatcccagaactttggaagctgaggtg

SEQ ID NO: 159554 - DNA, 377 bp, Homo sapiens
ttccctgctggtgtgtggtgcgcagggtcctgcacgcaacagcatcgtccacacacactgcacacatcgtggaatggtcgtatgaaaaacagcccctggtccacacaccacacacgtcgtggaacggtgcacgtcgtggaacggttgtgtgaaaaacagccactggttgcacacagggttgtggactgttgggaagaaacatcgatgctgtttctcacatgatttttcatcctgtggattttcatttaattgtaacatatttctgatcaaaccaggagtagtcttattgcagtcctgtattaacctctgttcttgaaaagagaccacgtgatttatcattttctctgcagcagtaattcacactgggttagtaagca

SEQ ID NO: 159555 - DNA, 157 bp, Homo sapiens
tgttcacagtgttaggtgatgttggctggaattgtttgccttcgcctctagctggaaaaatggaatttgcaggcagaggtattgtaggatctgcagctgtgtgccaggaacagcactattgagtcatgatgacacgaaacagcccagttttaaagaa

SEQ ID NO: 159556 - DNA, 450 bp, Homo sapiens
tgtattgtacgtatttaaggtatacatgatgcttttatatacatacacaaagtgaaatgatgactacagtcaagcaaactaacacatccatcacctcacctagttacttttttacactgttgtttctctcatagcacttttcacaggttgttattatgtacttattagtatttgtctaaagcctatttcccttgcttcagtgtaatctccatgggtatagaacaagatgggttcttttttgattactgttgtgtacttagaatctcagatatagaaggggctcagtaaatatttggtgaatgaataaatgagttcaaaggctgtcaagacactgctatttctggggattcgtgttcccaggtagatctcccaggccacatttctccatgtgattcaccaattctttttttcccagtatgttttctttcctttttactcccgattgttcct

SEQ ID NO: 159557 - DNA, 360 bp, Homo sapiens
gaccagtgttctggtctcttgattcctggcccaggctctggacctgcctgtggtgccccatggcactgtggtcagcctggcactgagaaggcaggcaactccactttacccataggaatggagacagcaatgggtggatgctagaatatgggtaacagctgttgttatgagagagggagacagctgcgaaaacaatggataactccactgtaatagacggatagtatggattctgaatgtgtgggcggtggctgtcttttaaacaagttctccttccgaaatactcaattcgaccaatagtgaaaggcaccagggcaaatccatgataagtgaggcccagaccctgcttacaaggaactc

SEQ ID NO: 159558 - DNA, 107 bp, Homo sapiens
gcctgctccagcagcgggagtttgaggaccggcacccctcgtcgcgggcgcactcgggggatcccgtgggaggagccccgctcgcccctccctcgctgcctgtctcc

SEQ ID NO: 159559 - DNA, 233 bp, Homo sapiens
ttaggacatactatgtactagtattgtgtgaagtgctctacacaacttaatttaatcttcatgcaacacggtaagatagatgtgttatttctaacaagatcagataagtgttccagtgttgcccacctgggtaagtggcagaggtagaattccaagatgggactatgcccatcttctttccatttttcctcactttctcaaatgttggtaccatagaaaaatccctggaatta

SEQ ID NO: 159560 - DNA, 390 bp, Homo sapiens
tctctagcttacacctctcccctgaactccagattcacttattcaacagcctacttacatctctacttggatgtctaataagcatttcaacttcataaaaccaaaattaaattgttgaaaccacccccctaacatcccacctcaaacctgttcctcctacaatcttctccacttcagttactggcaactccatccttgttttttcgccgaggccagatgccttggcgtcatccttaacttctttcctctcacaactcacattttatctgttagcaaatgctgttgactctatcttgaaagtacatacaaaacatgcttacttctaaacactactacactatgctgtatttcaagccaacatcatcttttacagatcactgcaattgactc

SEQ ID NO: 159561 - DNA, 532 bp, Homo sapiens
atactcagtgaggctgaagctagtgccctaattggtaatggacaattggcgtattagcctttctggaggcaatttgactacattattgaaatatttcaagatctttcctttgactcagcaagtctacttccaggatttgtccaaaagaaataatgaggatggtttcataaagatgcaagaataatatgttaaatgcattgcacataatctttttgttaaaagtgaacaaccagagggctgagggtctctgcctccatgcccacgtctcaaaattgctaactcctgttgattccactgtctgaagagctcttctgtgtctacttcttcctagttgcactgccatttcctagttcaggccaccatcacctttcacttggattactgcaacagcttcctacatagcatcccatccctttccggtttactctccacctggcaggcaggatgagatttttaaacacaaatcaaataacctcccactcctgataaaggtcttcactggcctcccatagccttatgtccaacctccttg

SEQ ID NO: 159562 - DNA, 481 bp, Homo sapiens
tagggaagatctgtccggtgttttagctagaggcaaatccaggctcactgccttgtgcttgggattataggactagaatggtagtacctacaattaggtattctatatacagatctttaatctccctcttttcacactcatccttaattctgtgtatagtatagggtacacatcttcaggttccatcaggtagactggcttccagcccctggtaacagattctaggctgtggctttctctagttattttatcttcaacctaatcctctctgctcctcctctcctccaaaaaaatggaaaacctcttatttgttggtggcctcctttattctttttactgttatgggatttcagtcagctctttgtgtttttttcagtggggtctcaggaggtgggcagatgataaatgcatgtgctttgtctgccatctcaaagcttcagttttctattgttaattgttaccaccttctgaagtgatagcg

SEQ ID NO: 159563 - DNA, 311 bp, Homo sapiens
ctgagtgtgtgtttttcagtaacatctattttgcatcactgcagaaatatttgtacagtggctgaaacaacagaggttcatttatttcactcacagaagagtcaaaggaagatgttctgtctggcaagcatttttttttgcagtattcttgtcataaactttcaaaccagctgggtgcagtggctcacacctgtaatcccagcgacagagaggctgaggtgggaggaacacttgcatggcctggaaggtcaaggctgcagtgagctgtgatcatgccactgtactccagcctgggcagcgacagagaggct

SEQ ID NO: 159564 - DNA, 126 bp, Homo sapiens
tccatagcttgatagctcatttctttttagcatatgaataatattccattgtcttaatgtatcacagtttattcattcacatactaaaggatgtcttggcagcttccaagttttggcaattaataa

SEQ ID NO: 159565 - DNA, 360 bp, Homo sapiens
caagaaggcagctattgcaacatccagcttatctcacgaatttcagtgattagtcatgccataaaggttctggtttaaaacctgaactgaaaaaaggctaggcacggtggctcacgcctgtaatcccagcactttgggaggcagagataggcagatcacttgagctcaggagttcgagaccagcctgggcaacatggcgaaacctcatctctatgaaaaatacaaaaacatagccaggcctgggggtatgcgcctgtagtcccagctacttcggaggctgaggtgggagaatcacttgagcccccgaggttgaggctgcagtgattgtgccactgcactccagcctgggtgacagagcga

SEQ ID NO: 159566 - DNA, 430 bp, Homo sapiens
cactgaggggaactctgccttcagctaaggctacacaactatcctgatggtggactgtagcaacttgtaggcaaggggtacagctcagggcagctacctctccctcttctcgggccaacctggaggaagttccttccagagtccaggctatacttgcttctggcctgcaaattcccgagaattctttgaaacctaggaggggcctgggtattatgccgttttgagtgagaattcagaggccagtggaattagggcaatcaggcatttcctgatcatctgctatgctccaggatgctgacttgaagagatgaacaaggcaaaatgcccattctgacggcactcagaatttcacggggaactggaaggataaatgaatctgggaggaactgctaaaacaggtaggagagggtaagcttgttagaacctgaga

SEQ ID NO: 159567 - DNA, 413 bp, Homo sapiens
ctgggcaggaattctaggttgcaggcaggcaatgagaacacatacatccagtttctatggtacctgttagatgccacccatatgctgacactgccagctcttaaggaacaggagccagcacatgtgtacaagaacatgtgccctcccatttggccagagggctaggactacaaatgccagtgtcatgagactgcctcagaggactgtagggtccttgagcgatctttgatcaaagaggtggagagaataaagaacagtaagtagagtgaatgaagtgggaaattggcagtataccatttgaggggtgaggtagggttctacggctatcctttgtgactccagaaagtttacagaagccttgagttaaatacagatgccattaccattattgctgtcactttattaacagctga

SEQ ID NO: 159568 - DNA, 216 bp, Homo sapiens
cccgaagtgcagggattacaggtgtgagccaccatgcccagccaaggtgctctttatattcaatcagacaaggttcttgttggttcagttttttgagggcctgttaaaggagaagttgtagacagcagggcacaataaatttaattgtccaattatttagcaataatttcactctacgatttttgtttttttgaatgacacttttttctggggcag

SEQ ID NO: 159569 - DNA, 273 bp, Homo sapiens
caaatcctggcttaatgtaatatccagcatgctacttaattttcttgtcttcaccttttcatatccacatccacctaggtgccacctcacagtataagccagcataatccattcttctcaatgaaaccacaatacatctgaccctgcatctcaggagaactgtatcagccacagcacttccagttgactatgaatctgaatgttatgcctcaggagaaacatccttgctgggactgagtagtgattcaaggagatagttatgattcagtcaag

SEQ ID NO: 159570 - DNA, 628 bp, Homo sapiens
tatttcagagaagcttggaaaaatcattacatcttccacctcaacttctatatggtcccattataagcatctggtactgccttggcaaatttttagcataatcctactgttttctagacatctggattgaatatgaactgtagaggggctgtgggtcttttttttttttttttctgccttattggaaatcaggtattatgatttgggcattttcctcactgaatggtagccgggacctgattttggggtgggagatcttttattttgtttctcatctaattcctggaaggcctctctttccttgtgtcatgtcccagtttacccttatgggaaaggctgtagcactgtgagccaagactgggagtcggccatgggataaaaagaattggcatgagccatgggctcagtgaaccaaaaaactccagccttgactgactttcagctggaaatctatcagatggccttacttttccttaaaaataaatcaagctctgcctactattccagacttttactgggccttgaaagcaggggcacacatccaactacagtgtgggccgtactcaccagctggtccatcttgctaaaagtatttggacatcactgatgaacctacaaacgccaagaa

SEQ ID NO: 159571 - DNA, 565 bp, Homo sapiens
acaattatttttaattttaggtgtgatataatattgtgtatattttttaaagataaaagatgtatttagagataaaaagatatatgcatcccaggtatatctgggatttgcttcaaatgaatgcagtggtaagggggtaggaatagacagggtataaggaggcaagattggccatatgttgatattattgaagcaaggtgatgtcgatgtggaggttttaatatctttacttttggtatataatttatatttgcattcaaaaataaaacaaatagctctgatcaaaaaataaaaatattgggggcagagggtgcaggagatatttccagtgaagtatctctgcgtgattgagcacagtaaagacattctttactgcttcccctctcaccaaatcctcctgcattcataggactagaaacctaaagaggcatctgaagtcacatcttaaggatgcataatggaggggagtttggagagggaacaaaattattaaggaggattatactgtcaccactcgacacaatggagactgctgcttttaactgccttaaacaagtcttgcttc

SEQ ID NO: 159572 - DNA, 272 bp, Homo sapiens
gaaggacctgcgtacggctattttacagttaacttttttatatatataagtaggagtacaccgtaaataatgattttaaaatacagtaaatagataaaccagtaacatattcattatcattatcaagtattaggtcctatacataattgtacatgctatacttttatacagctggctacttaataggttcgtttacaccagcatccctacaaacgagtgaataatgtgctgctgtatgatgttacgacatcactagatgatgggaatttctc

SEQ ID NO: 159573 - DNA, 315 bp, Homo sapiens
aatagtagctttgatactaaaaatgactgagcaattttttaaaacaaaaaatattaaaacaggctagtaggctctgactcatgttactcaaataatatttataaaaaggctagccattcttggccaaaactataacaaagacattccaaccatctactttctgttgcttccagaaaatcagctgtcccattcactaaccacctatgtatttatccttccctttgagctggttaaaataagctaatacctgaaaataggttaaggcttaactctatttttgccttttttttttatatatctggaaaagacttcagg

SEQ ID NO: 159574 - DNA, 461 bp, Homo sapiens
tttggtcattctaggaaactgttcagattaggatagagatatatttaagtgggtgaaagggagaagaaaatatgtattgcctgtgaaatgctattttagaatgttctatgaaaaccctattacattccaaggacagcttttgtagttaaaaacaaaataaaaatcatatgatatggatcacagtaaacaatgacatttccagtattggtgcacactaacttttttaagtgaatacttgtcatgtgccaggcccttgctaagcttttcacataaacagcctcatttaatcctcacatcaacatcagtccttttttggggggtgaagggtagagacagggtcttacagtgttgtccagtgtgatctcaaactcctgtgatcttcccagagtgcagggattacaggcatgagtcactgtacctcgccacattaatccttaaaatgttagagtacccaaaggttt

SEQ ID NO: 159575 - DNA, 283 bp, Homo sapiens
gtgcctgtaatcccagctactcggaggctgaggcaggagaaccacttgaaccagggagtcggaggttgcagtgagccgagatcacaccactgcactacagtctggcgacagagtggagttaaaaaaagagagagaaatagaaagacttaagagatatctatcttatatatagaaaaaaggagaaaagtttttaaaaagatgtatctaagactttaaataagggaactattgcatgaggaatagagaagtagagttgccaaggatgactctcaggtttctgcct

SEQ ID NO: 159576 - DNA, 178 bp, Homo sapiens
cagccaagtccagcctaaactgcagtcacaaaattgcaaactaaatgaataattgttttaagccacaacgttttggagtgatctgtaacccagcaaaagctaactgatacaggtaagaaatgaagaaatgtaattaacaaaataaatgccatctctacaatgatgatttccacatctc

SEQ ID NO: 159577 - DNA, 220 bp, Homo sapiens
ctcacactccaacatacacacatatgcacataagcatacctgcacacacaaacatgcagacacacgctacctcacactcatgccaacatgcacacatctgcatagaaacatacctgcacacacacacaaacatgcaggcacatactacctctcacaaacatacacacacatccatataaacacatgcacacacagacatgcacacactatctcaaacatg

SEQ ID NO: 159578 - DNA, 735 bp, Homo sapiens
actgctctcttacaggtggcctgtgaccccctggccaggccaggacttctcacaggtctcattcccagagaccagaggtgtccctgttgacttgttcctgcttctgggcttctgtattgaaccaaggcgcctcctgtcatcttggcttgtttctctctggtctggccgagttgtctagtgtgtgtccgtgtttctgcattccctccctctgtgtgtagagccttaacgttgccattggctcctcccaacatccagtatgtctttgttgtcgtcctgtcttcttttcacaccaccctgcccctgcagacctgctggtcggtctccagggccccagcacgtcttcccttcagttggtcccacttatctccactaggctagtttctcataaaatgctcatcaacctcatttctcccttctcagtagctggccccgttacagcaatgccatcacagacctagctctaatgtaaaatgctagctttcatcccgcccacctgtttctgaaatgtgctagtagaataccacagcagaggcaagcttagctgttaaaatctttgcctggtgaaagtagatactgtatgcttgtaaggtttatattgttacattcattttctccagatgtttctgttctaaaggtgggaacagtatcatcattatatagaccgccctttgtgaaatgtagctgtggtgtcagctgtggtgtcagaatggtcttacatttctgttttaagaaatg

SEQ ID NO: 159579 - DNA, 603 bp, Homo sapiens
  misc_feature (3)..(3): n is a, c, g, or t
cantgagccacaaacaccacaccagcatctccagggccaaaatgcctgtcaggggacacattctcagggaccccctctgtgtgtagagccttaacgttgccattggctcctcccaacatccagtatgtctttgttgtcgtcctgtcttcttttcacaccaccctgcccctgcagacctgctggtcggtctccagggccccagcacgtcttcccttcagttggtcccacttatctccactaggctagtttctcataaaatgctcatcaacctcatttctcccttctcagtagctggccccgttacagcaatgccatcacagacctagctctaatgtaaaatgctagctttcatcccgcccacctgtttctgaaatgtgctagtagaataccacagcagaggcaagcttagctgttaaaatctttgcctggtgaaagtagatactgtatgcttgtaaggtttatattgttacattcattttctccagatgtttctgttctaaaggtgggaacagtatcatcattatatagaccgccctttgtgaaatgtagctgtggtgtcagctgtggtgtcagaatggtcttacatttctgttttaagaaatg

SEQ ID NO: 159580 - DNA, 384 bp, Homo sapiens
ctaaatggggctatctccagatataactgtcactagtacgtgatggataaattaaatacttgcttcaaatccactttataataagactagtaggtaaattgatgaataaaggttaaaagtcaccatgtgtctgaaaagtcagttggactttgttgggacagttgtgattggcaccatgttttgcctacttgaatttcctgcatcgtgtttctcccacaggatgaccattgttcctttactgattgtggaatagaatgcaaataacttcagctctttatgattttgcatatgctgaattatcagtatcatattttccactgttctccttcacataacatatatcagctaagccaaaagttgtatatattccctgtctcaatgtcc

SEQ ID NO: 159581 - DNA, 128 bp, Homo sapiens
cagctactttctcctctggcatctattatctgctcttctccttcacccgttcaggtcccggggggatggaagttccctgggggtagcctgccatcctcatcctgggggagtgcacccccggctttgct

SEQ ID NO: 159582 - DNA, 365 bp, Homo sapiens
caagcaaggtaggagaggatgtgctctgtatcaagaatgttgaggcctagggtaaagctggcaggtaagggcggagcaagaccaactaagaagcatcttcccttggagaaaactgtcactcatcaagtggatgtccatggcaatctaaatggagattttcccaaagggactacaaatgtcagaactcaggtgatttgacatcaacaaatctccctgaaagccactcgggagaatatctgatggcatgagttagcatctgtggactagggttggaagatctgacttgagcgccaattcctctgtgtacactagtcagctgacctaagatacatcattgccttctctgagtctcaaactcctcatct

SEQ ID NO: 159583 - DNA, 380 bp, Homo sapiens
ccagtttcaaagctgaagatgagaagcagagggacaagtgtcatccaagaattcacttgagtcctatgcctgcaacatgaaagcaactgttgaagatgagaaacttcaaggcaaaagtacaacacgctgtagtaaaccctgaccagaccacaaagaaggcttctctccataaacatcagatcaggcagctagaacgattactgggctctctagtaactgtcacctgtggtgggtctaattacaggctaccccagcaagcacgcccacatcacacagcaataaaagggccctccgcttgccaagcacagccagacaatggcgagcacatgccacctgatggggagccccaaaagatcagccagagagactaataaaaatga

SEQ ID NO: 159584 - DNA, 421 bp, Homo sapiens
ccctctccccttcctttgcacatgtctgtatcatgcatctccgtgtgaatatctcatttccccactttccattttgacaacttctactcatctcttgggctacagttcaaatacaacttcctcaggaaaaccttccatgactcccaattttaacttcggtttctcacttgtaatactgtattttcttaaggtagaacttatgacaaactgtaattatgtattaatttgggtattatacttgaatgtgaatttcatcagggcaggcactatgactttcacatttcacattcacggttataaccccaggagccagagaagtccctggcacatagtaggtgttcaatacatatttgttaaatgaataaatggatgaatggtctgtggaaatggaggtcaaggtcaggcatgcattgttgtagaa

SEQ ID NO: 159585 - DNA, 588 bp, Homo sapiens
aggttctggccttctatttttctgttctgtaaagttgattttttccttttcagttcttattgagttgattggggatagagctgattatttccattaacccaacctaaaatagacttgagaaaggaccagaatgctttttgtaaaataaggagaagtaccaagcgaagtgaagtgccctgtttagctggtcagtgttttggggttttttgttctgtctcttcttacagaagaaggatctgacacctttatggaaagttgtttggtgaacttgtaatcagaacaaagcagttatttgcattcctaggacagtgtagttggtgactgataaatgttcatgttcttttggtttctttccagtgtatagagaaatctaccaaatcaagcagaacttttcactggtttgtcagggcactctttaccctgtctctgccaaaaacacttcaacaagtctctgagttttttttttttttcctgccatagattttatacagactaattggccttctaataatactctttgtcaaactaataataaatgacaaattaggttatatcatattccgtttatgcctttctgagggaatatac

SEQ ID NO: 159586 - DNA, 566 bp, Homo sapiens
gtcagtactcaatacatatttgttggactggttgcactacaacatttttaaaaggttccctctgaagaacagtgatcagccctcaattttacttttctgcataaaatcttaataaatacatacagctgtaatgtaaacagtatgacattcttatagaatctgtgtcagtagaaaatgagtgagatgtagttacctaccattcatgaatgtatagaagaggtgagaaaaaaggacagagacttaaataggttctccgcagaagacgatacccagttggcccaagaacatataagaaaggcactcaacttcattagtcatcagggaaatgcaagttaaaactacaatggaaaaaaggataatgtccgtatgcagaagaatgagctaagaaattatggtatatattcacaagtgggatactacatagcagtgtgaatgaataaactaaaatgcataaattgtacaaacattgtacagttgtacaaattgtacaaacattgtacagttgtacaaactgtacaaatattgagtaaaaaagccagataaaaaatatagtatattgtataaca

SEQ ID NO: 159587 - DNA, 441 bp, Homo sapiens
tgccctaggactcttctctccacctgataggctctttccctagatatctccatggcttgctccctcacttcgttcaggtctctgcacaatgtctcttgacacccctctatctaaaacagcaacatctcccctgctgaattctcctttacagtactcatcgccctccattgttcatatatttcttttttcatgtatctccttccaatatgatcaactaggaacttaagccccataagaacaaagacattcttcagttcactgctatttccccagcaactacagaatgctcaaatatttgaataaatgaatgaaaattaagtaagtttttcaaaaatctagaacacacttttagcatagagaaaactgaagtacgataggaggttaattcacttcatataacagcataaactgcccttccttaagtaggagacaataggtaca

SEQ ID NO: 159588 - DNA, 515 bp, Homo sapiens
aatctggaagggggaacattaagttttgggataaaggtaaaattatagttaaagtggttgggaaagtctttacagatgacattacactgaaaaaagacctgaaggagttaaaggagtaatctttggaaattcagaggaagagcattctaggaaaaaagaatagaaaacataaaggcattgagggaggggtgtacttaggatagtcaaggaatggcaagagccagagtgtcagggcagaggaagcaagagagagttgcagatgaggtgggggatcaaggattctactccatgtccacccctaagtgcagtctttcccaaagttgtatcatgaactcacttggctgtctatcttcttcatctttgccatcaggtccattcctaagccttcattgaccacaaactctgtaagttctataaagaaatttccaatataaaaatagaagttgtaacattagcatcaaagtggcatgactgtttaaaaatattgggtttaattctgttaaggttaaaaatat

SEQ ID NO: 159589 - DNA, 477 bp, Homo sapiens
ctgttgtagtggcagtttacacataaggggaagaggctagaatgatccatgtggtaatgcactagagttgaatatattagtatgaccacatgtttagtttaatatagatgactacatatagaaatatttattcatgtgtctgtatacatgggtttgtatacacacatatatttccttgctctgtcagctgagaggacctagatgcaacaacactccagtaacaatgaacatatctagtgcccagatcttagattgcaataccattctacaatcagtgcaaccaaggatctatggagaaatggctgatttctaggactgaggcaggaaatatataagatgggcctggagtaccttgtagctccagaaagtaaggaaacattcaaaacaaatgaaaaaaacaaatcaggaatgggagtatgtcagagacaaggagcaaaatgaaagagcttccatgggccaagatggaacaatttgacc

SEQ ID NO: 159590 - DNA, 269 bp, Homo sapiens
gtccagtgcagaaaccgtccatctgatgcagtgtggagagtccacagcagagcagccgagtgtgtgggggggtgcacaatgggatcaggagggtaggagggctggaagagggtcaaagagggaaaaggaggaccggggtgaaggacagagagcgtcaagtcacttcagatctcagctgcctgaacatttcacaacatcagctttctgccaatctgcacacctgaaagcggagtcttctaaagcccccttactgagaaaaggaggtgaaa

SEQ ID NO: 159591 - DNA, 101 bp, Homo sapiens
ctccacatttctttacctgaggtctctaaaaggccttttgtttgtgtgggttatatccacatatattctccatctccattttggaaattaaaactcagaaa

SEQ ID NO: 159592 - DNA, 434 bp, Homo sapiens
cacaccacctgagtcaagttaatcatttccttctaattttaatgcattaagttttacaataggcgttaaacctttttcaaatgcaatggtttttcctttagtcctttaatacattgactcacagaaagattgttttgttcttgggacaaaccctacttgatcacatatatttttaatacagttcacctaactattaagagatgaagcaggaatttgtatcctactgtgaacaacccaaagccagttcgtgatcttttcaatgtgacattgtcacagggtacactttgtcacggtgttagcacattttgtcttctttggagcaagttacagttcataatagaacttttgttgtggggaggcctaattttctagggaggaagaggagaaaatgtgaagagattaaggggagatacacctgacaggaggaaaaacca

SEQ ID NO: 159593 - DNA, 314 bp, Homo sapiens
gtaagtggaatttctggtgtgaggttatcttttagatatagatttcttttaaacttaaacaaaatatgtatgtctctgtaacatgtactctagttactggattttaacaatgataagattaaatggatgttttagttctatgagaacctctctaataatttggtcatgggtgtctttaagaagccatttagcatgaatctttagagaccaaaggttaggagtatttggtggggtagtactagtagtatcgtttaaagggaaataccagaaagaaaacctcttggaaactgctttctcaaataatgtaaagcttg

SEQ ID NO: 159594 - DNA, 237 bp, Homo sapiens
agggaatacagtggcattcaacagacaccttgtaactcatcacagatgtccatgagaagccacatggatggaatctgagtccaggcacacattttccagagaaagaaaagaagttgctgtgggtagaaaggagttttgaggctccatggagacaggctttagacggaaaaaagacattttagaaaatgcagtgtagaaagctcccacacatccagcccactaagtctctgaatgtga

SEQ ID NO: 159595 - DNA, 289 bp, Homo sapiens
ggcgactctagcaggatcttctaaatgactgtgtggtataagcttctgcaaaagtgactaaaatctgatgttagccatattcattggattcatcctattttattttcctcatagcattataatttttgaagttctttaaaataaattatccacttgtttatgagaaaaactatctctaatcaaaaaaaatctgctttatactatattatgttgcccaactttttatttgattttaattctcagccatacagccacttaggtacagccatttaggtaacagccatttagg

SEQ ID NO: 159596 - DNA, 717 bp, Homo sapiens
ggcacagaggaggaagggggtggcccttattcagaacccctcaggaaacagaacaaagtcgaaacaacccgctgactccgcattgttggtactgcgtgcaggactaggctttctgccccgcgttctcgggaacagacgcctggggatcccgaggccacaggggctcagatcagagtagcgttgtaaaatcaggaatgacttaaaaactgtttctttttgtagagacagggtcttgctatgttgcccaggccgttcttgaactcctggcctcaagggatcttcccggctcggcctctcaaagcgctgggattacaggcatgaggcatggcgcccggcccaaggatggcatttctgatgcaaaaataccatgagtgacatagcctgagtgtggtcattgctaatgtgggaggaaaatacggagaggaggtgtctctgcagccgaggaagagcgtgttgtcaagaggtaggagggcaacccgccatggctggtgagagccaggctgaagtgtctgttggacttagcaggtgggaggccggttcgccttcaggacgtcccggaggtggtggcagaagtcgggggaaatgggctgaaggacggatggatagaggcaggagaagctcgcatgcctaaagatgatgaatgtgttcacccgttcagcctggcagacaggtgactccccactgcccgctccccatgacaccctctcttctgcttgg

SEQ ID NO: 159597 - DNA, 373 bp, Homo sapiens
  misc_feature (17)..(17): n is a, c, g, or t
  misc_feature (28)..(28): n is a, c, g, or t
gctgttctagaggatcnctcacacgcanttggtcaagaggaaatggggagtcactaaaggttccttagccagggagtgcatgagcaagtggtgaggggcagtcactgaaggctgcagctgcagcctgggtgcagtagcgctagggtggagaggaggggacagttctggggggagatttgacagggatttggtcactgaccagaaagagagatgaaggagaggaaagactcaaaggcagctcctaaatttctaggatgagtaacttatgagggagacagggcctgaggatgttcatttttgggaagaaataaatttggagtcatggaatcaaaagtgaaatatggggattggggcctgggggcagagcaaagga

SEQ ID NO: 159598 - DNA, 316 bp, Homo sapiens
accagatgttcctctgtgggccttgctggattcataagtcaggataaagccagcgtggatgcatgcatgtcaaaaaaaaaaaaaaaagtcttggccagtgttgtagagaaatgaagtgttgtttcatctgcagttcctctccagtccttgctggttgggagcactggctcccgggagactggtggccctgacactcaagccattaactgagaatgctctctaatcccttgttttcattgttggtgttccggccaggctgcccgcacagagcctgcccgttttcattggctgcaggaattgttattggagtggctga

SEQ ID NO: 159599 - DNA, 1046 bp, Homo sapiens
acacaattaaaatctgaatgaaggttgaaaggactcatttctattgaagttttctttccaacaatacaggttacaaatatgacacacagacagaaatgtttaaaccaacagctcagttaaaaatatatttcatatctcagtttaaagaaaatattggcttaggcagaaattttaaaaatttttcagatgttcacactctgcaggaccctgtgctcaaggaagcagtttctcccattaccaaccatgcttgccttaagtctaactccttaccagtgattagctcacatacaaataagaggcacaactctgacaaacgaaacatgtgaagtctgctagaaggcttctcagtgagggtttcctcaatcttaggaagagacacaaaccacctcacacccattacaatagctagtattaaaaggaaaaacaaacggcagcccagaaaataacaagtgctggtgaggatgtggagaaactggaacacttgtgcattgctggcaggatgtgaaatggtatggccttatggaacacagggtggcagttcctcaaaaaattaaaaatagaattacctttgattcagcaattccacttacgggtatacacaaagaagggaaagtgagtctcaaagagatatttgtaccctgtgtccatagcagcattattcattaacagcccagggattggggcagcccagatgccaatggataaatgaataaacaaaatgtggtatatacagtgaaatgttattcagccttaaagaggaaagaaattgacatatgtgacaacatgaatgaatcttgagggtattatgctgagtaaattaagtcagttacagaaagacaaatgctatgattccacttttttgaggtacctagaatagtcaaattcttaggcgtggggaagggggagctatcgtctattgggtacagagtactgattgtgtaagatgaagaaatgacatggaaggtggtgatggtgcacagcaatgtgaatgtacttaatatcaccaaactgagcacttaaaagtgtttaagagggtaaacattatg

SEQ ID NO: 159600 - DNA, 526 bp, Homo sapiens
acagtaactaacctagagctctttcctcacatttcttcagcagttatctagcagagggagtaggatcatgagcggagctagccacttcagcaaagaaagtgtgatgaagtccatgaacccagagaataaagccctttggcctgtcaggggcagattcttaagggcacagaaggggaaaaacaacaaaagcaagtttatattcacagggaaacataatctgtgattataaatattttatgggcaaagaaagcagcactggctgagagactggggtggagagggtggacagcaaattagattccagcctgcaaagtgatagggcagctggaaaagcagcaaagccgaggctattctgggctgtgctgcgagggcctgcgtcacaggccctggccacagtctttgttgaaaccacagccttccagcggtcagcacagaacaccttggggagagggtttaagtccatgaagaccagaggaggggacagcgaggacagaggagagtcatctgaatgactctggtgaacctc

SEQ ID NO: 159601 - DNA, 358 bp, Homo sapiens
tgtacgtgttgtgggttcttgagtcattcctgagtgatgatcagggcatccaatgatctggccaggccggagactcaggccacagcctggtgtgcatggtgggtgacaggatgagggaggctgacacaggtagtgggcatggggtgcacaggagccatagtcctagtcctaaatcgttgacctctggaaggaaagagtgtttggaacactgagtccaagaagtaggcacaaagccagcacgatccccacagggaaatgtcttttatggggcctgacaaaaaagaagtcaggaagtagaggacagagagctctctcaattatttgtccacttttcagccccagcccaaatctaaatgag

SEQ ID NO: 159602 - DNA, 526 bp, Homo sapiens
tcagatgactgcagacctccccacaaggaggagggaagctggcctccaaggaggcgcatcccacagtgcagtggtctctggccagggtgggtcattacgccattggtttatagcgccatttgcttcggccccttttggtggcatcccagggtttaaagtgaccaggcagctagtgtggggagacgggacacagctgtctgaggtcagggggtctgtatgtgcctctccggcagggaacagcctcggccgtcagaagccaggtttcagcatttaggatgcagccaacagccaaattgctttcttggttttatatataagggctttttttggtaccataagggcgggtggacagggctgcctttgcttcctggagggtctggttcctttcggggaaggtctcagttggccactggagtaacagcactgcgtcggcccatgtggccagccagcatccctgtgctcatggctaaggacaggctgttactctgttctgcgggtcttgaagtcatttggtcaagtggacttc

SEQ ID NO: 159603 - DNA, 146 bp, Homo sapiens
agttaggtgaaaatgagtgatgttgatctgctggttctccaggttgtctgaaagtagaaaaaggaacatgggttcacattatagggtggcactttgcagagaagacatttctacattttcacagggcaaggattgaagaaatgcaa

SEQ ID NO: 159604 - DNA, 244 bp, Homo sapiens
ggaatccaatttaccaagcatgtaagacagcacctactggtactctacattactcaatatttattttctacttttcttttcctgcttcagtcaaccaaattaaaagtgactgagataatatgatggagatgtggcagaatttaaaaactgctaacttgacagaaaaaattcagttatgctggacacctggtgactagacattcagaagttgaggtcagaatgcagcagaatctaaagtgtatgg

SEQ ID NO: 159605 - DNA, 407 bp, Homo sapiens
agacataagggtatgcacatttaatatactacagtatagtgtaaacataacttcttttggagaggttctcgttcatgtgcccaggctggagcgagtaagtagtgtgatcacagctcacggcagcttcagcctcctgtgcccaagcaatcctcccacctcagcctcctgagtagctgagactacaggcgcatgccaccacgcccggctaatttttgtatttttagtagagacggggcttcgccatgttgttcaggctggtctcgaactcctgacctcaggtaatccatctgcctcgacctcccaaagtgctgagattacaggcatgagctgtgcccagcctataatggcattttcaaaattaaattagtagctttttacttaatatttgaagtatttcttctgtcatt

SEQ ID NO: 159606 - DNA, 312 bp, Homo sapiens
gccctcatcgccatcagcacaccacagccaccgctgtgccatttttaaatcattacacagatgcaaagcattttcacaggcattgctgcggtatcacatgccaactttattaaagtatagcagggatttcttccccctttctcagaaaaggaaagtggggtttccagaggataagtggcttcccaacacgcacacaggaacacaatgtttgagatgaacttggagcccacatcctctgcctcccagtccaagcttgggtctactcctccatgctcacgactttccagttcaaccaactgatgggcctttggg

SEQ ID NO: 159607 - DNA, 223 bp, Homo sapiens
tctcgtggggagagacattttgataaataacttctcattaaaatgcagagttaaagacccattaatgaattcctggtgtaaacaaatgcaccaccaagtgatctttgatcatcatcaaccttgaatatagataaagttattaaaaatataataatgtctaacactcacatgggactttttttttttactttccagagtgatcactagctctgtcatttattat

SEQ ID NO: 159608 - DNA, 407 bp, Homo sapiens
tgacctcaagtgatctgcctgcctcagcctcccaaagtactgggattacaggtgtgagccgctgcgcccagccattacaatattattaactatagtcatcatgttgtacgttattagttccccagaattcatttatctaataactgaaagtttgtaactgccatcccatttaaagtagctggaaaaccagataaaatatatgaaacagtagttttaagacattgtataagaggcagcacaggactttggtttctgagagaggagaagcaagtgagagaatacctatgatgacctgaacttattgcccagagacagtttccaggccacagcacagggaggggaacccaaacagagcctagagttgaggagcatagattggaatttggggaggtcaaagaggctagaat

SEQ ID NO: 159609 - DNA, 629 bp, Homo sapiens
atggtgcactggcaacgccaccacctgagtcgctccccattaagggcagaatatgtttccttctgcctgtaatgaataagatggaaccaaacttagaacagtgacaactcgaggtcaaatgccagaaagaaactaaactttaaccactggctcattcttatatttgttcctccttctgtctcctttcataagctcttccttttatcagcacatgcaagtgccttttcaatttccttcagtaggctggggttttatgtcctctccagtgggtggacagacgagtcccagtttacttctgagaaaacacagcttctactatttttggacagcctatctaaagagcaggaaattgccctgtaataatactttttggactgtggttgggaaatagtccttataatggagcagttaagaccaaggcatctattttctttctggggggtagagagggaagtatgtataaagtgttcttagatgaaaatgtccacactggtgttcctttctctagcctagttatagtgcttgattaccatttccctacagggctgtgggtggttgctctgggaagtcaggaatactcagcctggctgtcccctcagcacacgccttgggagccctggaggccaagt

SEQ ID NO: 159610 - DNA, 594 bp, Homo sapiens
atggcgggtgtctagaggatccctaatatgagaccagtaacccattcacaaatctaccaatttgtgaagacatcaattcccactgggaggcatgagttctccaagctctaagaacataaaatgcccaagagaacctcactttcatttgtgacccagtcatcagactggacaccagggcccccagagttccatcatcttccagaagaagacagcacttgaagaggagacatcagacccaaggtctggtctcagctctacttgctggtcgggtgaccctgacggggagatacctttccttggattcagttttcttatctcaatttgagatttggggactttaaggggaccaagtgccacagagtcaaagaacagaagccctgaagtcagacaattacaggtttcaattgagggtctcaaattatatcccctctctgagtctgcttccttgtttgtaaaatgagtacaatgtttacccttggcattcttctgaagtttgaatgatagagtataaagtatctagtaagctgcagacattttattaaggcttcattaatgttagtcccttccctctaaagtgttctctgtctagctctg

SEQ ID NO: 159611 - DNA, 492 bp, Homo sapiens
aaagatcctggagccgggtgcggtggttcatgcctgggtaatcccagcactttgggaggctgagacgggcagatcacctgaggtcaggagtttgagagcagcctggccaacatggcaaaaccccgtctctactaaaaatacaaaaattagccaggtgtggtggtgggagcctgtagtcccagcttactggggaggctgagtcaggggaatggtgtgaatctgggaggcggaggttgcagtgagctgagattgcgccactgcactccaacctgggcgacagagcgagactccgtctcaaaaaaaacaaagaagtaaaatcacagtatggcgcctcccctcgtgctcctcctcctgctctgctgatgggcgctgtgtgcggagcctccctttgccatagctgcctctgacgatacggcggcctcccaccttcacacagcttccctcacagtcactccgacaggtccacctcccaggtcactcgcacacgaccgg

SEQ ID NO: 159612 - DNA, 890 bp, Homo sapiens
cagcccgcaagacctcgccgcctgcccagctctgtcattgactaaggttgcttttgtcagtacagccgccaggggtttccacgctcattcccctccggacaaggtggacagctttggtgatagacaactgggaggtaaaactccacagagccatgccagcgactgaccgcccagggacaggagatggagacgttcagctgcaaaggctacggaggaacccccgcaattggaatctctccatgccttctgcagcatggaaacatactccgggacctaccggggctctctcgggccacctctgagtgcaagggaaaagagtgcagttcaaggaagggaatgtgtctgtcatcccaccacttgcgcgcaaggccagttccgggatcagcaggcttccttcaccagcacgggctcttcattagcaaccactgggagggaatgtgtgcggagtcatgtcaagatgggaaggcacatgttcctatcttgacagcagcagaaagaaaaatggcagcagaaggaaaacagcagcagaaagaaaaatttgactcagatgggttgagagggcaatggcaagcaatcttggtacatgtcagctgcatctcagagtctcgctttgttgcccaggcagtggcatgatcttggctcactccaaactccgcctcctgagttcaagctgctcgctggaattacaggtgcccgccaccacagctgtctaatttcttggtttttgtttttgtttttgagatggagtttcgctcttgtcacccaggctggagtgccatggtgcaatctcagctcactgcaacctctgcctcccaggttcaagtgattctccggcttcagcctcccaagtagctaggattacaggcatgcgccaccacacccggctaatt

SEQ ID NO: 159613 - DNA, 444 bp, Homo sapiens
cagcccgcaagacctcgccgcctgcccagctctgtcattgactaaggttgcttttgtcagtacagccgccaggggtttccacgctcattcccctccggacaaggtggacagctttggtgatagacaactgggaggtaaaactccacagagccatgccagcgactgaccgcccagggacaggagatggagacgttcagctgcaaaggctacggaggaacccccgcaattggaatctctccatgccttctgcagcatggaaacatactccgggacctaccggggctctctcgggccacctctgagtgcaagggaaaagagtgcagttcaaggaagggaatgtgtctgtcatcccaccacttgcgcgcaaggccagttccgggatcagcaggcttccttcaccagcacgggctcttcattagctattgagacttctcaaactagagg

SEQ ID NO: 159614 - DNA, 101 bp, Homo sapiens
gaaaccacagggaggtatttccatcaccagtaatggccttaaaactcctcagaattctaattattttcaaagtcttggagtttgagctttgcagcagtggg

SEQ ID NO: 159615 - DNA, 449 bp, Homo sapiens
ttatgttctgacccaccacaataggcagagtacatgggaacaaggccaagatacccatcaaagataagctggataaagaaaagtggtccatcagttggggattttatttctgttagcagaaaaatagaattttgtgtgtgtcatagttgagttctcacgagatctgatggttttataaaaggatttcccctctctttgctctgtgcttctccttgttgctgccatgtgaagaaggacatgtttgcttccccttctgccatgattgtaagtttcctgaggcctccccagccatgtggaacttgagtctattaaacctctttcctttataaattacccagtcttgggttatctctttattagcagcatgagaacaaactaatacatgtgtctcctttaatttctcccagcagtgttttgtatagtcttatgctgtttgttaaatttgttcc

SEQ ID NO: 159616 - DNA, 152 bp, Homo sapiens
ctctgcctcccttgcccactgctcaggccaccatcttaccactgtaacagcatctgggtgctctgtctccctgcttattctccatttaaggaccactgaattttactcctgcttgcagccattccctactgacctcaaggtcacagtataac

SEQ ID NO: 159617 - DNA, 210 bp, Homo sapiens
agaactgggtatttccatcattaggataatttcacatgtgcagtagaaacgtattttatgtcagagccccagaaacatacaaaacttcagatccctgtaggaatgtgttcatagggcaacaaaaatagcatcagtgccttgagcttcattattgtcaatttaaaaagcagtcatggccgggcatggtgactcactcctgtaatcccagca

SEQ ID NO: 159618 - DNA, 183 bp, Homo sapiens
aagggaaaaagaaagcaaagaggaaagaaagaaagagaaggaaggaaggaaagaaaaagaggaagagaaagaaagaagaaacaaagaaacaaagaaaggaaagaaagagaaacagagaaacaaagaaagaaagaagagacagaaagagagaaagaaagaaagataaagaaagaaagagaaaga

SEQ ID NO: 159619 - DNA, 258 bp, Homo sapiens
agagtggatgttacgttagcaggcacgaaaacactattcatctccttgtgctctctccatcagggctcttgagtaaccagtgcattgtcagtaagcagtaaaattttgaagagtcttcttttctgaggtggaggtctcaacagtggatttaaaatattcagtaaacaatgctataaacagatgtgctgtcacgccagctttgttgttccatttatagagtatagacagaatagatttagcctaattcttaaagggcct

SEQ ID NO: 159620 - DNA, 203 bp, Homo sapiens
tcccaaaaggggctaatgggtcctgcaacagatatgggtttggtttataaatatgtttttgtgaggagatgggcaggacagcagtctctgttgtataacatgctgcttcttgcatccttctgttattcctttcagcacagaatgcaagccttatggctttcctattctaaatctgaagatgctcttttttttttttttttttt

SEQ ID NO: 159621 - DNA, 415 bp, Homo sapiens
caggactgctgagaaacggtcaagtatcattgggatgccagcctaaagaccaggcagattctggtgcacccacactagacactagacacggatctgaggactcagctgctgttggcaggttatgtctctaggcaagaatgtcacgatgcctcacaagagcctctgggaataggccagaggtcatatacagttaaaattgaggtgtacaaagtaccatcaccatactcagcctgctggagagttaaggggcaaaggtgagagaggccttctttcttttccaggaatagtgtatacaccacagtcagggtctcttaggtatcctcattttaggtggagatatgaagccaataacttcattcctcctctctgggaatcatctctaggcagaaactagtttggaagggagtacactttt

SEQ ID NO: 159622 - DNA, 340 bp, Homo sapiens
cctccagatttataaaaatcaatgccaaaaaaattttttacaagcccaaggatttgataaaaaaaaaaaagtgttggaggaggaataaagagtgatgtcaggagaaggaagacatgttggttagcttattgacataataatgccacataacaaccaaccacaaatcctgaatagcatgcagcaagaaatatgtatctcttgcctgggagttttatgtcccctggagcggctctgctttgcctgcagtggctgagatgactttgcgtcactctgtgggttggctggtgtggctctgttccatctctgtcatcctcctatgataggctggctggtgatgagg

SEQ ID NO: 159623 - DNA, 433 bp, Homo sapiens
catctgctcctgtcttaccgccattcaatccctagaatctcttttaatcaacttgctggagctgtaagcccatcgtatacttttaagttgcctcctggctccatcggtctgagtgatgaaataggcatttttaatatttgctaaacaggattgtggagaaggtgaagtcccagcagggctcccaagtggtaactgcatcttgttgtctccggttaatcatgtacctaatctgccaattattgacttgttcttgcaaaggattttacttggcttgacatatcagtagcaatcagtgatgaactgtcaagcaaacttgctcactgccttaaccgcccaagattctgacttgctgcaactgcctctgagatttcctttgacacctagcactgtagccaggtcagattattctttttcttctgtctgttacctttct

SEQ ID NO: 159624 - DNA, 156 bp, Homo sapiens
gagaagtattaggagagcaaggattctaagacagccatgtgaagctgaatgaccatttatggtctaggctctgaggtcacagagcaccacttctaatgtactctattagcagggccatcaaggggaggggacatggaccccaccaccacttgatag

SEQ ID NO: 159625 - DNA, 403 bp, Homo sapiens
tccaaggaaataaaggttttaagagccttgctttcaaccaagaaaacaaaagtgtagccacaacacatatgcatattatttttcatgaaaaggacttcttcgaaatccagctgcgcatttttgtagttgaatttgtattaacaaaatacaaataattttaaagaatgaagctgaagttcctgttggaaaatgttatccttttcagtatttcaaaactattatttcttatataattagttgtagggctattcataactgtgcttgccttctctgaaaacattatagaattatttttaatgtattttctttttttttttttgagatggagtctcgctctgtcgccaggttggagtgcagtaacacaatcttggctcactgcaacctccacttcctgggttcaagt

SEQ ID NO: 159626 - DNA, 559 bp, Homo sapiens
tcttggtgggggcatggctcagcgtccacgggcccagcctcagggctctggccataggccttgggcacacacactttccagaggcccctctctactttccctgtgcccgagacccactgccaagcaggcggccaaggacagacaggctgaaccagagcagcctcctcaggctccgcacaccttcccagatctgggaggcctgcctggggctgatgaagccatctatacaactgggcgcagccccactgagcaatgtatttttaaatagtttctaaccaaacgaggtcaagaaatgtctccaatgatgccagtggtgttattccaactgtggctagtaaaatataataacatgcatgttgtttttgttacctatctagctgattaggtaataaaatatgctcagtattaaaaatttagctgaagccattatcatacccagaactcggggctcttggttttcctcagaagtcacccaaatctgtcacctttccagacttttaacctatttaaatttttctggagaagggaaattcctcttggtgtccaataaatgtgttca

SEQ ID NO: 159627 - DNA, 436 bp, Homo sapiens
cacaatcccagctcactaaaacctctgcctcccaggttcaagcaattctcctgcctcggcctaccgagtagctggaaccacaagcacggaccaagtaactggaactacaggcacacaccacttagtagagatgggttttcaccttgtttgccagggtggtctcaaactcctgacctcaagtgatccgcccacctcaatcttccaaagtgctgggattacaggggtgagccaccacacccaggctggtgctctatcttcagaagtgttaatatcattaaagacaaaggcagactgaagaactattccaggttaaaggagacttaagagacatgacaactaggccaggcacggtggctcacacattttttttaaggtctcactgtcacccaggctgagtgcagtcatgtgatcaaagctcattgcagcttcaaatttc

SEQ ID NO: 159628 - DNA, 559 bp, Homo sapiens
ctccagcatgaggcggtgaccacccggcttgggcttctcaggggtgtccctgggcccactgccttccggatgggccagccccacgctgggcaggggcaggggcaggggcagagacaggcagcagcaggggcttcctctcctctctccacaggtgaaccactcaccgaccccaagcccccacccagtaggacccactcagcaggtagcagtggagacagaggccgcctggggcatgctggctggacaggagctgtccactccccaaatgctgccaggccccttcagatggaggagtccaggctgtgacagccaggtggcccgcggggaactgctagaaggggccggggagaaagggggggatcccgtcggctgcgtgtcgggtggtggtttggtgggtgctccgcgccccgcccacactacgggcttgagaattcacagttctcctcccgtccacgtctccgcgccatccacgccccgcgcctggggccccagttgtgcgattctgcgcccgcccccgggccccagggcaggctgcccccagcccctccacggcggccgc

SEQ ID NO: 159629 - DNA, 471 bp, Homo sapiens
acagggaaactgattactacaatttatcttcctaatagcgaacttgtcataacaattttaaacattctttttcattctatctctcttatcctgatctcatattaatatgagatcaataaaaaagactgattggaaggcaggggtgggcactggccatggacccttactccgtgcttatcatacacaataatcctcattttattccattttctgaaaaagacctactcctacagattattattaagaagttgacagataactgagaaactcatgaatagagaaaaaataaattcacatcacacatcacaaaaaagaacaattagccaattagtcaaattcctttttgagatctgggttcttgtctgttcattgtccctcatcttcctgctaactagtattctctctgtgtccatacacaagacatgaacttgaaaaatcattctattgttctcaacatttcagctctggccc

SEQ ID NO: 159630 - DNA, 229 bp, Homo sapiens
agaggagcccacagagaagctccaaacctatttcccaccaagactggcttcaactcaaccattcagtcccacaaacaggcagattgttctgggagcaggtggaacaccatggggagcactaaagtggtatagggagagaggccttccttagagaagcaaagccatcctcacacaggccatccaggttgaaagcgggagaggatgagcagacgcgggtggtgtggctgtc

SEQ ID NO: 159631 - DNA, 395 bp, Homo sapiens
cttctttcgtcctttgctccagtggttgtagcttcctacctccttcttaccctcacccctaggcttccactttagagaatttggagaactggggaaagaaaagactgttttgtgcatggtgtgcctgcagcctagtgccatgagctggttcttgccgtgtctgagccaccagatccactccttctgtggttcacacgctattccctctatcccagccaagcttgcaaactctgatcatgaactaccaggtggagggggggcatggatatcctccccaggaagcctgtctggaacctctgaacttttctgacctgtgcatgcctctaccacagcacaccttaatttcttttgaaatcactgcatttgttcatttgttagttgtttgcttctagatg

SEQ ID NO: 159632 - DNA, 341 bp, Homo sapiens
cagtaagaacagcaattgtcgtgggggtttagtttaccctatccctcttccccagctctgtggtagacttgaaaatcaatagcccccatcacagtgaaaaccagcagcatggcagccactagagggggaaagccccatttctggaaaatgtcactatttgacctgtcttgtggttccttggaagaccctacttgtaaaactgtctttaattgacctgactcagagcttgcacagtgggaacagtattttcccggagggcatttgtccaaacaatcagaagtacttatttaccatcacagctacttgagatggaagataacagggtaaacaacaggctaacc

SEQ ID NO: 159633 - DNA, 571 bp, Homo sapiens
ttccacttctgagatgaaccctagtccctgctctccaccctcaccctccaccattcacctctaactcaagggaaatggctgcactgaggagccaaaccataattgagggcactggtacagatttggcctgattagcatcacagaaagtgtatcttgaattccagtccaatgtcctggagtcctctgaggctctctcacatgtgtctgtgaacacagtctggggctgccaccatgtgacatgtgccacttgccctcaatctccagatccacccaggcttctgagtcccactctcctcaccagaatgaaaatgctatgctatgccagcatttcctgttgtctctgtcaactctggaaagcccttgtggactgcagtgcaacttctcttgggttttgcttgacctcttattgtggctcatactcactagggtcaggaacatgcatccctggaggccaggtcagaggcccttctgactactcagccctgattccatgctgggtcatagtccttgggtcaggcttgtatcccttgactctctattgcccaaaagtgactccttctccccggtggaa

SEQ ID NO: 159634 - DNA, 467 bp, Homo sapiens
ttgcaaactctgtttgggcatagtgtgggaagttgagaaattgccaagattgttttttaaaacttcgattaaagtatctatctatttggtttaatctatatgttcatgaagactttcatttgactttgcgatgattgataattgccaattggggcttgaacctcatcattttaattgtcagttttccttaatacaattaagaatgctatgctaccagatatcttaagtcacagtttttgcattttagattactgttgtagtataatatgtgcgtagcaaaacagagacctatttgtttaggggaaccagtatttgttgaatcttgaatttctttgtgtctgtttggattttacaacttcctgattttcccacgtacagtaagtcgtaaattccagatcaaaatatagaaacggagcataatggaaaatggggaaaacacggtatgagacaaagataatgcactaaga

SEQ ID NO: 159635 - DNA, 468 bp, Homo sapiens
atgcctacttttcacagggcataatggccattatgccaagaggacttcacatctcccttaagatatagatctcaattctgttgctctttggggagaacttctttgaaaatcagcctctcaggggaactctaggaatggtcatttctgacatgccaccttggtggaccatgttttctttagtcattctggagttatctttctaagatgcaggaataaaactgaaggtatatgaaaggtaagtgttttagaaaaaatgaaatatgcataaaagctgtcccagatccttgggacaggaatgacttgacagtctgagaagacaatattaaggccctatcacaatatagtgcttctgtctgcaaaggactttcaacactctgttacattaaccctcctcagatgctgggagaggcaggaggcatcatttccccattctctcctgggggcacctaatacccatgagtaatgacc

SEQ ID NO: 159636 - DNA, 827 bp, Homo sapiens
acactggagtaacaccttcaaagcactgaaagaaaaaaccatcaacctagtgtactgtattaccagcaaaactacatttcaaaagttaagctgaaataaagacttttttacacaaacaaaaatgaagagcattcatcaccagcatacctgcattacaaaaaaatgttaaaggaaattatttagtcagaagcaaaaaaaaactggtaccaagggaaaatctggatctacacaaaagaatgaagagtgttaaaaatgataaatatgtgggttgaagactttttaatccctttaaagaaaaattttaaaataataaaacttacatgcagaaataaaatagatgactccaataacataaaccaagctgtgcaaactttttctgtaaagggccagaaagtaaatacttttggctttgtgagccatatggtctctatcacaactcaactctaccattgtaatgtgaaagcagccagccatagacaatatgtaaatgaataggtatggctgtgttccaataaaactgtacttttaaaaattgatggcaggcaagatttggtctgtgggttatagtttaccaactccaatgtaaaagataagaagaaatggaagtataatattgtaaggtccctatattacataaagtggtatatactgtttgaaggtaggctgtgtaagtaaaagatatacattgtaaacccaaaacaagtgaaaaataataataaagaattacagctaataaaccaattgtggagatagaaattgaatcctaaaaatactcaatccagaaggcaggaagagaggaaaaaaagaaagaagtgggacaagtaaaa

SEQ ID NO: 159637 - DNA, 314 bp, Homo sapiens
tgatctagaggatccctcataggttcgaggcaagatttggtctgtgggttatagtttaccaactccaatgtaaaagataagaagaaatggaagtataatattgtaaggtccctatattacataaagtggtatatactgtttgaaggtaggctgtgtaagtaaaagatatacattgtaaacccaaaacaagtgaaaaataataataaagaattacagctaataaaccaattgtggagatagaaattgaatcctaaaaatactcaatccagaaggcaggaagagaggaaaaaaagaaagaagtgggacaagtaaaa

SEQ ID NO: 159638 - DNA, 273 bp, Homo sapiens
gcagttatcgggggggatagagcaacccaggcagagggaagagaaagttccaaggctctaagatgggaattaggagtgcagcacgtgctcaataatctgtctggcaagagaaagagcagacgactgcagcagaaagagcacaggactgcaagtcggaagaactgggtttgagtaccagctcttcatctgtcactgaacctgttttcaaatctatcagttgaagaaaatacctcctctgtgaggttttataaggagtgagtaagatcggctggg

SEQ ID NO: 159639 - DNA, 244 bp, Homo sapiens
ctggttccccaaatctactttcttgcctcttgcagctgggtggctgtctttccccacttctagaagtcttttctgatgagagtaaatcagaagattcctgaactagggcacgccatgtactcctgaaagaggaggcaccttacaaagaacaggggcattaaatgaaaatgcacatgctaaaatttgagactgcaccccccccaacatccttcttaccccactgggcttccagaaagtttgaagc

SEQ ID NO: 159640 - DNA, 611 bp, Homo sapiens
gctagctcggtaccccacaccacctgagtcaccacctgagtcttgagtaggctctcaacaaatgattgttgtgcttattaattgaagaagaatgatcttatatgtgaatcagaaaggaaggaaattaggagtaagtgacaacgaagcaagtgatttgtgaacattgtgtccgaaagagaatctgaggaaaagggtgttttgaggttagtagcagggctgacattgaatctgagttccatgcccagcagtgagccacaccctttccttactaaggaatctggaaatgttgccagccctgccttttatctttgaaaacacagggctatttatgtctaaacacaatgcactgaatttaccttcattggttgacacagttatctttcctgatcctcaaaacctcaacagacagcaaagtgcacaacttgctatgtaatagaagtttggtagatgggaagtctacatgcaaagctgatttattttggcaagataactcagccgcaaggggttacacggaaggcagagagaatggatgtaaagtgtagtcaggatactactgagaaatcctagtcaaggatgttgcaatagcctgtgaactaggaaaggagtgatat

SEQ ID NO: 159641 - DNA, 405 bp, Homo sapiens
tcacgtgaaaaaaaaatctttcacttccttccttgggaaatgctcgtttacatttagtgaatggtcctggtagttttgacaaggaaatatattacgaactaatggagaacctgctttggagatctgtgccacatgtgttccattaagcccacttctcctgccgcattctcaaccgaagaaggctggcctccggaatcatggccttactcattggtaaagaattctgatataagtatacttatttaaagatgtaaatagaaggtaacttagcatgtttcagaatttaaaacttgcctcatatgaatttattttgatgtgaaagttgctgatcaatttggaaaacatgagtggctttgcttgttactagttttttattgctagttacaggtatgtctaagctcatat

SEQ ID NO: 159642 - DNA, 457 bp, Homo sapiens
ggattgacagctgcaggatgtagtgcctgcctatagtactgaggccatgacccacctctggagagaccacagcctcatccctagagtagaactggaaattctccattgagacaggaaggcagcacttgaacctggcaggttttggagtgaagtgtctaaggacagaatttctcatttctccacctctgcccatgtgtaaggcagcaatattttcatagaggtgaagaaggcaggtgtcccgtggttattatgacatctgtttacctcattctagtcactgtgccatgtttcacagccattgtcaactacatttggtgaaaactgtttcctccgtccacaactggaacattgacactaaccacattctagagttcattacatagagctgtgtctgtgggtaagttaacaggtagttttaaataactagatatagtcttttcctcttccatgtaagcca

SEQ ID NO: 159643 - DNA, 992 bp, Homo sapiens
ggaaaatagtgaggagttaagagtttaatgggtagagttccagttggggaagatgaaaaattctggagatgaatggtggtgatggtttcacaacaatgtgaatgtacctaatgccaaagaactgtacacttaaaaatgattaaagtgataaattttatgttatgtatattttaccataatgaaaattttaaaataccttttaaaaagtttgttacacagcaacagataaccagaacagttctacacaaacagaagtctgaaataagaactatactgcactaagcctcccttcacaaatgtacactggctattattttaggacatgattttaagaaatcttgcctccccatttaatttttaatgttctgagcagaatcttctgcaatacaaatattaaaacatatgaacagaactcagagttaaaattatatacttaattacatgcaaaattatcacactgtgtagcaatgagggataaataaaaatcattcatggaagtaaaaataattacaaccaaaccagtacttcaggggtcctcctggaggaaagcaaagggaaagaattatggccgtcctgcccttaatctgttcatcacctctaacaaggtttgtgaggaaagggggatggccctacgttaatatcaattccaccatatcctaattcccactaaaccatcaaataggccagatgagaatggttgatacaggaagaaagattagagaaaatataaggaaaatacacctggtgggaaaaaacgaggatactttcacaaaaccctacttaatttttcgaattcttagcaacaaaacagtaggtatttttatttgtttctgtgacagaataatatagcagaccagggtagctgtattaatgtctggagcactgctctctgagatcagatagttaagagaggaatataagaaacaaatttcaggccgggcatggtggctcatgcctgtaatctcagtcctttgggaggccaagctgggtgg

SEQ ID NO: 159644 - DNA, 183 bp, Homo sapiens
agcagagaaggcaaagtcctgccctcatggcaggacaaagaagtaaattatatagtgagttagaagtgccatgaagaaaaatagcacagagaaagaaatggataatgctcggtggagccgtgagttgcaacagtaaatgaaatagtcaaggaatgcctcacttaagtgacatctgacttaaca

SEQ ID NO: 159645 - DNA, 386 bp, Homo sapiens
aggtgcaaatgcatatataatcctatcttattacagattcagttcatttaatggacaactgagaatgaaactgatagtaaagttgaaaatgtcatcactttattctcctaattttcatttttctatcacataagcataaacaatgcttccttttgttaatgcaaaattattaacggaaattaaccaatattttctcgtaaaagtttcagtggccttgaatataattttgtgtgtcatctgtacaacacacacacatatattatgcactagagaacagactggttagcaaaaataatctactcaggattaatgccaataagacaataaaaaatacgaactcaactacatcagatactgacagatcaggcaagggcctgatcaagctc

SEQ ID NO: 159646 - DNA, 436 bp, Homo sapiens
acctcccaggttcatgccattctcctgcctcagcctcccgagtagctgggactataggtgcccaccaccacacccggctaattttttttttatttttagtagagacagcgtttcaccatgttagccaggatagtctcgatctcctgacctcgtgatctgcccatctcggcctcccaaagtgctgggattataggtgtgagccaccgcgcccggccagtatttcacttttaagctcaaaaaatgtgtttagcttcttacaatttcatgtagtatttgagattaatagctccatagagagatttgattgtttagccatccatgattctgtgaaggagaatgttaacaatatctgtgttttggaatttgaagatcgaatgattttttgttttttttttgagacggagtctcgctctgtcacccaggctggattgcagtg

SEQ ID NO: 159647 - DNA, 458 bp, Homo sapiens
gcggccgcctactactactaaattcgcggccgcgtcgaccttaggacaaatctggaccagaccaggtgtggcttctttttaacctagccaataggaagcacttgttgtaggaaccctcaccccagtctgtgtagatgtgtctagagctgagcctctttcttccagtttggcctttgtgggctctccttcccatttctggcctcaacaaactgacctgccagcaggttctggagccttcccaggcctgcagcaaatagggcttggcaatgacaagatctgtggtagggcagcatttattggatgtcctttgaaattaactttcccatggtccataagtgcctcctgggagtttcttcagggtcctggcttcccttgaacttcatgcttatgctgactcccacacacatgtctgtgtttttcattttaaagatgattggtaatgaattgggggcggggag

SEQ ID NO: 159648 - DNA, 933 bp, Homo sapiens
cttgggctgggccggggccgcatcccactgtccctccccaagggcaggcatgcaggggggtcagccacaagggacctgcccttctccctgccttctgtgggttgggaggctcctgactgagccacctggagggagagccctcacattcagagccctccaaagagtttgccaaatgttggaaatgcctccagggcccgtccaccagccgtccagcttccggtgcctgcatgagtctccgcttggccctctcctcggcctaggaacccgcaggtcttgtcccgtcaggttcctcctgaagcttttgttctgagaggaaaaactttccagggtttcaaacttggaaaaacacctgaacgcagccagacacattttccgtcgtctggtcagccaaggaagtgttggcctgtggctgcactcacttccttcagccccaggaagccttggtcgggggcaggagggagggtcaggcagggctgggggcctgaccgcccacactcctcctcaggcctgcggggaacgccctgctccccaactaagcagccttctctttgttctcttccttctctctgtaaacccccgtttcctgccttgttccctccctgaacatgctcttcacctggcaagcagaggaagctacgttgggatatgtgagcagtgtgctccgtggtgctgctgtgtgacccgccttcccgtagccccttgccccgctgctcccgctaggccctctttcctgctcctgcctctttccttccccatgcccaacaaacccaattccctggtgggccctgttcagggcttttccttctttccgtgcccccctgcgattcaagccccgttttcagctgaggcagaaagaaagtcactgaaagctggaaatgaaccaagttggcaggggagtggaaaaatgacggggcgaaatgaagtaggaagaag

SEQ ID NO: 159649 - DNA, 387 bp, Homo sapiens
gggtggggtgtcttcttacaaatactattaagcttgtcaagaaaattaagttatcagaaataaggtaacaacagaggccaaaacatgtttgctgctgaggcgagtatagagaaatgtaagatgttgcttcctaagactaaatctcaaataagaggacttaacaaaagagggaggcgcagggggtgacggcggcaaaacagctccagagtcatcagcgtgagggccgtgggacctgtgggtgtggccacgtgcaccttagggtcagacacagagccagatggctgctccatggtccctgcggctcagggccttcgctccctcgggtgcagatgtggtggctgggagcatggtgtcgccaactttttactgttagccccaggccatggg

SEQ ID NO: 159650 - DNA, 273 bp, Homo sapiens
accagattgcggtgtcacacctcatcagaaccttgtcactgcaacctctccttcctgtcaccacttcaagagcctctgaccccacacccagggatgcccaggaggaccacctcgtttcggttactgcagtgcaattatctcagacccccatggcttttcctggacctcactgacacccagaacagctgcagttggaccacctttgacttcaacagtcataatctctcttcatcccagttctccagcctcgtagtcccaaaacccttactctta

SEQ ID NO: 159651 - DNA, 482 bp, Homo sapiens
gtgattgtgccactgtactccagcctgggtgaaagagtgagatcctgtgcagaaacaaaagaagaaaaaaagagatatgaaagcctatatattgaagactaccaagtactgcttagagcagttaaagacctttggaatagaaaatgtttcttcttgcatttcaagattgcttttgttttggggggacacactattttttaggaatatgaagttcttcttaggcattcctgtaaaaaaggccacttcttgataggattgtattgaatctgtgggttgctttgagttgtatttttattttaaccatgttacaacttccaacccatggacacaagatgtctgtccattgatttaggtcttcctgaatctcctcgagcaatgttctgtagttgtctgtgtacaagtacggcaccttcttgaacaaatttattcccaggcatattattcttacaagtgctattataaatgaaatcattgtgtcaatt

SEQ ID NO: 159652 - DNA, 331 bp, Homo sapiens
tacagaccccaaactatttcagatgtagttccagccctcctaagcaagtgttagctcaaaccttctcactcttgctcagattcatagctgctcacctttcagaagaaatgacaatgctgaaagaggaaaccaaggggacaagagagatggcagccatcccaacagctgtcttgtgttgtgcccctactgtgtgccagacactgtcctaagcactttacttatattaactcatccagctcacaaccaacaaaatggccctaagaggcctctgctgatatccccgttttccaaatgagaaaactgtccacggggtcggtcagtaacttgttca

SEQ ID NO: 159653 - DNA, 318 bp, Homo sapiens
agttacaacagctccagttacaacagctcagataaggggtgggacagtgacctttctacagggaggcactttgggtttcatgtcaaagggtatggatatggtctccccctacaggtggcaggcaggtattttggaagaaatagaaaatcaaccacactgagaagatgtgcgagtgcagtgtccccagattaggggtcaggaccatccctgatactgtttaccttgaagagccagatttctgtgcttgagccctggagctacatcccaactgttggcgaaatgcctccactgtaaagtcctgcggtggaaaactagaat

SEQ ID NO: 159654 - DNA, 538 bp, Homo sapiens
tatgaccaaaagttgttggctctgcaacaagagcagactgatagccagcaccaagacagatggaggtgatgttctaggcagaggtggcttctagaccttcctttgcactgccagcttctagtcagtgttattaaatctagtccctttcataactgaaatttcaaacataaattatattgcaacatccctatagaaatgtctgaagttatatatgaagaaggaaggaagatgctgttctcaatacatcccacatcattaatatgtcaaatctcttttcttgtttaaaatgaaactgggatgttttccaacttttcatcctgatggtaaggatagttgcccgtgttgggtagggaagggagggaggtgtagctgaaagtacagttttgtgtttccactaatctgatccctcccaccagctgccctttccacctgccctacaaactctctgctcagaaagtacacattgatacaacttatcaaagccagccctctgttgtagccatttcagcaaaataagccaatttgggtttggtagatg

SEQ ID NO: 159655 - DNA, 156 bp, Homo sapiens
ccatcacccccctgcctgggcagccccttaatgtcagtgacagcctgtgctgcctctgtgcccactgtgtgcccagcactgggccaagccctttgcatcacatgatcctcactaccgtcctctgtggtagacactgagcttattcactaaggcaca

SEQ ID NO: 159656 - DNA, 567 bp, Homo sapiens
gggtagatttcacttttgaaaatttccagtcatgtggaaccaaatacgttgatctaaaaagaataatgctgttttttttaaatcaaaaactaaaaagtgtacctatgaggaaacttattttcttgaaggacctgtggactggttgagatagttcctgaagaattccaaaaatatttaagcattgacatcactggaataagtgaatgaccgtgtgaggcagttgtttttgtgttctgtgaacataaacattctgggataatttttttttaatcttattaattcacagtaaatcaaaaatattgtataactataaaaatcactattttcgtatgcaacattttcagtacctaaaaagatccatttttcagcttgggcaacatggtgaaaaatgggcaacatgggcaaaaaatacaaaaattagccaggcatggtggtatgcacctgtagtcccagctacttggggagctgagacaggaggatcacttgaacccaaggaggtggaggttgcagtgagccgagatcatgccactacactccagcctgggcgacagtgagaccctgtctcca

SEQ ID NO: 159657 - DNA, 340 bp, Homo sapiens
agaaatatattggggcttgaagggagaaaatttgacatctgattggatgtagagtgagaaaggatcaaaggcaaagaatctgagttttttccttggagacatggaaaaggtgggataatatcagccataatgaagaatgatctcaagaatgtcctcaaaaagttatgtcttagccgagatgggcggatcacgaggtcaggagattgagatcatcctggctaacacagtgaaaccccgtctctactgaaaatacaaaaaattagccgggcgtggtggcgggcgcctgtagtcccagcttctcaggaggctgaggcaggagaacggtgtgaacccaggaggc

SEQ ID NO: 159658 - DNA, 181 bp, Homo sapiens
aaaaaaaaaccatatccaaaccatagcattgactatagttaataataatgtatggtatactggaaatgtgctgaagtgttctcagcacaatggaaaaaaggtaactatgtgaggtgatgaatatatgaattagcttgattgtggcaatcatttcaaattgtaggcatatagtaaacatcac

SEQ ID NO: 159659 - DNA, 385 bp, Homo sapiens
tagatgtcatgatccacacgtaacgccttctgtaccaattctctcaatccctccagcagatacagacagtctctcctagtagtcagatcaggcctggtgggaggatctaaccttttatggggtgcagtaaacactgacagcctaaagcaaacgttgagaggggtaaaagggagaaagtaaggccaacaggagtagggtagaatgacagatgtcagccaaagctgcaggggaaggacatgtggtatacagtggtaatgagacatcattcaaatgcttcgcttcgcacacagggctgtcaagcctcaaactgctgttcctgcctctcactcctgctacgtaccaggtgtgagcacacactgctgttccaagccctccgattttgtct

SEQ ID NO: 159660 - DNA, 374 bp, Homo sapiens
aggttattacatgccttgctcaaggacagggggctaaaagtaggcaaaactaggaaccaggtcttctgacttctatactgcattctttctactacccatacgatcttcagggaagccttgtgtatagcattctttgttcattggtaagttattaaatattagccctttagaaaatgtaacaaacatgataacattatttacagccaaatccactgctcaacctatggcacaatctactaactttggaaacagcaccctgcctgtcagcatgacaatgttgccttattattagtaacagtgactaaaaattttcaaatgatttaacacatttctgaacctcttaaaaaattaaatgtacattattcctataaatg

SEQ ID NO: 159661 - DNA, 663 bp, Homo sapiens
gtacagaagaaaacaaagaaaatacctttgtgacttgggttaggcaacaatttcttaggataggacacaaaaagcacatacaaaaaaattaatcagttggatttatcaaaattaataaattctgataaatctgagcggtggttcaggcctgtaatcccagcactttgggaggccaaggcgggtggatcacctgaggtcaggagttcgagatcagcctggccaacatggtgaaacccccgtctctactaaaaatacaaaaattagccgggcgtggtggcacatgcccgtagtccctgctactggggatgctgggattacaggcatgagtcactgcgcccagcctatcctcaccttgaaacctttttattcttgacttccagaggtttaattttgattattcgttcttctcaatttttctctctgctctcctttctcttctctaagggtaggtattcctcaagattcttcccttgaacatcctctcccagagccttcttaggtaactaattgtttgttttagtgagatatgatttacaaggtgtttgattttgaagtttctctgtacagataattcacaagtctgtatctctggccttactttatttaagttccaaacttaaatttgttcgtcagtaccttcctaacatgtcggcttggatttta

SEQ ID NO: 159662 - DNA, 419 bp, Homo sapiens
cccccccaacaccgcggtggccttttcgcttgggccgcattccagggctccggacgtttacgattcactggcctctgccccgagggacccaggataagggtagggggtgtctcagaggtcattaaataaaagatgtttacagtgagctgggggaagggggtacccggggagacggcagccggagaaggcttcccagattcaaaggtttgggagatgacctcgacgtcggagagggggatgcgggccgccggcggcgctcactgtgggcgaggtcgccctgtccgaggcccagcgacggggctgattccccacccccgcccctagccaagaccactaggaaccccggcttcccaggaacgcagggcctgccgcccccagaggcccggatttggaggcggaggctgtgcctccgcggccgc

SEQ ID NO: 159663 - DNA, 295 bp, Homo sapiens
gcaatgtgcacttcataacgtgtttaaaaatgtaagttacgtgcttctgcatttgtcctggaagatcgcacgcacttaatcaaatcacactgtctcacaccgggtttccaaaaactgacatacacccaagcaacatttccgacaacatggtaagtagaaaattgtgattatttccttacataattatttcagagaattttgagtaaatacagacattcccactgaaacttgaagttataaaacatgtactacacagctctgagggttctatcttggctctgaaataccacctgtg

SEQ ID NO: 159664 - DNA, 391 bp, Homo sapiens
aaaaatgccctccgtccattccgtctttcatccaaatcaacccaagtcattaattatttcaagaaacatttactgagtacctaccataggcaagtccctaagtgtacaataaaaaacaagcctgggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagcgctaatatccagaatctacaatgaactcaaacaaatttacaagaaaaaaacaaacaaccctatcaga

SEQ ID NO: 159665 - DNA, 332 bp, Homo sapiens
gtttatagtatagaaagagaagagcaacattaaacaggatttcaatcttcttttttttgtttttgagacggagtcttgctctgtctcccaggctggagtgcagtggcccgattttggctcactgcaagctccgcctcctgggttcatgccattctcctgcctcagcctccggagtagctgggactacaggcgcctgccacgatgcccggctaatttttttggtatttttttagtagagacggggtttcaccgtgttagccaggtggatcacctgaggtcagaagtttgagaccagcctggccaacgtgttgaaaccctgtctctactacatt

SEQ ID NO: 159666 - DNA, 121 bp, Homo sapiens
cctgcactattatccttgataccaaaagtagacaaaggcaaaaacagaccagcatttgttacgaatacagatataaaattttccaacatacgtaccagcaacctggatctagcaatatgta

SEQ ID NO: 159667 - DNA, 390 bp, Homo sapiens
ggtgagcatgtgggcagctgagcatgtgggcgggtgggcatgtgggcaggtgtgcaggtgcacagatgggccggtgggccgaggcatgactcccatgcccccacagccttgcccagactccccagcaggcccccagctttaacctgctggtctccttaaaagctcctggacctcaagcagacttggtcttttggttgaataaacagcgtgactcccgattttggcacgagggttacccactctgaccttccccgtgagaccccactgttcagacttaatgaccctcctcggtagctgaaatgcactcagtgctaactcattttaacgttatcctgagaaaaagataaaaaaagaatacgaatccgcgtactagaactctaaagaacataa

SEQ ID NO: 159668 - DNA, 364 bp, Homo sapiens
tatagaactcaacctgcatctctttgccatccatgttctttttttttagagactgggtctcattctgtcccctaggctggagtgcagtggcatgatcatagctcactgcagcctcaatctcccaggctcaagtgatcctcccacttcagcctcccaagcaattgggaccacaggcgcatgccactgtgcctggctaatattttatttttttgtagagatgaggtcaatctgcattaaacttcatgttgctccaacaccgcattttatctccccactttcccagcaatggacaactaggcttgtgccaattctccatcaccaccagaaatgctgcaatgaacattgttgtatatattcccttttg

SEQ ID NO: 159669 - DNA, 195 bp, Homo sapiens
tgccctgccccctcttaattcacacaagtgtaatatcctgcccaccgtgccactccccagcacctctccaaagcaaagaaatcttaggccaggtaagctaacaaaaaacataaaatgagacatgagaagtttcttagggacctagggtcatcagatttagcaaataaaaatgcaagatgcccagctaaatatgaa

SEQ ID NO: 159670 - DNA, 239 bp, Homo sapiens
acacaaatttggtcattcttattatacccaattgaatcagagtgaatggaccaagaggaaaaagcactccagacacataataccagctccaaaaattgaactttttgcaaactcaggtgctgaaatagcctgctgtaaccatcagaccatttttacctggtagctgctgaaaaaaactgcctgggctataagactagttttacttgttactatcactcaccaatcagagcttgaccgct

SEQ ID NO: 159671 - DNA, 200 bp, Homo sapiens
gcgttgaaaacatattcccacaaaaacatacacaccgacctttatagcagctttatttctaattactaaaacccgaaagcaactaaaaggtccttcagtaagtataactaaactgttgtacatctagatgatggattttttatatactgctaaatgagccatcaaaccatgaaaagacatggagaagacattaaatgcat

SEQ ID NO: 159672 - DNA, 526 bp, Homo sapiens
aatactggagagaacccatgatgatgcatgagaagcctgggtccttaacgctccttcacacttgctaatccccctttttaatgagaggcagagcctgttaaaaggcaacagtacctagtgataattgaatttaataacaagcttttacttccgttgtatctgtttcttcctccatgtttccgctgtcttgtttgtggcggtggcttctggtttgcccagtgttgatcacaatataatgtttctttctaaaacaaggcgatttgatttacactggagtggttttgaaggcaaggaatagacagatactgtccaggaggtggcggaacatgggaaggtggtttctttcttttttccatgttgcccaggccagtctcgaactcctgggctcaagcgacttccctgcctcagcctcccaagtagctgggacgacagcattgcatgggaaggtggtttgagaagtgcaggcgtaatttattcactcggcaaccattaagtgggtacctgccttttccacggccctgttttg

SEQ ID NO: 159673 - DNA, 499 bp, Homo sapiens
tctgtagaccaatttgcagagtattccatcttaataatattaagtcttctgattcaggaacatggcatgtctttccatttatttagatcttctttcatttctttcagtgttttgtagttttcaaagcataagttctccacttatttatttattttttgagatggagtttcgctcttgttgcccaggctggagtgcagtggagggatcctggctcgctgcaacctccgctcccaggttcaagtgattctcctgcctccacctcccgagtagctgggattataggcacccgccatcatgctcagctaatttttgtatttttagtagagacggggtttcaccatgttggccaggctggtctctacctcccgacctcaggtgatccgcccacctcggcctcccaaagcgctgagacaacaggcatgggccaccacgcccggcccagactcgcttttataactgacacacttaggataacaaatctactcctgcgaacctatga

SEQ ID NO: 159674 - DNA, 253 bp, Homo sapiens
ttgtcatctctgttctgctattgagatcgcccagataattttttattttggtaattgcattttttatttctaaaatttcaaataggttattttaatattttctaatttctctgctgagaacatctatctttccattcatttcgaacgtgttttcctttacctcatgaaacagagttataatagttgatttaaactctttggctgacacttcaaacatctgggctttcgcagttgacatttgttgattgtcatt

SEQ ID NO: 159675 - DNA, 392 bp, Homo sapiens
gcttagcctttccggcgggcattacctcaaggcctccggagtctcccctccagacaggcatttcctcaaggcctccggagtctcccctccagacaggcatttcctcaaggcctccggagtcttccctccagacaggcatttcctcaaggtctccggagtctcccctccagacaggcatttcctcaaggcctccggagtcttccctccagacaggcatttcctcaaggtctccggagtctcccctccagacaggcatttcctcaaggcctcacgagtctcccctccagacaggcatttcctcaaggcctccggagtctcccctccagacaggcatttcctcaaggcctccggagtcttccctccagacaggcatttcctcaaggtctctggag

SEQ ID NO: 159676 - DNA, 198 bp, Homo sapiens
tgatctagaggatcccgtgttgatattgctagggtggcgcttccaattaggtgcatgtgaatcaccaagggtgtggtctggcccgcagtcagtgcctcccagaggtcagccactgccattcacaggaaagctagaacaggggtggcactgcttttgggtcatggcctttggctgcagtaggagggaatgaagacaaac

SEQ ID NO: 159677 - DNA, 690 bp, Homo sapiens
ggtttgtaagggtctgttgcattgtggggtctcacactcattgcctgccctgtgctgccctgggcagctgccttcaggatagagatttttgagtttatggttttgctgaaagaaattaactggaaatacttttttgtttacaaatcaccaatgccaatctattcatacattctcatggctaccagaatattccttacctgttcatccctgatggcagaaggaaactggttgatcagggtcagggtgagggggtgtgggtgtgggaactgtcttacttggtgacgcccaggaattgagatggcctcccaatatggcgggcctcctcaccagcaggaatgtgtttccacaaagtcctccagctctgtccatctgacattctgtctctgtctccgttattcttacgcggcacttctctttccagcccccgtgctgcccctcccctccctgtgacctctgccttgctattatggtttgcacagcccagtttgcataaagtggatacatctagaatgttctgccatacaaaagcagcagctgtttttttatccatgtgaaagcatttaatgtccttagccactataaattatgacagataacacactttgcacagactgtatttcaagaagaattttttacagcctgccctgttggtaggcaattcctgttgttacatatcacgagaaagcttgc

SEQ ID NO: 159678 - DNA, 594 bp, Homo sapiens
aattgtactactatgacttctagttttatgttgaataacagtgatgaaagtgagcatccttgtcatgttccagatcttagggtaaaggctttcagtttttccccactcagcatgatactagctgtgggtctgttgtatgtggcttttattatgttgagatatgttacttcgatatccagttttttgagggttttttttttatcatgaggggatactgaatcttaacaaatgtttttttccagcatcaactgaaataatcatatggttcttgtccttcattctgttgatatgtggtattatattgattgatttgcatgtgttgaataatcattgaggcctgggataaattccacttggtcatgatgatcctaatgtgttgttgaatttgggttactagtatttgcttatggatttttacatcaatgttcatcagggatattggcctgtggttttctttgttttcttttctttttttttttaaatgtgtctttggttttggtattaggatgatactggcctcacagaagatggacacattccctcctcttctatttttcagaatagtttgagtagaattggcattagttctttaaa

SEQ ID NO: 159679 - DNA, 132 bp, Homo sapiens
ggacctcacattacatctggctgttataccttaagagtttctcttttaatcactgccagcttcccttccactctttatgccatttatttgctgaagaatatacatcatatgtcctgtagtggagtccatatc

SEQ ID NO: 159680 - DNA, 262 bp, Homo sapiens
agagcatgagagagcttcagctttgatacttaatttctatatatcccatcttattccgaaaggaatttcagttagcttaatttccattttagtgctgtttctttttgtgttaatttattgttttcttaattgtgctgatttaaaatccagccaacaaattaatttaacgcttgtctgtctaaatgtattttcacttcaaagtctcttcagtgaatatgaagacaattagctatatttttgctaacaagatttgctgatgggg

SEQ ID NO: 159681 - DNA, 231 bp, Homo sapiens
ccctggcctagtcattagagaaatcgacatctttttgtggccttatacttgttccaaaaagtgaggatggaaagtaggtaatctatgagtcatctttgttttgattatggcatgtcttattcaaggagagtgacgatgaaggtagaattaatggtgaagaatattaaaagaaagaggtcaagtaatgtgattgaatcgctgggactggagagacaataatggggcttatat

SEQ ID NO: 159682 - DNA, 623 bp, Homo sapiens
aatggttaaaaaattatgatatatacatattatttgtcatacatgcatataataaatgctatgtagcagtccaaaatgcacccaacagttgcgttgtctgaactgccttttatggcttatggcaaactatgatatattatagttgacctcgagacaatgcacagcaaagtcatctctaaatcaaatgcagaaatagtttatgtaccttcattaaacatactggattttttcaaacatttcattcaggttttatataaaaattctcagtacatttgaactctgggattttctctctggtagataagtacaatgatattttcaaattaatggaataaggaatctgttctctattcattcccatctaaatagagtttcaaagagatgctgagaactttcctcagattagtaaattcaagtactcactgtgtatttacctctgtcactgaccatgctctgtacctctaaagtctcttccatttcattaaatgaaagtagtgaatgaatactaagaaatgctttttaaaaacaatagttttattgagatataattcacacaccacacaatacatctatttaaagtgtacaattcaatgacttttagtatattcacagagttctgcaat

SEQ ID NO: 159683 - DNA, 606 bp, Homo sapiens
gaaaagagatcactaagtgtaaaagatgcattttctcctcagcacaaagcagattccaggtgtatataattcaccattcagaaaaaaattccgtggcctgtcatgctggctcacacctgtaatcccagcactttgggaggccaaggcaggaagatcacttgagcccaagagttcgagaccagtctgggcaacatagcaagaccccctctctattaaaaaaaaaaaattagctgagtatggtggtacacacctgtagtcccagctacttgggagactgaggctggaggatcacttgagccactggtagcctgaacgacagaacaagactctgtctctaaaacacacacacacacacacacacacacacacagagagagagagagagagagagagagagagaaaagcctggtccatgggagttgtggttacagaaggcaaagcttttaatataccaaagatctaaagttaagcagaagtactccataagccttaccaattggctagcttgtataagcacccagtcttttctgaagtgctgctacctctcaataggaagcaatatcggggtccttccaaggtatcactgaagtattaggacaatgccac

SEQ ID NO: 159684 - DNA, 488 bp, Homo sapiens
actcactcatcaccaagagatggcatcaaagcattcatgagggctcttcctccatgatccgacacctcccaccagaccctacctccaacatgggggaacacatttcaacatgagaactggaaaggatattcaaaatatatcaccctctgcatgcatcctcttggtgtctatgtatgtcctaatctaataaggacatcggtcggattggattagggcctaccctaatggctctaccttagtcatttccttcaaggtgctatctctgaatacagtcacattctgcggtactgagggttagggcttcaacaaatgaatctgaggggacacaattcagcccataacatctatcacaaaccagacactgttctaatgctcgtgatcaatgaacaaagacaaaattcctaacactgtggagcttatgcactaacagagaaagtgtaccatgaataataatcataattttaaaattacgtagtgttagacggtaa

SEQ ID NO: 159685 - DNA, 316 bp, Homo sapiens
agcgcatcactctcttcccactcctaactgacaacctttttttttttcctcgtggcggggatttttcaccaaccccaatccccccaccttttttgaagtgggggaaagaagacaagatcatcccaggagacagacggaggtggggaagtggggggtggggaggggggcttgagcccggcaaacagccgcgcagctggattattttgcaaatagcaggaggaggggagagaaaggcggctgcggaatcctaggactggcgcggccggcaccctgctgggccgggcgcagggaccggggacccggagccggcggccgc

SEQ ID NO: 159686 - DNA, 385 bp, Homo sapiens
tcaggagcttgagaacagcctgggcaatgtggcaaaatcttgtctacaaaaaatacaagaattagctgagtatggtggtgcactcctgcagcgctcagctactcaggaggctgaggtgaaaggatcgcctgaacccgggtggttgagactgcaatgagccatgatcattccactgcacaccagcccgggtgacagagcaaaaccctgtctaaaaacaaaacaaggctaggtgcagtggctcgcgcctgtaatcccagcactttgggaggctgaggtgggcagatcacgaggtcaggagatcgagaccatcttggctaacacggtgaaaccctgtctctactaaaaatacaaaaaaattagctgggcgtggtggtgggtgcctcta

SEQ ID NO: 159687 - DNA, 829 bp, Homo sapiens
tcccaaagtgctgggtttacaggtggtgagccaccgtgcctggccactgcctcaggagttttgaacaatggacacatattagggttatagtgttatccaggatgcataataaccagagtttgactatattgagatatatgtatcaagtactgtactttctaaagtatcacgtcataatacttactctctgcatagcagctcagaagtcttttttttaactttaatttagccaatccagaagtaatgtttccataaaatagatccagactagaatgaactgaattgcctgagtaaataaagatacgataggcagatgctgaattgctcttctcactattaattgcctcaacactattgagttcctttgagtatctgagagtggctgttctgtctgagctttatttctgacctcagcactgaccttttgattccatcaaaagtcttataccttcatttgttggtatcatcacctgtaaatatggtatccttattgttctctcaggcaaactcagactgtgaaacttaaaaatgtaagatattcctgccactaacagcaacaattattgtgaggtcttccagcagcaaatataattggtctcaaaaatgattttgagtcataccgacctttttttgcagataggcctagcataactcaaagtggtcttttttaggaaatgaaattttgacaatagaggagcattttcttatgcactaatatagaatgatgtgacactactccctgtcccccaaaaattgagggaggtgattctagaatcaattaatttcaataagttggggaatttctatacactgtttccctgttggagag

SEQ ID NO: 159688 - DNA, 414 bp, Homo sapiens
tcaagacggcctcactctccagctcagctttccaggtttggaaataagaaagagtaattacggcttctgggagcaaactcagaacgttctctctcagccttttcttcttcataacaaatattcctggttcctcaaaccccataagctccaagggaaaaccacccttgtctggggagggtgacaaggggcattgagaaggagaagtacgcgttataagggagttcttggacacattccttccccaagttcggagtgagaggcaagaacagttatggacatgtctttctcttcctggagaatgagctgatattgacaaggtcaacatgataacccagctgtcacacttgcaaaagggcctgtccccacctgcagagccattctgaagcccagccaaaaacttcacccaagactcat

SEQ ID NO: 159689 - DNA, 211 bp, Homo sapiens
agaaaatccacaaatcagaaaccaaaaagacttaatcattaaattcaattttccactcactgtatctaaaatgagccacagacccgacagggcatgtgtattcagaacctggataaggatgatggtgaaatgaagtctttaacccatccattacaactaccttttgaatcattccagggaggctttacctacatgcacttgtgtaacagat

SEQ ID NO: 159690 - DNA, 368 bp, Homo sapiens
aatatattaacacaaggggaactagataatggtacatgggatgtctctgcattatttcccacaacttctacaattatttaaaaataagatgtttgaagtcattgatgattatttaatgacataaaagtattcataatccttcttcccttataaaaattagccaagacattcaaccacaaagtacctgaggcttaagtgaaaaccagattttaaaatcttacttatcattccaatcaaccaaccaggaaatatgcacacaaaaaattaacaataattgattgcagaattataggttgttttcattttgcaatctctggcttctaaattttctacaatgaacacacatactttttttttttttttttttt

SEQ ID NO: 159691 - DNA, 114 bp, Homo sapiens
tatgccttgattcactatctgaaaattagatctcaattgacaaaataaaacagaaatagctaataactcatactctgccctcccctgaggactgcagtgaggctatactaacag

SEQ ID NO: 159692 - DNA, 347 bp, Homo sapiens
tcactcaagccagaaaccagtgttttcctggattcccagcccgcacagccaagaggtcagagacttgtccctcttgcctatttctccaagctgttcctgccttcccctccccttggccatggcctcaacttggacctcgtcctgccttcactagcccctgcctggtccgcctgcccgtctccgtaccccagccctgcctggtacccacaccagcctcgggggggatctttctgacactcagatattgccctgtccttgtcccattcactcaaaaaagaaacctgaagtagacaacacacagcacctttgctccaacacaggaaaggagaaagagaaagaaaagcaag

SEQ ID NO: 159693 - DNA, 306 bp, Homo sapiens
atggccggtaccaatcagttacacaactcaggacagacaggatttgtggaagttgaagcttatataaaaaagaatacaaaattatgaatataaaaatttatacaaaagtgagcacttatttaaaataataaatctcaacatagaacaaaataaaaaagctgacaaataccccaactacctgaaaaaccattaaaacaacatatatttttattaattaactgcctgacagaatacttttttacctacaattttggctgcattctctctgatcacctcttcatatgaaaatgattgtgtaaactgatg

SEQ ID NO: 159694 - DNA, 659 bp, Homo sapiens
ctccctcctaaagacaaaaccccatgaatccagttcctttagaattagtggtttcaatcctgactaggcacacaaatcatctctgaggattttaaaaaccatgaactcatgggtgcatacccctagagattctgattccgtgggtctgggtgtctaaggtgtttgaaagctcgccaggtgctttggatgtgcagctgcaataaccagcatcaccagagaccttaggtggtgctaagaagctgacaggcagcatctcattccatcctcacaaccagcctgaggtaggtccatgacttgcttgctttaccgatgaggaaactgaggcccagaggaattcatagctcccctaaggtcatgaaatgagcagaaagcagagtctggatgcatgcggaagtcctagctccaacactggatggaaatgcagatgaaaaagttaggaccactcgtctaaaaccatcctgtgtccacttggctccttcccaaatgacggccaaaattctgtccctgattgagatgcaaggtaaggactgggatgaaactccaaaagctggagttttaaggaacatatatgttgtcatccaatgacatttatctggagccggatcagtatctagcaaaaccaaggctagattgcacaaccttggtgtgtaatctggaac

SEQ ID NO: 159695 - DNA, 299 bp, Homo sapiens
cagagaaattcctactcatccatcaagactctgccctcatgtccttaaaccaatcccaggagaactgcatgacaggcatttactgtgactctcggctacactgtggcctggagacagacaacactgtgcatctgcactgagagtcacgagccccagaacaagggtgtgacagggaacacatcacattcctccctgtccaggacatgaagccagtgcagctccctaacatgcagcagagacctcaaccacccctatcaggactagtgcctatgcttatcattggagtattcgtgggcaag

SEQ ID NO: 159696 - DNA, 482 bp, Homo sapiens
ccacacctgacccccatgactgtatctctctgatccccctgacattcactccatttccccctcctttcgtgttcctcatcctgatcacatttggtttattgatggcagttccaccaggcctaatcgccactcaccagcaaaggcaggctatgctatagtatcttccacatctatcattgaggctaccactctgccccactcccacagcctctcagcaagcagaactcattgcctaaactcaggccctcactcttgcaaagggactacacatcaatatttatactgactcaaaatataccttccatatcttgcaccaccatgctgttatatgggctgaaagaggtttcccccctatgcaagtgtcctccatcattaatgcctccttaataaaaactcttctcaaggccgcattctccttatgtcaagtctactccccccatatttggactccccacaacacaagctactatttctgtggtcac

SEQ ID NO: 159697 - DNA, 441 bp, Homo sapiens
ttacaacagttttacctccaagtcagatccccaacctgaccaacaatcatcatctccctggctactctcccatcactgaccatggggacagcaggaatgcctctattcattcctgcctcattccatcctcgataaatctttctaaagcacaaatcactaatgtcactaccctgctcaaaacactccagtgggccggggtgcggtggctcgtgcctgtaatcccagcactttgggaggcagaggcaggcggatcacttgaggtcaggagtttgagaccagcctggccaacatagtgaaaccttgtgtctactaaaaatacaaaaattagctgggtgtggtagtgcctgtaatcccagctacatgggaaactgaggcacgagaataacttgaacccaggagtcagaggttgcagtgagctgagaatgcatgactgcactcgag

SEQ ID NO: 159698 - DNA, 230 bp, Homo sapiens
gctggcccagcatccctgccccttgcttctgataaacgcatctcattttttactgagggagccactgtagcatagatttgtcatgcgggccaggccaatcggtccagaatatctctgggggtgggaagaggacccaagtcaggcccacagtacccacaagcattggccccaggacttcagtggcagccactgggaaggagaagccccctctccacttgctggccaagctg

SEQ ID NO: 159699 - DNA, 242 bp, Homo sapiens
ggttaaaggattgttttaagttagatatgataaagctgaaggtttgagcaaattgtgaaaggtttgtgaaagactaatcttgtaaaagaaattctgtgtgtaaacacattggctaaagttaaaggggtaatattcagtttttacataaattgaatattgaaataaaagcactgcagggttttcttagaatattaatcttttatttaacagaaaattttaacagtttataaaaggtttacagg

SEQ ID NO: 159700 - DNA, 397 bp, Homo sapiens
aattccatccttagtggccagcattttgcccgagggcagctcgtaagaggcgacactggaattcagacactgattgtttggctttttcccactaaccaccctgacacccaaagggcctccctgtcgccaccctctcctcatcaggttatttacttgtgactgttggaactcaacattttgagctttaactgtgtgctagacctggtggtactcggtggtttgcttgccacgcctttgtttttctcaggaaaaaggtcttgagacacaaccagcatcttatagctagttaggagatgaagctctagaagctctggaacccaaatttcccatctcctggccccagtccctgcccagtccccctgtagggacttagctactgactgatctttgggtgggg

SEQ ID NO: 159701 - DNA, 260 bp, Homo sapiens
tatggcattgacatgttgtgattagttgttatgcaccattatagcaaaaaaattgcacactgataaaagtaactgttccctcgttggcttcaccagctttcccaagaattgtttaatcccattccgtgtataaaatcactctctgctgagaatcctttttctgagaaaagaattctgagatttttttttctgcttgaggcagaccaacactcattccaagaacaactggaaaggctgaataaaacacagaaaactttttt

SEQ ID NO: 159702 - DNA, 243 bp, Homo sapiens
ccagaaatctctttcttcctgacccctcttccccagagtgcccggaattccactgtcagaaatgcattgtctgggttaaaaaacttaacacctgctatgatttcaacagtgtcaaaacaggatacgtcaaaactgggcgaggaggaaatgtatttgggttctaggatagtgaaagctctattttttctacttttctgtattttccatatttggtacaatgagcacgtacttagaacggtttta

SEQ ID NO: 159703 - DNA, 216 bp, Homo sapiens
ctcagatcctcctggcccaggactgccctgggtctccaaacttcacaaaattctcaggagtaaattgggtcaaacagcacccattctcccactcttgcactatttgaccaaagtgcctccaaagacttaagcaggactcagccgatgagcaggacccagggcatcgttacctccattttcgaaacacacacggacgctcatgcacacacaccacca

SEQ ID NO: 159704 - DNA, 416 bp, Homo sapiens
tcactaagaacacatttaatgtacagactatatgcatttttaaatgctctggttcaaggaaagttaaaagtgtttatagttataggtctacatttgagaaatacttgttatgaactgaggaacaggcaaatccagcatttgggccacaacttttctttgatagttccccagataataggctgaagagcatatgcagagatataaaagtcaatgaataagtgaatagctgaatctgttgaacactatgctcacagtttctagttcaagacaaatgaaacattaacataagttgttctgaattttctaagtgaagaattctacccttctttaagttaaaagatttataaccttttcaatagcagtatatattctgcaattcagcagcttttctttctgtgattttgaagaccatcttt

SEQ ID NO: 159705 - DNA, 530 bp, Homo sapiens
atgttgtggaggagttaatatttacaaacaaaatgtttgctaatatttacaaataaacaaaatgtgttaatatttacaaacaaacattcattgtgtaaatgaaacacaacaccttcattgccaatttgtcgaacatttgagtacttactgtgtgctagtcattggggacataggggtgagtaagacatgatccctattttcaaaattgtttatcccttctagtggagaagatagcacaaagagaatgggcaaaaatggttgggcacagaagggctgactgtaaaagtagccaaactcagaataccaaactgatagaaaggttatgatgaggtctttttatatcctctcccacgaacatggtttgcagtatctattaggtatggtaggacatatgccaagaaaactacacaaatcagagtgttcattagtgcagggtgcagtgtgtctggatgggatgtcaagtgcataaggctatgcagcatcccaagtattgtcagtcatggaagctagatcagttttggtgggttagg

SEQ ID NO: 159706 - DNA, 136 bp, Homo sapiens
tatcaataaggagactaacgaactgaaatatcaaatattttttaaacccaagaattcataaaaaaataaaaaagactaaaaacaattcattcatcaactttggaagactctaaggaaacagttcattagtttgaaa

SEQ ID NO: 159707 - DNA, 375 bp, Homo sapiens
aatagtgccattcttttcactagatcttttagagtgtaaaggggtcctgagagaaaaagtttgcaaggggcaactctagggcagtgatttttcttttttttttccagaccagaggctgggctctggattacagctcagtagtgggtcatggaatatgtactgtgactcaacccgtatcattttcaagaaagaagagagagaaaatcgttcagcaaatataactgaatgaattatctggttcacagagtatgtgcgtcttcagctttactcggtcatactaaattgttttaccaagtgattataccaacaaccctctttattttatgtcctcttaaatggatggtatcgtcccacttgtaaatttttgctgtgtgt

SEQ ID NO: 159708 - DNA, 479 bp, Homo sapiens
tattgacgccagaagctgaccggcgacagcagcgaggattttacgcaagcgaggcgcgctgctcgctgcggagtacgtttaccaccgcaggactgggggaggtgaaacatctctgcaatgagaattataaaacacagctcaaagaaatcagagaagacacaaacaaatggaaaaacatcccatgctcatggatggaagaatcaatatcattaaaatggctatactgcccaaagctatttacagattcaatgctattcctatcaaactaccaacgacattcttcacagaactagaaaaaactattttaaaattcatatggagccaaaaagagcctgaatagtcaagaaaatcttacgcaaaaagaacaaagctggaggcatcacattacctgacttcaaactctactacaaggctacgctaaccaaaacagcatggtactggtacaaaaacaggcatatacaccaatggaacagaataga

SEQ ID NO: 159709 - DNA, 875 bp, Homo sapiens
aaaaattctgtcatagactattaaaaaaaaagttttactactcccaagtacacacagttatgagaattaggcttttaaaaagttgcacagtgaaggctctttaggaacctactttacttaatcagtaaaaattgagtattattgatgcaccaactattcccatataaatgtacttgctttttcagataaaacacttctgaagtgctcaagaatgtctgaaaacagtttgttttcttaaataggataaataatcattccttttgcaatcttgtttacagtattcattctcttagccaatccctccacgcaaatggagacaaacttcatcccagtcctaaccagtatagttgaagggaatggagccttgtagtctatgatttttttttttaaatttccatcgaagggattggggatgtcagagagccagagctttcccctttccaggagctaagttggcttcggaagtcttctgggatttgtgaaaatattactgttgtaaaattacaaagtggtagccataacaactccctcagattggagacttgaaatgtcaaaactcccctcttcctttcccctagtttggtggatgctcatttattaattcattcaataaactattagatgccaggtaccaaactactgccatgggagtgcacatattaacaaaatgctctacctgctgccaaatggcttactattctgtggaagaaacaaagtatataatcctccccaataacagttatgtattgtttgttcacttaatgtggaaggcaagactgatgcagacacacaaggaaggctcaaaaatataaatctagcagcaatgtcatcttttttgattttaaataccatatgtgcttactgctaatcaggaa

SEQ ID NO: 159710 - DNA, 663 bp, Homo sapiens
ccaagctcggctaatttttgtatttttagtagagacgaggtttcaccatgttggccaggctggtctcaaacccctgacttcaggtgatctgcccacctcagcctcccaaagtgcggagagtacaggcatgagccactgcgcgcagctagctctgcctacagtttttaaatgacttcttagtctacttaggagaaaatataaactctttaccagagcctactggacttctcaaaacatgatgtatgtttatctcttccctttagctcacttggttttagccgactgaccttctgttctctgagtaaaacaaacttattcctgcaacggggcctttacgcctactttgccttctgccccagaaacagttctcacaggttttcccatgactcttttcttctccttattcagcatcaccccaaacatctccccctgagtggccttcgccaggacattcttcttaaatatctttccttacctcatcctgtttggttttgtttataacaggtgtcagctacaatactggttttgtttgtttatttactttttcttacaatggaaagcccatgagagcagggttgtgtctgctttattcacaactttaacctcagtgccagtacagaaccaggaccgtactagaaactcaatgaacatttgttgagtatt

SEQ ID NO: 159711 - DNA, 194 bp, Homo sapiens
aaaggtaatctttccatgaaggagcatatccatcaaatacaacttattgcaaaccctagctcttccaagaagatattaacatgaatgctgaatatataactcatcacacgtatggcattaattccatcaaaacatgatagatcaacctaaactgtcaacatacagaaggataaataaagcatttaaccccttgg

SEQ ID NO: 159712 - DNA, 237 bp, Homo sapiens
atttacagagccttcatacgtacttttttatattttaaccaaattactattttttggctagtttacaaatgtaccattggcaaaataaaggaggttatatctttctttcctttatattttctttactgaagcaattaggatcttcaaccttgggtctgaattgcaacaatattggaaaagtgaataaactattccatttattaaatgccagtttaataggtcagaaaacttatgttc

SEQ ID NO: 159713 - DNA, 242 bp, Homo sapiens
accaaacttaacctttgcccaagttagaaaaaaaaagaggtttagcaattaaaaacaaggctgggcatggtggctcatgcctgtaatcccaacacgttgggaggccaagatagaaggactgcttgaggccaggagtttgagacaagattgggcaacatagcaagaccttgtctccataaaaaattgaaaaattagccaagcacggtggctagtcctgagtagctaggactcaggaggctgag

SEQ ID NO: 159714 - DNA, 213 bp, Homo sapiens
gtgttgtaagtctcctgggagtgacaggatgcttgtggtgtgctgaatggtgtgcccccctcccccaaaaagatgtgtctacaccctaatctctagaacctacatttattggaaaaaaggtctttgcaaatgtaatgaagtatctggaaatgaaacaatcatctttaatcatctaggtggccctaatccaatgacaagagtcctttttttttt

SEQ ID NO: 159715 - DNA, 566 bp, Homo sapiens
cgcacaccaccatgccggactaatttaatttttgtatttttagtagagattgggtttcaccatgttggccaagatggtcttgaactccagacctcaagtgatccacctgcctcggcctcccaaagtgctaggattacagatgtgagccattgtgcctggcttaaaaaatctgttgactaaacggtgcatgaacaggacaagaatgtttaatcaggcttcactataaaatatccaaagattatccacttctctttgctcctgataatggacatgaagccttcgcaacaagtgaaaggaatctctttcattatcaactaataagtggcattttggtttatatggtagtctcttctccgtgggtcagaataaccctgagtcagtggacaaaatgaccctcgtagatctaaaatgctgaggaccagccctcaggcagtggtaaatcccctgatataatacaagcctgtaaagtatcatggccgccaggccatctctctcaatgccacttcagttgctgacagtaattacctactacgaggcagagatgctaaactccagttcatagctca

SEQ ID NO: 159716 - DNA, 327 bp, Homo sapiens
gctgaaaggtaaagattaggaaccttgatggaggttgaatttgagtttctcttgggactgaatgtgcttggggtttcctgtctgtctttgcaaatagaagagttgattttttgggaaataatctgttgatctcttaaccttagaaaggattacaggcgtgagccaccacgtccggccagaatgatccgttatttccagcaaggaatagcctgagaagcacggcaggccttgagtggcgttagagagaagtgctgacatcttgagtgatggagagggtggccctctgggcagggtgtgtcccacagggtgcctgtttggacgtggggt

SEQ ID NO: 159717 - DNA, 117 bp, Homo sapiens
ctgcctcagcctcccatgtagttgtgaccaccacaggcgtgtgctacacatgcggctaattttctatagaggcagggtctctctcactttgttgcccatgctggccccaaactcctg

SEQ ID NO: 159718 - DNA, 258 bp, Homo sapiens
cgaacttccaaataagagattcatttaaagccttatgtttagggctcacaacttaactgcccaaggatatcagagggcgcagctttacataaacaaatgaactaatgatacgtttacaaagaaatcagaccacaggtacaactattaaaataatcaattaaaaaatgacttttggccaggcacgctggctcacgcctgtaatcccagcactttgggaagccgaggcgggcagatcataaggtcagaatttcgagataa

SEQ ID NO: 159719 - DNA, 444 bp, Homo sapiens
agacgaaagatttgattgaaccgactcgaggactcgggatcctactataatcgtgctataggcatacaagcgatcgtagatggacgcgcgtacttgccagattatgtagcatgtagggtcttgagggcagaactactatcagcctagggggtacctttgtgcggtttagaaaaagaggtccctttctctgggcagacttggcaagaggagcaacactggactgtggcctctacttgttccagcactggagcaacagcctcacttgtaagaatttaggctttcctctgagtgagattcgaagcctttagaggcctgtgtgcagaagagtgggagagctgacttaacattttaaagaattgttcttggccaggcatggtggctcatgcctgtaatcccagcactctgggaggccaaggcgggcagatcacctgacgtcgggagttc

SEQ ID NO: 159720 - DNA, 309 bp, Homo sapiens
tctcgcaagccccatcttcccggcagtcaactaagaatcagactttcccagcccctgtcaaccaggctgatgagtagaagaccaagaatcctctccctcctctcttcctcttccctctctcaccagtccctgccaccaagcctttaggtgaagccacggaccctggggggcgccaggaaaagcaagtacagtctctcgagcactccagccaattacagaggtgcaattacagatgctgcatgtgcagctgccctgaggtttacagaattagcttatcaatgacaaaacagacggccatctaaaacacac

SEQ ID NO: 159721 - DNA, 334 bp, Homo sapiens
taactctaacattagtaataacccaaacaagcatcaatagtaaaatggaataaactgcagcatattcatgtaatgaaatgctatacagcagagaaaatgaatgaattgcgacaataggcaacaacatggatgcatctcacaaaaacatgctgtcaagtgaaagaggtcaggcacaaaagatatatgctgtgccatttaatcaatttaaagttcaaaaacaggcaaaaccaacctatagcaacgttggaagtcacaatggtggtgtccttggagaagaaggtggggttactgatggcagctctggtaatgttctggatatgagtgatggttacac

SEQ ID NO: 159722 - DNA, 407 bp, Homo sapiens
atccagattctctccagagttgagatcctccccaggccccagatccaggttcttgccatctcagctactccttcacccaatgcagctattccatgagcttcagcttctcctcatactctcgcccctcccagatcacaactgatctttgttatatctcagttcctctccagatacaagatgaacctctatacacgtcttctccaggtctgctcctccctgatctcagctactccccacaccacaaattatccaggtcctttcccaaggatgatctctctctctctctcaaatctcagcaactccaatgacaactccctatatcttctgcttctccctaaaactctcaccaatcccaggtgcacccaggaaaatttagatccccatagaaccataacttccccttaggc

SEQ ID NO: 159723 - DNA, 340 bp, Homo sapiens
ccactttataggatttgggtaggtagtggaaaattacagtcaaaggggatgttctctggctggcaggggccggggttacaaggtgctcaatgggggagcttctgagccaggagaaggaatttcacaaggtaatgtcatcacttaagacaggaactggccattttcacttcttttgtgattcttcacttgcttcaggccatctggatctatacgtgtaggtcacaggggatatgatggcttagcttgctgcacaaattccatgataattcctttcctatttgtacccagaaaataatgaacaaaaatcaaagcaccatttggacaacttgtttcaatttta

SEQ ID NO: 159724 - DNA, 310 bp, Homo sapiens
ctccagattaactagagaattaggtagctgttctggctgctctactttgatgatttaataagtggcctgaaaatcgctggagcaggaggttaagatcttggcaacattagagaatagttaggtgtacattttcacaagttggagcacagtgaatgatcaaggtggaatagtaatagggtagtcatgactagcagcaactcacttagttctaaggtgaggaatatttctctttgtgcataatttcacagactgtatcattccccagggtgatgtgaaagcaactacattctctggtaggctcattaccttt

SEQ ID NO: 159725 - DNA, 240 bp, Homo sapiens
agcagggcctttccagacaatgtagtctttcctgtaaagaaaatggttttggtgtgggatttggtaaaaacactggttagtttgtaatgaagaaagaattttggcatagacagtccgacccagttcatggatacagtttgatcccagggagtttaacaaaaggaagctttggttttgctagcaacagacttgatcttctatagtaattaattgcaattaaggttttccaggagctttctc

SEQ ID NO: 159726 - DNA, 594 bp, Homo sapiens
atttgtcctgtgctcttggtaaaacatggcttctatggtaggaagaggggaaaagtctatattttaaatggtttcatggactgccaagaactgttataaaacaatattttgatgagttacacagtacatgaatcagaaacatatgagattaatttccctgaaaatacatgtgggtttaaaaatgaaaggaaaggaatgttggcacaatgtgctatgccaaaccgaaaatgttagaaaaatattttatgatattaggatgcacaaatcctaaaagcagctcaatttgctcatctttcagtggcctgctcccaatgtacctgttgtgtctggtcctctacagtgagaataagtaaaacctaaacaagaaatttaaaagccatggtataagacaaggagccagaagttccaagtcttgggcctggttctgccactggctagctgtggaagtctagattaatcacttaatcttcctgggcctcaactcaggaaaacagtccatgacttgcagacctcacaggattgttgagagtgctgttagaatgcgagttcagaaagcagtgataagcccaggatgacagagaccagaacaaaaaa

SEQ ID NO: 159727 - DNA, 527 bp, Homo sapiens
catttgtctgttcaaaacagttaagaatctctcaattgatctaatgaattgaagaaatctatccccacgttagaaacatgcacatgttggccctgatttaatttcccagtaactacaattccccagtaactacatatgcatatgtaccggacaaacaaggcagctttccattcccaactcctcttccctggctgatggttctcaggagaatctaggcatctgagccctagccccagcaccctaatggagagtgcagggcacctggatagtggaggcaggcctagaagcttttggtgtaaaagatgaaattgaaataaaaagacccacaggtaaccatgtgtcaagcacacatctggtacccaatacatctttatggaataaaatagacattaaaatgctacaggtataagttaaaatattggcaaactgactagcaaggtttagaaatccacatttaagactggtctagtggtgataaattccgtcagctttttcttgtcagggaaaaactttaatttctccttcat

SEQ ID NO: 159728 - DNA, 220 bp, Homo sapiens
atgtgtagtaaggattgaggactggttaaaagctttgccacattcttcacatttgtagggtttctctccagtatgaattcttttatgtgtagtaaggtttgagaactggttaaaggctttcccacattcttcacatttgtatggtttctcttcagtatgaatattcttatgttcagtaaggtttgaggattggttagaagctttgccacatttttcacac

SEQ ID NO: 159729 - DNA, 457 bp, Homo sapiens
tcccctcttttcatcctctccgtttacactcacctaagtgaactttattgatacatactgccatgtatacacctaaaatactcaaataatttccaacccaggctgcttctctgagttgtatcagaatgaaatgtagccaactagcaacactccatttccactgaatatcccttaagtaactcaaactcactttgttcagaaatgaacttaaaatgttcccccacccaccacaaccacaaccattgaaaacaaaaactaaaacttccatctttacaccctccaggatttcctatctccgaatatggcactgcatttaatacttacgtcagaaacatgggcatcatccctgacatatacatctccttcaccatccacatcttttcaatcaacagatgctatccatacttcagcacaccttttgtattatctacttcttacaacctccacttccactacc

SEQ ID NO: 159730 - DNA, 679 bp, Homo sapiens
acacacccaggagctccagcctgttatgggatgggcatcctaccaggaaccaaggatgctaagatgtcctccaaaatggattgcctcatatctagtacccgcctgctgcaggcttcttcatctagttcctctggggacacactgtgcagctaattcatccaggcagattcactgggaagctgttgctcatgagggtgtaatgaagaatctccaggtggagaaatgatcctgaattatccagtgggccctacatgtcaccacattgcgatccttctaagtaggaagcagaagatctgacacatgcaggagaggggaaggcaatgtgaccatggaggcagagaggggagtgatgtggccacaaaccaaggattgttggcagctgccagtggccgaaggggcaatgaatggattctcctttggagcctctggagggagaatggccctgctaacaccttgattttggcccagtgatactgattttggacttctgccctctagaactgtgagggaatacttttctgttgctttaagccattgaatttatgatgatttgttacagcacccacaggaaacaaatgcatggatctaacttgaacctagtgagttagattacttcagggaaacacaataaatagttaacagggcttgtcaggggggtgggagtgagatgaaagtgtga

SEQ ID NO: 159731 - DNA, 666 bp, Homo sapiens
acacacccaggagctccagcctgttatgggatgggcatcctaccaggaaccaaggatgctaagatgtcctccaaaatggattgcctcatatctagtacccgcctgctgcaggcttcttcatctagttcctctggggacacactgtgcagctaattcatccaggcagattcactgggaagctgttgctcatgagggtatttctgagacttttttttgtgaccttgctgtatgactggtgtaatgaagaatctccaggtggagaaatgatcctgaattatccagtgggccctacatgtcaccacattgcgatccttctaagtaggaagcagaagatctgacacatgcaggagaggggaaggcaatgtgaccatggaggcagagaggggagtgatgtggccacaaaccaaggattgttggcagctgccagtggccgaaggggcaatgaatggattctcctttggagcctctggagggagaatggccctgctaacaccttgattttggcccagtgatactgattttggacttctgccctctagaactgtgagggaatacttttctgttgctttaattcctgtttataactccatgagctcctcgatcactgtctcctgagatgtcctttttgtcactggaacttgtattaaagtggttttgtaatgggta

SEQ ID NO: 159732 - DNA, 547 bp, Homo sapiens
gaatcccaactcaccacccaggaacaggagaggccaggctcctagctgcaaagggtgagaacttcctgaggctccatcccctcctcccagtgcacaggctggtgggagactctccagggaccttcccccttatcttcctcctgcatcgatcattactatgttccagacactgcatcaacaactttatatgcagctttctttgccaaagaagtctcaccaaaaaaacttcttcgaaagtatctgaacacacaaactcaggtgtctacatctcacagcagggacacatggtgcatcctccacggaagaagccgtgctggctaagtgtgtccatttctaccccaactgccctatgaacagaaaggatttctaaaaaaggaaacagagaaatactgttggaaatgtatttaaaacaaatcatcatctttccgtatttcctttttttttctttggagacggagtctcactctgttgcccaggctggagtgcagtggcgcgatctcggctcactgcaacctccacctcccaggttcaagcaattctcctgcct

SEQ ID NO: 159733 - DNA, 520 bp, Homo sapiens
gtgaaattccatctcaaaaaaaaagaaaaaaagaaagaaatgtctactcatccctcaagtcccactccaaagtcccttcctctaattgagctctcagtcccccaaggattttgccaatctcctgacccttcctctctcaaccctgctcaccaaggctgtgtccaaacccgcctctgccatcagactgacaggtcctcctgggcagggtgtgtgttgcacagtgcctggcatgggctggatacagaggagactgactgtgtgtctacaatgcccagccaatgcctcctggaaaccctgttccctgtattcccccaggtcacactccaaaaagtcctcttacctggcttgggaggaaggtccttgtagggaggtgttgagttctcatagtcatcatcctcctcctcctcctccatggtcccttccaggggaaaggcaagtcagagcccagccattccctcctccctccatccctcaagccctggtctctgcctcagctgccccatgatggggattctgtacc

SEQ ID NO: 159734 - DNA, 868 bp, Homo sapiens
ccttctcagtttccttctcctctgcagtgactgtgccgccctctgtggtctccccaggaccagtgttgaggcaccacttcagtagatccccccagatccttggaaggtctgagtggccacgagagggtggtgagagttggcaaggtgggccttcctgcagggaccacggggggtcagcatccttgcctccgttctagacacaggtgaatgtcagtgggcacccacactggcggagactccagtgtgagggcaaggaggagcctagtgagactggatcctctgcaggtggaaaaataggaccttctcagagttggctgtcacatacaaattaacagggactgtgggtgacgtttctaacaataataattaaaaaacaacaaccctgcagcacatgtcagcctggcgttgggcaagtctgccacctttcttttatttcgatgtgtaatggttcacatgatttggatgagaaaaggagggatcaaactttatagacaaaacccagctgtgtgaaaaacaggattaatgccagtgattggggatgatcaaagagaaaccttactttttctcccccagtactcattccactaaagggcgaattggcagagttcggcatccctggggggaaagagaagtgctagaatcatgcaacgtgtgagtgacgataattccaagatcaaaacttacacacttaatctgctaactcttatggtgagggtttcttgccatagatgctatgtgggtctgtttctaagtagaatcactatattaccccagttaataaagaaacatggatttagcagatttaaggttaatattgtttaaatttaaataaccttaaaataaatctctttctcttctaaaaaaaaaa

SEQ ID NO: 159735 - DNA, 347 bp, Homo sapiens
cctccctagatggcggcactactagtccctctgcttccagccttatccttctatggtctattctcaatgcggccagcacgtcagtcctctgctcaaaaccctcccatggttcttgtgtcactcagagtgaagcccatagcccttacaaggccccataaggtcaaacacgattgctgcccacttcccccatgacagctgtcactctgtctcctgttcctcctccctattccttcccccttctgctccttgggcaccccagctcactcccatgttaggtacttggcgctgaaatactcctctcccagaacttcttctggctcactccttcatttcttcaagtctacaca

SEQ ID NO: 159736 - DNA, 568 bp, Homo sapiens
acccaggctggagtgcagtggcacgatctcagctcactgccacctctgcctcccaggttcaagcaattctcctgtctcagcctcccgagtagctgagactacaggcgcctgccaccatgcccagctaattttttttttttttttttcagtagagatggggtttcaccatattggtcaggatggtctcaaactcctgacctcaggtgatccacccacctcggcctcccaaagtgttgagattacaggcatgagccaccacgcccgaccatatttatttttaaaagtaaatattagttctatgcgacacttgagccaatttcagtactactgggagggccaggaaaggcaaagtagttacaagctaaatcctctttttatctgctttatatttcaggggttctcattgagattttgtttaatgagtatgttctgatgctaaaataagtttgaagacttccagctggaagatgtgttctaaggtccttttgttactgaaatgtcagaggttctgtctaggtcctgctgctcactgcatagcgccagtcactgcattgagtatttccagggg

SEQ ID NO: 159737 - DNA, 313 bp, Homo sapiens
gaccaaagtgctaacaataggatgaaggggcacggggaggttttcccgttgcaacctcacctcatgaatcctgaaattagattgctagtttactgggtctgggaactccatttcagatgtgaatctgagagttcctcagataaaacatataattaaaaaggatgtttatattaattacaagacaggacaaaacatttgatctttataaaagaaaaaattatatctactatgtacatgtgtagattatatgtataaatcataatggaaaaaggtaaaaagtatacctgaaggaatttactaccaggcatcacct

SEQ ID NO: 159738 - DNA, 251 bp, Homo sapiens
gccaaaattattatcttaaagtatttttttcagggaaagaacatttaaattaaaggaggaattacataaaaacacttgaacaataatactctagaagcatctgaatagaaataatagactttctttcctttattcacagaaagtcacaatgtcccctgggaaaagtcatcttttaaatttgaaatcctctaactccttaagggattaagtacccagatttctgcactggtgacttagatttaataaatctg

SEQ ID NO: 159739 - DNA, 456 bp, Homo sapiens
acacagacatacacacccacagacagatacactcctctccaccatactaagcttctttcttaactctaggttctgcacgagctgtttccactgccagaaacacttcctcctcctagtatttttctcaacctgccacttattatattgtatcacatttgcttattaatgactctaggttttgaatgccatgagagcgggggctatttttacttctttgtcattgaatcctcaggactttgtctggtgcctggcacataatagcttctcgttaactgttgaattcattagtgaatgaaggaaatagcaacaggaaaagttttattcaccagtgtttatcctaaggttagctctgcttaggatgatctcatttgtgactggatgagaaaactggcaagtgtctgaataattcacaaatgcaagttcagctcctgaataagcagtacaataagcaatgtg

SEQ ID NO: 159740 - DNA, 363 bp, Homo sapiens
caggcagaaaacaccactggtcaaagaatgactgcctggattatagaaaatagtaagttctccagagaggcggcatttagacctgggtggcttcaaaccaggaaaacctaagattgatggtgcacttcccaggccaagggataaaagggactgtgatcagaagtaagaaagttaaaggggtggctgggcgcggtgtattcgagaataagaaggcaggcttggcatacgaagtcagagaatgccactgttcaaagattgactgcctgaattatagaaaatagtaagtccttccagagaggcggcatttagaccctgggtggctctcaaaccaggaaaccctaggattgatggtgcacttcccag

SEQ ID NO: 159741 - DNA, 188 bp, Homo sapiens
aatcgagctcggccccgttgctggcatttcaatagacacatggttttttttttcagtcatattaattaagttctgtgcacggtgcttgcacataaataaaaccagatgcttaaattgtagctcaatcattacgctgtatttgctcacatcccctcctgtaccactttcaagaaattggcttttcgcct

SEQ ID NO: 159742 - DNA, 528 bp, Homo sapiens
cattcaagtcaacattgtttactaagtgcctatttgtactttgaactcagctggatactatgtacaaagagagcatggtgtactcaaactatttcatagtcctagaaatccttcagggacccctctccttttgtgagctcccaggcaattcaaaagctacttgggatgagttatatcctgggcacaaagaagtaacttaagttggccagctccactccttcacagagcaaatagaattgaaataagggcagggtgttctttttcagttctttgcctaaccaacctaaatataatcctttaaatatcttctaaaatagtttgtcttacacattaattattttttgaatctatatcaaaatacatatttccagtacttagagatacttagaaatggatacaataatttcccaataattcttctggatacatgtgtgtttaaaaagtcaacattctgtttttttattgggacaggtgatctgtaaggtttattgttgacattctagttactttaagtttgatagccatgtt

SEQ ID NO: 159743 - DNA, 485 bp, Homo sapiens
  misc_feature (4)..(4): n is a, c, g, or t
  misc_feature (32)..(32): n is a, c, g, or t
aagncagttaatacagactcaaaacagaatanttttaaggagggactctggccgggcgcggtggctcacgcccgtaatcccagctgggcagaccaggttggtctcgaactcctgaccttgtaatctgcctgcctcggcctcccaaagtgctgggattacaggtgtgagccaccatgcccggccgtctctgacatattataagtgctcaaaaaagaagttattgaatgaatgagcaagagtatccatcaagagaaaacaaatgtctatgtctagaatgagcaaaaatacatgactgcagcagagtggaagaacccaatgacatgagttacccaagcaaggaaatgctctgaagagctgagaatgcaggttgaggctctattcctgtagaaataaaactaaagctataagtaccagtcaactggctgcatttcacaggggtcagccactctgggcagctggtgataatgagtctgtattactgctta

SEQ ID NO: 159744 - DNA, 479 bp, Homo sapiens
aagccggagaactgcaggttcaggaggctgggaggggccacagccagccagtgggcccggtttcccaggatggcccctgactctgatgccagcgacaagactctttcctttgctttccaggctggtgggtaatggccttgctgttgcttagagctctgggttgcttctcagtgccctgtttgacctctcagccatcccagcactggtttaaccatatcctggtgttaagtctcatgtttgcctgtctggactccaaatgacgggggcaggtgttcaggacactcgtcccctttggaccacacaaggatgtaaccttgggccagggtgtacacttccatctatcagaatcttggcagagacctggggagcggcgtggatggggagtgtcagagtgtgaatggcccattttaaagaaccaggggtgacgtcaactcaacaggaagccacagcaacgagggagccacaggtcactggggcaa

SEQ ID NO: 159745 - DNA, 215 bp, Homo sapiens
aaaacaagacaaaggcgatcctgtatcctggagtttccatcctagtgtgtatgggtaaacatgtattatagatgaaaaataaacatgaatcatatcagggttataaagcaggtttggtgagggtaaagagtgtcagctggatgaaggaaaggtgttctgttttatatctagtcatcaggaaaggtgctgctgctaaggttatgttcgttccattt

SEQ ID NO: 159746 - DNA, 674 bp, Homo sapiens
agagctgactcggggacaggataaagtagaaagagacacttctctactcccctttgggggacagcgatttgcaatctacaaagcacctacacatctgtgacccactgaatcctcacagcagcctgggaggcatgatttattatccccatgttacaggggaaactggctcagagtgtatgtgtaacttgcctgaagtcacatagctgctaagaggcaggatttctaattctgccttaagtccaaagcctccttccactcccagctcctgtaacaatccttcagccacttctgaaaatgctccttctagcgccgtggtctaatttaaggctgggaggaaccttaaaattatctaacccattggcttccaaagcctgggcctgggggagctgtgtaacattccagatacccaggccctagtccaggggaatgtgactcatagatgtgaagggacatctgggaatctgtatttttaaccagctaccccagtggggacactttctagtgccatctcatgcccctcccattttacagatgaggaaactgagacttgaagagggaaagagactttgtccgaggtcacaaaatggcacaggaaggggccctttggttgcccacccaggtggaacatccctctatccactgttccttctctctctgcaggctccaggactcag

SEQ ID NO: 159747 - DNA, 182 bp, Homo sapiens
tatggatgccaacaaaacccacccaacaccaaagaggaaatgttaaagcagcatttcccagacttaaggagtttgcataccaccttccctatttcagtcatttccataaacttccatctactccaaagattttagatcactattcaaaacagaagatcagtgtgtcatgtgacaaacagaaa

SEQ ID NO: 159748 - DNA, 249 bp, Homo sapiens
acattgagtagccataacattatctttaaacatatttattcttcatttcctaacttttcccaccttttggctaaatcgtatgttctttctctcacctcacttctgttttattactctctgggaaagatttttatataaaacgtctaagcaatcaaacctaacgcaggatgaatttctacacattactataccctctggtcactatttttttcttctctttattgcccatttccctgttcttgaaacatt

SEQ ID NO: 159749 - DNA, 338 bp, Homo sapiens
taaatccattcaaataaataaatccactgcatttataatctgggcttcctattcccctctctactctgttgatatcccctttttctctttactggcccacttttttttctcccattctcctctacctttttctatcccctttcaatgcaaagatctgagatcttgggcctctgaggtcagtataagcttagggatggaacaaaatatcactatattataatttatttggtcaactcaacatatttttccccaatctgatattttcaggggaattaaatcagtccatggtttaatatgcataaaggtgataattcctcatccaggtcaacttggatgag

SEQ ID NO: 159750 - DNA, 409 bp, Homo sapiens
gtacattttcagttttgacaaatgtatagatttttgtaactaccaccaccagtcaagatgaaaacgtttctagcactccagaaagttcccttgtgtcccttcttggtcagttattcccaccactgctctcaggcaaccacagttctgcttctatcactatataagtgacagaatttttctacagaatttcacatagatggaatcatacaatatgtactgttctgtctggcttcttgaggtaagccaaatgtcttttaagagtcatgcatgttttagcatttattagtagtttattctttttttgttggtgagtagcattcattgtatggatatattccagtctgttttattcattcactttttggacatttgggttgttatcaattttgggctcttttgaattaatccc

SEQ ID NO: 159751 - DNA, 378 bp, Homo sapiens
tgtgttgcccaggctgcagtacagtggcacaaccatagctcactgcagcctcaacctccagagctcaatcttcccatctcagcctcccaagtagctggaactacaagcacatgccactatacctgaataatttttgtattttttgtagagacagagtcccactatattgcccaggctgttctcaaacttccaggctcaagcaatccacccaccttagcctcccaaagtattgggattacaggcgtgacctgtgtctggcccaaggagagatactttgaacagttcattttaaagcaagaaactcaattaaataagaatttcattaaattaactgaactcttacaaactggaatatcatctctctgggatcagctgatt

SEQ ID NO: 159752 - DNA, 184 bp, Homo sapiens
acgagcagggcctccctggccaagctgcggcaaagcaagcctgtgtcataggaccccctccacaggatgcagctgctctctgctgcttttaacatgcaaatgcagacttcctagtagggcagggtgaggcagagcactcccaactaaatcttgacaggagagcttggtgctgggcggtatttag

SEQ ID NO: 159753 - DNA, 419 bp, Homo sapiens
ccgaactgtcagtccctttgttttccagtctacacaaaccttgttgtcacaagtttgcccttgccccaatgtggatagctgccaggccctctttctgagcctcctcgtcaccttgcctcaagccctcacatgtccccagcagggtcagtgtggggtcattgcaggctcagccatctgcctgttcttcttactcctcttgacacccataggacatgatttgatttctattaaatccagaaactcagggagctggagtgtgtgttatgtaactctcagcatttttcgtgaagaattacatactttctgtaagtgcagctgaggtcatcccataacctcatgcatgattgtgaaacagacctgatttggctcagtgctaatatggcctttgggatctttgttcatgaaagcatttcctcagt

SEQ ID NO: 159754 - DNA, 468 bp, Homo sapiens
atcaaagcacggtagggaaaggcactcactctgcattataaaaaggacagccagatatcaactgttacagcctttcaattcaacttccaaatttttcacacttagctttaatttacacatcagtatgcagtttaatttatgcctttgttcacgtgtactcacacatctgcctcaatgacatttcatatctctccttgcctagaacatctgtctactgcatcactctgaagcaagttatgggctttttaaacaaggttatacaagaatacggtgataatcatgctgtttatactgagtaataatccttcataagacatgcttagaaacgtttagactctgatatagtctctttctagaagtttaagcaaaagaaaaggattaagataccttttaaaaaaacatgttttccattatgatttcagtttaaatgctttaatctatttaaactgtttgtaccattagtatgat

SEQ ID NO: 159755 - DNA, 288 bp, Homo sapiens
catacacctacacacccccacaccacacacacatctacacccaccacacacacctccacacaccacacctccactcatacacctacacacagccctacacacaccacacctacacacccatacaccacacacacccacacacaccacacacacacatctacacccaccacacacacctccacacacgatctagcacccaccacagcctacacacagcgcccgcgacaccatacacgatagcacacgctccacatcaccacgggagatcctactagaggtcgaccctgc

SEQ ID NO: 159756 - DNA, 370 bp, Homo sapiens
tgttctagaggagtcccccaagctgtcacacacacacacattggatattgggtccaccctcagggcaaagccaggagagagagaaaaaaaaagaaaagaaaaagcaacaagatttcccctacactcttaaaaccacaggggacttaatttccagacattcctgttggagctttggatgtgtccttaccttcactgtgcaccacaatatagggctcactctcgagttaaacttataaaagaagacacaaaacaacatgaactgggaaattcatcacaacgtcggttatagccacaaattggactttcctctccaatctgcattggtctgatttacttttcagaattctcaggtatttatttgctttttgtg

SEQ ID NO: 159757 - DNA, 133 bp, Homo sapiens
ggaaaatatctaataagcaggcatgaagtttcagttaagcaagatgaattaagtgccagagatctgctgtataccaacgtacctgtaattaacagtactattctctacacttaaaaaaaaaaagtaggctggg

SEQ ID NO: 159758 - DNA, 285 bp, Homo sapiens
atctagagaaactctggatcctcagggcttgttcctccagaatagcaatccagtaaggggcatctgagagttgagaataaggggagagctgaactcatggctagacacaacttggcttactaaagttcagagatgaaaagcctcatttcagtaattacagtttagttttttagaacagctgtataaataccaaatggctattcatcatatctttcttcttcctcaaaacaagggttataccgtagacaccctaggacttgcctctattctttgtgtctacatttc

SEQ ID NO: 159759 - DNA, 561 bp, Homo sapiens
actctttgttgcttcaattaaaactacatactaagaccagattaactttcataagaatctactttttatctatcattcctttctccacatctactgagaccccacctaccaaatcttttgtctaactgctgaaatggttctcatttcctgttctacgaaagccttacatatgaaatagaattgaatttatagagtcagaaaatccaagtttgaattctggtgccacttactcgctgcggtctgttatctataaaatgaggatattttctctcacagagagtgtgaggcttaagattttgttttttgctttcagacagggtctcgttgtgtcacccagactggtatacagtggcacaatctaggctcactgcaacctccaatttccaggctcaaacgattctcccacctcagcctccaagagtagctgagactataggcatgcaccatcatgcctggctaatttttacatgtttgtggagtcaggattttgccatgttacccaggctggtctcaaactcctgagatcaagagatccacctgcctcagcctcccaaagtgctg

SEQ ID NO: 159760 - DNA, 417 bp, Homo sapiens
aaagaaaaaaaaaacatgttggaaacaaaatggaataagatggctgattccctgcagaggacatgccagctcgcatgacagcacatctctctctgccattggtcacgtggcttgatctcaatctcaaatttgaagagatgagttgggatgattcaaaatctgaagtaggaagcactctcacataaatgcattttttatttgctttattcttggagttctgtcaggtgctaggaatccacaatgaccaacccaaggggcctcttgctctcatggagcttgtagtccagctggctgtgttctggattctggggaaattacagataagtggaattccctctcaacctgcctgagacctgctgggcgtttcagaaaggcattaaaaaggctgggcagagtggctgacgcctgtaaactcag

SEQ ID NO: 159761 - DNA, 404 bp, Homo sapiens
atgctgggctccttggtaagtgctccatgtatcttttcaactattttcatgctctcaagagtgtttcaagaaaagcgctgtaggccgggcatggtggctcacacctgtaatcctagcagtttgggaggctgaggcggacagatcacctgaggtcaggagttcgagaccagcctgatcaacatggagaaaccccgtctctactaaaaaaacaaaattagctgggcgtggtggcgcatgcctgtaatcccagctactcgggaggctgaggtgggcggatcacgaggtcaagagatcaaaaccatcctggccggaatggtgaaacctcgtctctactaaaaatacaaaaattagctgggtgtggtggcgtgcgcctgtagtctcagctactccagaggctgaggcag

SEQ ID NO: 159762 - DNA, 343 bp, Homo sapiens
ctgcaaagttgtctaaggctggggaatttcatgaagttcatggatatgatgatagagaactgtcacagacacatacaaagccactgccaaaacgaggatctgacaggaggaaatccacaaggatgaggccatgtgggaccctgagaagaactgatggcaccctggggtgtttctccacagtggcccccttcatggtcgtgctgtgaaaggcagacatgaagcaaagaaggtccttctgtaggcagccccactgtcatcactctttgttcctataattaagacataaatgcattcaaccgtaattttgataaaatataagatgatgaatacatttttataattt

SEQ ID NO: 159763 - DNA, 419 bp, Homo sapiens
ggcttccaagttcattcattgaaatgaatacttattgacaacccactgtatgctaaacattttgctagattctggggttgcaatgataagcaaaccctgacagtcccaatcctcttgtggtttataggctagtagaaaagcaagacattagtcaagtaatcacacaaataaatgtaatattgcaacagtggtaggtattacacaggagaataacatggtacaacgagggcatatgggtgggtaatttgaccatcaggaagttttctctaaggaaatggtcattgagagctgaaataagagtaggtgttaactaggtaaagagaaaagggaagagtgactcaagtagagggaacaacatattcagaggctctgagttggagacctactttattatagaatggcaagttcgagactgatta

SEQ ID NO: 159764 - DNA, 499 bp, Homo sapiens
attatacatgtaggatgaacaaatagaaagggattatttcctttaacagaaataagctgtcttccccaaaaaggttatacctgcttacatactggtggaacctattctttattgcaggtcctctcctccccttgctagatttgtgggactcacaaagctgtttccagtgacacctgtggcgcccctgctaaactacccactagaacttaaaagttttcttggatactgtaggctttattttatctggagttagtaagctgaactacatgacccaaggacccttatcagcttcctatgctgataataacagaagacctttgtaactcttgattaaaccttaatgttttatcagaaatcctatatattttactagactcttgagtaactccattttcccccattaaaaggtagtctcagcccaatcaatgtgattccctcgaaaagtgtaacttgaaatgacacaatcatcatttactgatcttatgtaacatatatgaca

SEQ ID NO: 159765 - DNA, 583 bp, Homo sapiens
tttattcatgatcataagttttaggttatgcctaatttatactcacatatatatgtttactgcccttttattatgcttgccttctaagaaataagtttttttgtttgttttgttttgttttatttttgagacggagttttgctcttgttgcccaggctggagtgcaatggtgcgatctcagctcactgcaacctccacctcccgggttcaagcgattctcctgcctcagcttcccgagtaactgggattacacgcatgtgccaccacactcagctaattttgtattttcagtagaaaagaagtgagactctgtctctggggtttctccatgttggtcaggctggtcttgaactcccgacctcaagtgatccacctgcctcaggctcccaaagtgttgggattacaggcgtgagccaccgcacctggcaaaaataagttttaaagtttgtataggcttttttaggtttacttattggaaataatgttttcattgtcccttcttttgatagtttaaagaagatggtgaatgaagtgcagcttttagctctgtgtcatagtcttatcaatagagtcaatagaaaga

SEQ ID NO: 159766 - DNA, 877 bp, Homo sapiens
taatccctcccacggaggctgaggaatgagaatcacttgaacctgggaggcagaggttgcagtgagctgagattgtgccactgcgctccagcttgggcgacagagtgagactgtctcaaaaactaagcaaccaaaaacagaaaaagatggaatggaattaatatgttccatttagtaaagatggaatagaattggtccagtttgtgttcattgtagcatattcacctatttggtcagcaaccatttttttttttttaaagcctaagcataccctgagaacaacaaccttttttgattagaacagaagaaaaagccagagtgttcttgggctgccaaaatattaatacgtttgtctcaaagacgagccacttaggtgcttgcttagagacttctactttacacagaatttgaaaagtttgacagctggctacttactctgcaaaacggaagggagactttttagaacagcaactggtgatctggcaaaaatgaaaagtagaacttgtgaagaaatgagatggacttggtgtattaatagctaattttagaagaccctgtggatattctaaatcagcataatagtgatgtctgagccatagtgttaaattatgattactgtatttgaagtataagaaggcagaaaagtgtgatgctgttagaaaaaaatctcatttcaaatgattgaaggttaaaaacaattggggaaagattagagagggcaggcggtgctttaagggaggtggaataatacttggctccttattctccaaaagcgctggatagctgaagtttttaatattctggataattgatatttgattattagtttaggagggatagcatcttcagtgaacccttgtagctctaaggtaggcat

SEQ ID NO: 159767 - DNA, 379 bp, Homo sapiens
aagaaatacacatctatgtaatatttatataatctttgcacagagttactaaggttgcagaccataataacttatttcctatttctagcacagaagctttaaaataatataaaaatatcttgtaatatgcttcttagtaaaatgtacttattcagtatttgtgtttcatactgataggatgtaaatttttattgtatctactcagattatatgtaaataaatgatgttttctcttggtaaaattacattccaagaagataaattaataatatatggcatatgacacatcatcctttcaaagcactttaagtgggaaaagtagatgaggacttgttctggaatttgaaggaatggatgaatacaggaaaacattggggaa

SEQ ID NO: 159768 - DNA, 315 bp, Homo sapiens
agtatgaagacagagccgacagctgacttcctgtcattatgttgcctgcctgtgatttcacaagtgtggggaagaccctgcctgtgatttcacaagtgtggggaagaccggagccagaggctgcattgtaaaagagccttgggcagcagcatgaagatgcctggaactgggttgggcctctgccctgggccgccgtccacactcagggctggtggtcttcgggccgccctgccaccacacctgtgctcacacatgggcacaggggctcatgaagcagaggggaagccgggcctgtcagcgtggagtctcacccag

SEQ ID NO: 159769 - DNA, 219 bp, Homo sapiens
aattggaaaaagaggttcgcaaaaaaatgttaataaagttgttgaaaaatagtaaaatcaattccatcctctaattgacaactattgtaaaattggaagtatgtttgatcttttcttaaaagttcctctaacagataaggttttaagacattcaaaatatgttcatttggaatttccccctctgagaaagattctggcccagatctcatgtcttaggga

SEQ ID NO: 159770 - DNA, 560 bp, Homo sapiens
ataaaagacacaaatattcattacatgcttaacgtgtacacaagttaattcatcacctcctactggctctgcaaacatacctctcaccattctccagtggcccaagtcggaatcctagaagtcatcttcacattttccagtggtttttactatgtctaatagggctctgggtcttctttaagatctctttagcaagcaaaagttaagatctccttaacttttgtattacctgtgtctcccagcctgcattcacaaccttccccaactgacaaggaccagattgagcacttctggctccgcaaatgtgctgtgcccttcccggacctcaggccttcacgccttctgcttatttcaaaatgcccttcagaatcccttcccctgcttacctcctacttgcccttcagaatccaactcagacataactcccgcaaagaaactgaacttaactcttgaggctgcatcaagtttgtgccttccctgcaatgatgccatagctcaggtgacttacattttctaagtttatctttatttatctgtctcccataaagactaagcttttt

SEQ ID NO: 159771 - DNA, 441 bp, Homo sapiens
agagctgcaatgtgctggttacactcccattgcctgctctgagctttgctgctggtccccagcccccaccaacaccccccaactctctttcttctcgttgccaaaacgcctcctttacgtcctgttttggagtcagaccttagcactggaaaaggtatctgagactagcctgggagaagagaaagtggactctgggatccgaaggtttagatttgacttctagctcaaatagctccttatggtgtgactctgaccctgagtttcctcatctgtgagatggtaatgagaattcctgcaccctcccagagagtgttatggaaccagtgaggtgctccttgtgaaggtagttaggcaattctaaatagtacttagaaataaggacttatggagtataacagcctcataatagtagcttccatttattgagcgctgaccatgtgc

SEQ ID NO: 159772 - DNA, 511 bp, Homo sapiens
cacaccacctgagtctgccattgctggaactacaggcacatgacaacacgcctggctatttttttttaatttttcagacagggtctccttacgttgcccaggctggtctcaaactcctgtactcaagtgatcctcccccttcagcctcccaaagtgatggcattacagatgtgagccacctctcaggttcaagtgattctctcacctctgcctcccaagtggctaggactacgggcacgtgccagcacgcttgcctcatttttgtatttttagtagagatggggtttcaccatgttaaccaggctggtctcaaactcctgacctcaagtaatctgcctgcctcggcctcccgaagtgctgggattacaggcatgagccactttacccggccccgactaattcttaaaatttttgtagaggtagtatctcgttattttgtctaggctgggctcgaactcctggcttcaagtgatcctctcactttggcttcccagcattctgggtttacagg

SEQ ID NO: 159773 - DNA, 286 bp, Homo sapiens
aagcagttatacagactcacaattacaaatgtccaggattccttggcaaaatgcctgattctcagactgggacaggagatatattagatgagcctgaacccttttgtggtgccagaaagtaaagaaaaaaaaatgcacagggatggggaatatgtcaatggaacacagggaccaagtaaaaaacttcccagtggctaaagctgggacagtttctgtagtatagcaatagtattagatcataaccaaagtataaaataaatacctatgagtctgtattaactgcttg

SEQ ID NO: 159774 - DNA, 330 bp, Homo sapiens
caggtagacctaacgatcgtcatgtgcagtatgaggtcttcacgtgaaagctttatttgggtaggaaaacctagcctacgagaaacgggtccgtgcggtcacgcctgactgcctgtctccgggtcaaggctgccaggaccagccccagccctccgcccgagaaggctgtcctttcccctcggaactctggcttccctaaagcggccgcgcctccttccaggcctcacctcctgggttaggtctacctggccaggtagacctaacaactgctcaataagtatctgataaactcagttttttccaatttaccaaagcttaaggaccttttct

SEQ ID NO: 159775 - DNA, 454 bp, Homo sapiens
  misc_feature (70)..(70): n is a, c, g, or t
  misc_feature (79)..(79): n is a, c, g, or t
caggtggatcacctgaggtcaggagtttgagaccagcctggccaatacggtgaaaccacgtctctactantaaaaatanaaaaattagccactgcccccggcctccagtgctttctttatgcggcttatttgagaagcggagggaaggactagttggtagtgaagcatgtcagtggcatggctgagctggggagcagagtttcagaaccatgctttgtttggcaccatgggtataccaggctcatgtgctttttttctgtacacgctttggcatgtgatgtgtgtggctctgccttgaggacattatgctgagtaagagaagtcaggctcaaaaagacacacttatgattgcacctatatgaggttcctagactctcaaattcttaaagacagaaggaagaaggggggttgccaggggttgggggcagagagatgagagtgagtatttaatggg

SEQ ID NO: 159776 - DNA, 459 bp, Homo sapiens
tggtataccatggcgccaaacaaagcatggttctgaaactctgctgtgcggaccaatctcaacctcccaaagtgctgggattacaggcgtgagccactgcccccggcctccagtgctttctttatgcggcttatttgagaagcggagggaaggactagttggtagtgaagcatgtcagtggcatggctgagctggggagcagagtttcagaaccatgctttgtttggcaccatgggtataccaggctcatgtgctttttttctgtacacgctttggcatgtgatgtgtgtggctctgccttgaggacattatgctgagtaagagaagtcaggctcaaaaagacacacttatgattgcacctatatgaggttcctagactctcaaattcttaaagacagaaggaagaaggggggttgccaggggttgggggcagagagatgagagtgagtatttaatggg

SEQ ID NO: 159777 - DNA, 512 bp, Homo sapiens
ctgcctcagccttccaagttgggattagaggcatgtgccatcacgcctggctaattttgtatttttagtagcgatggggtttctccgtgttggtcaggctggtctcaaactcctgacctcaggtgatccacccacctcggcctcctgaagtgctgggattataggcgtgagccactgcgcctcttctgtaagagcctggctgcctcctgcctcccagctctggctaggtcagcccagcttggcattttcccagaggaaatagaggcctgcttagcctgagacttagacaaggaacccaggcatcctgagccccagcccaagaacagccatgccagcctcatcttcgcaccctgttccagtagccaaggaagggaaagaagctgggagattaagggtagggggattctggagcctcccagagcttcccaggagggagttggacacatcgggaaactcatgttagcctccccctcctcagcaggtgttccccaggtctaacctgagtgtgtatc

SEQ ID NO: 159778 - DNA, 361 bp, Homo sapiens
ttcacgtgtgcctgtgtctagcctctctctctgtgtctccaactccttttcttctaaggatgccggtgagattggttgcgggcccatcttaacaacctcagtttaacttactcacctctttgaaggctgtatctccatctccaaatacagtcacattctgaggtactggaggccaggacctcagcatatgaatttgaagggacacaattcagcccccaacaccccatcattactcttttctgccaggaagcccgcttctctttacctgtggtgccatctttcctcctctgctcatggcctgatagctttcttagccgccctccaccccttccccatttcctctccttgcccgtcctcactc

SEQ ID NO: 159779 - DNA, 405 bp, Homo sapiens
tatcagatcaatcctaacacatttgtcctataattttcagggaagtctatgatttggagaaacatgttgcccttaggctaagactaactacattaccttaaacgcaaaccccttctgtcaagtgctattacaagttattgtgaacaggctgtgttcaaaaagttcattagtttccatttggaatactgaatgcattttccccaaaaaccaatgataaaaaaaaaaaaggcagttatatgcccaaaccagcccaggaaaacaaaaccaaaaaaccacagaaatccccaccttggacccagagcaagcacagctcagctatattgcattgatggtatcataaagctgagttacctgcaaagcttaacctgctttctattgaaattacatttccaattcatactgggg

SEQ ID NO: 159780 - DNA, 468 bp, Homo sapiens
ctgcagctatcattttaaactttctaaggaattatttcctgacttcattatgcggcagtagagacgcagcttcaccatgttgaccaggccagccttggactcctgacctcacgtgatctggccaccttggcctcccaaagtgctgggattacagatatgcttaaggtgggaagagaagctggaaacctagaattatttcaactcaatcaccagccattcactgactttttaccatgtataaatcctgatcaacctcaaaaagagtaatattaagtttgattcttacactttttaaaaaaaatatatccaagatacaactatcaaaagatggcccagaatcaactgccagattaactatatggcccatagataatgatagaggagggaacttaaaaaactactttcttgtgcaaaaattatacctgtcacaaaataaagataaagtggagcactagaatttatgaggca

SEQ ID NO: 159781 - DNA, 442 bp, Homo sapiens
ggggtacacaaagatgacttagtgcggtccctagaagaggaagacccgagtaagtcacaatggtgatagagaggagggaacaaaaccctgaatcatttttgaggtgaatgggccagatttgacaatcaattgtcaggaacattgtgctgatggtgactgtaaattccttgctcaggaagctgtcttgactgtgcatggtggctcatgcttgtaaacccaatgctttgggaggctgagataagtagactgcttgagcccaggagttcaagacgagcctgggcaacatagtgagatcctgtccctacaaaaaataataaattagctgggcatggtggtggcacatgctactcaggaggctgaagtgggaggatcccttgagcccagatgttccaggctgcagtgagctatgatcatgccactgtactccagcctggacaacaga

SEQ ID NO: 159782 - DNA, 205 bp, Homo sapiens
attttattcttccctgacaccttccccctcactgccacccccaaatctcagacctcactggatatggtgacctgacaactgccctttacatggggatttgtatggtaaattgccactaagaggcccctgatccacaccttcctcaccaatttatgctgtcgtggctttcagacagaaactggggaattcacatgtggcaggcttg

SEQ ID NO: 159783 - DNA, 411 bp, Homo sapiens
ggaaaaatgagatagagtcaagaaaacaaaactaaacccctacatttatggtcagttgactttggacaaggatgctaagccagttcaatgggggaaagaaaaatcttttcaacaagtgacgctgggacaactggatatctgcttgcagaagcatgaatttggatctctgcctcatgccacatataaaacttaactccagatggatcagagacctaaatgtaagagctaaatctgtaaagcttttttaattaaaaaaacgtttaaaaaaattagtcataataagtgatgtaaaactcttaaaacatagcataagtctttgtcaccttggattaggcagtgttttcctagatatgacacccaaacaatcaacaaaagaaaaaagtgggtaaattgaacttcataaaaattaag

SEQ ID NO: 159784 - DNA, 392 bp, Homo sapiens
gacagaagcctttcagactctgacatgccatatctcagcagtctatgtcgctgctggacactgctattttattcactcaacaaatctccctcaggcaccaaatatgagtgcccagctctgcactaaacactttatgtaacaatgcaaagaagactgttagaaaatctagaaaggcaacaaatatatcatagcataaatatttgattacaattgtgataaatcttacaaaagggaaacacagaggttaatgagcacagatactcagggtatttttgccttagtacactgaagcaatcaacctagcctacggggtcagagaaggtactatttaagtgtacgcttgaagagttagaacttgaccataaaagcagcaagtaagagagagaaaaaaa

SEQ ID NO: 159785 - DNA, 502 bp, Homo sapiens
ccctgcctcagcctcccaaatagctgggattacaggcatgtgccaccacgcctggctaatttttgtatttttaatagagatggggtttcactggttggccaggctggcctcggggagcagagcctttctgtggagatcaggccagcctcctggcctccagcctccctgcctccagccttcctgtgctttgctatctggggtttgaggatgtggggaggggtctttcctctgagagatgaggccagtcctgtggatcacagtgaggcatgccaatcccagctggctgtgcctggccttcagctccaggagcctgagaatgataaggtctggagagctgcccttcctggaaacacagcatgtctccttcccccattctggggtcctgcatgtggcaggtgtgctagactctgcagggcatggctgggtggagctgtgtgattctggggttctgcgtgtggcaggtatgctggactctgcggggcgtggctgggtggagctgtgt

SEQ ID NO: 159786 - DNA, 344 bp, Homo sapiens
cattcaaaaaacaattaatgtaatccatcacaccaacaggctaaagaagaaaaatcaaatcttatgaatagatggaagaaaaggattcgacaaaatccaacacccattttttgatgttaaaaaaaaatagtcagcaaactagcaatagaagacacatcctcaacttgttaaagaacctctgcaaagaaacctgcagctgacatcatacttaatggtgagaaactagatgttttcccactgagagcaggagcaagacaaggaaggatgcccttttcaccactcacagattgtgagggatgaaataaagttgtccttatttgcagataacgtgattgtgtatgtag

SEQ ID NO: 159787 - DNA, 724 bp, Homo sapiens
tgatgcctccaactttgtctttctttcccagaattttttgactattcagggtctttctagctggcaatcatgttcaacatatgtaaatcaatcaatgtgatacatcacaataacagaatgaaaaataaaaaccacatagtcatctctattgatacagaaaatgtatctgacagggtccaacatactttattagtaaaaactctcaacagtttaggtacagaagaaaagttgctcaacataatgaaggccattcatgaaaaacccagagctaacataataatccatgggaaaaacctgaaatcttttccactaagatctggtacaaggatctgtttttcttctcaattgctgtgggagtcttttgtggttccaaatgaattttagaattgtttttaccatgtctctgaaaaattacattggaattttggtaaggattatgtcaaactgtatattgctttgagtagtacagacactctaacagtattaattgttccaacttggtaccctttgacttacctcctatttgctccttaccccgagaaaccccctggtaaccattttattctctgtctgtatgtactcaactttttttttttttttttttacattccacatgtaagcgagatcatgctgtatttttctttctgtgtgtggtttatttcacttagcataatgtcctccaggtttattcatgtgtggctaatggcaagatcttttttaaggc

SEQ ID NO: 159788 - DNA, 530 bp, Homo sapiens
tgtgtgttctggtagataaggcaaggtcataaaggtgaagggctgacagagattaggagagcctgcaattaaatggtacgaaaagagtcctaaataatcactgttcagagcttccaagtacttgactaaccaaagagacccagaaaactttgtatttcatctgaaaattgctttaaacagtgaaaaatgcaatctttgtgtaagtatctttgtatctttgtataagtgcaaagcactgcacatatatttgcaattgttgccttcaataacacttttgtgatgatatccagatgaaaaataatttaaacatgatacaataaaatataaataaataaaattaaatgtaagtcacaaacccatctgcatttcctcaatgacctgtttcctgagaagcaatgtgctatgaaatactgagagtggcctctggagtcagctgggcctgggtacacatcctgtcttaccacaccttgaaatcactgtgatttccatgaactgactgacaaaaaccacgaggatgtaaggagggtcag

SEQ ID NO: 159789 - DNA, 224 bp, Homo sapiens
tttattgtttaaggaagggaaattttagaaaattaaaataattataggctccctcacctccagcacaaattctgtttgctggaacaagtattattgtgatattagtgaactagcacttctcaaggaactggaatatgtggtgcctgagagaaggtattatatccacacctgtgtctttgttttgggtaatgggaagtgttggctgcagcatttactgagccagt

SEQ ID NO: 159790 - DNA, 424 bp, Homo sapiens
cagggcttctttctgttccaggagcagctcaaaatccataaattaaggaaattaactgatggggcctgcggcatctttgtaagctatttaaatctataaatttacaacatcttctgcatatatcaaataattgaactaactgcagggatgtaactttaatgagaaaatttccccctttttcctgtagttcgaactcgaaaataaataaataaataaaaccttcccttaggaggaaagtttcggctgattcccgcgtaaagaagttacggaagcgctgtctggacgctctctccacgcgcgcgaggtcctctagtagagggagaaagccccccccacttcaccttcctcccactggcaccccgagtccccctcaccccagctccaggccgaccccgagcgccccccaccccgggagtgcggccgc

SEQ ID NO: 159791 - DNA, 557 bp, Homo sapiens
ctgggaaatggtcttatgttgttattgttatcatcattttagtaactttttttccttccattgtctctggtctcttttccaatgatgacctttcacgccctgcattgagcccttaatttcatgttttattcttcctattttttaattttttttttttttttgcttttggagattttgactacatcttcagatcctcctattgagttttttctgcttttttatttttccagacaagggccctctagtctcttcctggggggccataagcctgatatgttcctgaactaaacatatttctaattaactgtgtcaggagaattttgctggcgcggggggtctatatttggaatttccctgaatccctttattcggttcggcgtctcattcttgccgtcctctgtgcctctctgttccggagcctccctgggtctgtttctttagataagaaaactcaactcttctgttgaaggtggcgggggagccacctgactgctcaagtttggagcaggacctggggtggaggacctgggggtctgatggcttctttctgccgccct

SEQ ID NO: 159792 - DNA, 441 bp, Homo sapiens
cccgggacccacaggtgtgtccggagctggccccagacacaaagcgccaagaattggcggggacatctcagccggcggggacacaccccggagtccgaggtccccgtcaccagggtgcagctgcccaggtagggggctcggccgccatgggccgcatccttcccctgggggccgcggggcccatagtcacgggcaccccctccctggcctcccgcacaggactgggcggctgcaggcgagaactgggcacccagccccgttcccgccccgtcccggccccgtacctggctttcaccgtcgcgggcacgacccccggcccaggagggctccgagtcccggaggggcagccccgggcccggcctggaggctgctaggcgtccggagacaccgggtcctgtccccatggcggccggaggaagccgcggtctgcgccgcccgccg

SEQ ID NO: 159793 - DNA, 108 bp, Homo sapiens
ttcctcctcctccccactccccccgggagtctccagaagccctgccattgccctgaccccagttaacactcctggtaattgctggggctgctgcagaaagcctaggga

SEQ ID NO: 159794 - DNA, 1024 bp, Homo sapiens
cctgcggctgtgcgcccacctcgactgcacacccgacatctgggcgctgcacaactggagcgcctggctcacccctttcttgcggggcaccactcgccgctttgacacggccttcttcctgtgctgcctgcgcgagccgccgcccgtctaccccgacttggcggaggtggtgggctaccagtggtcatctccatcagaggcaactgaaagtttcttatcaaaagaaatttggttgccacccccacagttctacgaagtgagaagacttgcaaactttgcctctctctctgacttgcacaaattttgtttgggtcgtgcattagaaggactggaaaggtggctgccgatcatcttgttaactgctgatgggatggtccatcttttaccaggtgatgagctatatttagaagattcagactttttggaaaatcttatgtctactgaaaaaaagactgaggaaatcatgaaggaaggcaagcagtttcaccggatagtgacataccatcgccacctttatgatatccacgtgactgttcagccaaagtataaacacgtttatcctaagaactctgtagtaagaaaaagccatttgtagggtgcttaagcttgtttgtaaaatggcctacttgaagtcctcatgaataatgagggttgactttcatttgcttgaaacttaaggaagtttgtgcctataaaagttactgcaattcagtatttctttatttttttcgagacagagtctcaatctgtcgcccaggctggagtgcagtggcatgatataggctcactggaagctctgcctcaggggttcatgccattctcctgcctcagcctcccgagtagctgggactacaggcgcccgccaccatgcccagctaatttttttttgtatttttagtagagacgggttttcaccgtgttagccaggatggtctcaatctcttgacctcgtgatacgcccgccttggcctcccaaagtgctgggattacaggtgtgggccaccacacccagcctttttttttt

SEQ ID NO: 159795 - DNA, 215 bp, Homo sapiens
acatgttcgtagaccgaatataaagaatcattctcacttggaagattgcgtaacaggcaggacacttgggcaggaaagaagtacgttcttattttcatttatacctctgttcaaatttccagaatatttttcctttctgattgatgtggatttggcagtgcctaccagcacttgagctaaaaatgtcggatttccttctcccttaggcactgaat

SEQ ID NO: 159796 - DNA, 551 bp, Homo sapiens
aacctgtcgcaggcaactatgcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaa

SEQ ID NO: 159797 - DNA, 245 bp, Homo sapiens
actgtggggtaagctgacagcaaacccccacccatctcaacacaggcaaagcttgaggagcatcgcatataggcattgtacacacacactctctctctctctctcactttctcacttttcaatccccagcagatttccatacccacaaagacatctgtacagatatcaggagtgaggaccgagcctgagaccttccctggagcaagctttgatgacagcaaagttggagtagattggggcagcca

SEQ ID NO: 159798 - DNA, 408 bp, Homo sapiens
caaaaaaaaaaaagaaaagaaaaaaaagtatttctataaaaccacctgcattttctgttttgagaggtggcaagaggagttaaattgagtttttccaaggaggagacaaattggtcaacctatggcagaaagatttggaaatgttaaaaaatatattaccatgttgaacagaaagctacagatgatattcaaaggaacactgatatagaccatgtcatggaatcttatacttaattgctcatactgactttgccctcatgggtagttacttatgtttattgtgagaatagtgaggtacaagtatgtaaatggctttttagtgaggttgagatagaagagactattatcagctcttcttgggcttctaaattggtcaagctgacttaagtgtgtgtgtgtgtgtgtgtg

SEQ ID NO: 159799 - DNA, 368 bp, Homo sapiens
ctcacattccaaatagatcgagctatcacattaatatttttgtcaggaggcatttttcattcaatcataattcatgcacataaataatcacatgctctagtactatattcgaggaaatttttcctttttagtcaaaataagaatgaaatgcattaattcaagtcattccagcaggctatatgtggaagaccacgtcactgacttgaaagcaaaacttgaatcacaaaccctttaaatcaaaatataaaataagataaaatactcaagttcccttttggatttggaagcaaaaacagctgctgcaacaatgagtggctttccttctgagttcatcaagaggggagccagacgtggatctgatggccctt

SEQ ID NO: 159800 - DNA, 230 bp, Homo sapiens
tctggtgttgatgttagggtaatgtgggcctatcttgttaggaagaatgaaatgctctgcaaaaatggttccttttcccctccccaagctggaagcaggaggaggctcttctccaatattccttgtgagaacctagtgaagctccaggaagtaaaactcataatgtgtagacccctgatgattgagtcctcttggagtaaaactaatgtcatgaatgggccccctaatga

SEQ ID NO: 159801 - DNA, 228 bp, Homo sapiens
tgcatgggctggagtaagggtaatgaaagcagcaaatgctccttcactgtcttgcaagacccaacagtctgaatgtggtggtctggagttcctcttctctcccacctgcccgtaaaccttagcagaatctgatgcttgagcataatgtctaaaaagtattatggctagtatcatgtggctacatgttaactcagttaaatactgaattgggtggcgggattgacaagg

SEQ ID NO: 159802 - DNA, 211 bp, Homo sapiens
gacttgagaactccatacaacttggtgagctatgaggacatgcttgttaatccttggattctcctaatctgccatcaaaggcaggctctggggcagcctggtgctcgccctgtgaaaaactgttcaagtaagcagagacagaacaagaaatgctaggtaaatgtatgacaccttagcaaactagatgtcctcacacaaacaaaaaagcagg

SEQ ID NO: 159803 - DNA, 118 bp, Homo sapiens
ctcaaaatgcaagtttaattcataatttataccacaaggaagggaaggagagtaatagggatgagcgcactaagcaaacaattaaaaaataagctaagagtgtcttaaggcaaatcct

SEQ ID NO: 159804 - DNA, 394 bp, Homo sapiens
agcagtcctccctcctcggcctctcaaagtgctgggagccactcacaggtgtgagccaccacgcccagcagagcttcgtttcccaatctagaagtctgtcatacaaaaaggcatcccggttttctctctctctctctctctcacacacagacacacacacacacacacacacagagtcacctccccccacctttttttcctttttatccttctttggcattttctttcaagcagaaaataaaaacatttcccatggctacagctttgaaagcttccctctcctatcagcctccatcccacgcccaccccaatgtcaatccatttctagagccagcgtcaagtcaaaaacaaacccacaaagatcaagcctgacaggccccctcccggctgccct

SEQ ID NO: 159805 - DNA, 108 bp, Homo sapiens
tctcaccatcaacacaaactcaaaagattataaagttattacctttccacaaatcaacccattcctaattcctattcaattaccttcacccccgcctctgcaggcccc

SEQ ID NO: 159806 - DNA, 345 bp, Homo sapiens
ctgggctatgactatgggaaacagaaatatgactatgggaaataagggctatggctatgggatatagtgactgggaaatagacttcatagtctatttccctcacagtgcacagcttccgacagctctgcccccatgttttcctccttcttttaatcctttagcctgcctacctaggagttgcccctgcatcagtataagccccttattggccaaacgctgtgtttaagcctccttgactagtagatttttaccctttaccactgcatgtctgtgtggcttggaggctgctatcacaccactcagaaagtttatgtttttgtcctatgctcattcggagactagca

SEQ ID NO: 159807 - DNA, 125 bp, Homo sapiens
ctctaagctcaatgctttgttgtgagaaagaaaaatggaattctaagttccccaatcaatgggacatccatcccagagcaaacttggaagaggagttcttggccataatggtacgggaggtcagt

SEQ ID NO: 159808 - DNA, 530 bp, Homo sapiens
ggggagacaatgaaaagagagagagagaccgagccaacaaatcaccccaaaagcacaacccccacacttcttagttatgtgaacaaccaaaacatccattgttttaagctggatacagttggtttctctgtaacctccaactaaaagtgaccaataggaattgggcccacagacagaggcccagggacatgtgcaaagtcatacagacacttggcactggggcaggacaggggcccagtgatggtcctgggccaagacctgattttgaactgtggctccatccttcaaagctatgagaccttaaggatattccttcatgcctctaagcctcaaatgctggagatcataacatcccagggctctgaggattaagggaagtaaaaactctggaagcacgttctcgagcctgccgcagggctgcctctctttctggacattgccccactgacaggcagcaggggctggttggaaactgatatggtttggctgtgtccccacccaaatctcatcttgaatggtagctctcacaa

SEQ ID NO: 159809 - DNA, 342 bp, Homo sapiens
ttttattttatgatgatagaccatcacttatgtaaccaatgtcctactattaaacattggaattgttcctaaataaaactacgctacatggccttttatataaatatttgaccaaatattttattatttcttcaggatatattcccaaataagctcaatggggcctggcacagtggctcatgcctatattcccagcactctgggaggcagaggcaagaggatagcgtgagcccacgagtttgggaccaacctaggcaacatagtgagaccctgtctctacaaaaataaaataaaagagtagccaggcatggtggtatgcgcttgtagtcctagcaactcggg

SEQ ID NO: 159810 - DNA, 135 bp, Homo sapiens
ggtcaacttatttaggacttcatttattgattcaacaaatatttactgagcacccactatgatctaggcactgtcctagataaagagaaacagcagtgaacaaaacaaagtctctgattctcacagagcttacgg

SEQ ID NO: 159811 - DNA, 459 bp, Homo sapiens
tggaggagggatgtctggcctcacaacaggggccagtctttcgtgtccaggaacaggatcgatgacccttgtaggacactgggggcgctgttacctcctcaccgagcgcaggtcgctgccctgtggtctaacagagcatgtattcagacccgcaccctcatctttggcggatgctgaagatgcaagaaaagccacctgcttgatgcttgcttggcctggagatcgttctcctcttggtctgtgtcccgtggcggcaggccttgcagggaggggggcgcaacagtggggagcatccgaatggagtcccactttccaaccttggggctgctgcatcggcctcccacatgtgacctcccaggccctgatgctgcttcttttgaagggggtgaggcctgatgggcaggtcaagtcggtccttcagggaggggtctaccctcccttgcccgggggtggtgcccg

SEQ ID NO: 159812 - DNA, 401 bp, Homo sapiens
aattttaattacttacaagttgtagacccctttcatggatgtaaaactttgaataataccatcttctttattagctagtagccaacgacttttcttatgtccttttttccatattgtcaagaaaaagtaacgtgaatattgtttcacttcctgctctactttaatagaacagaagaacagaaaaattttttaaaaagtttggccaaaggatgggtgcttgggagaaaaataaacttagaccacatgatgtgcaagaagtatattataaatccttaagtactgattgatttggccagagttaagcctctaggactcactagggtaggtctcagggctgagtctctgcagtaattctacgtagctggtttcagcagctcagtcaagaaatattcagggatgga

SEQ ID NO: 159813 - DNA, 381 bp, Homo sapiens
catcaaccctaaatttaatatgtcacaaaatttgaaaaatatttttgataaggatttcaaaggacatgacttcccttattatcccatgtgttttactttctgcattagaaactttattctgagaagggctcaccaagttgctgagggatccattacactaaaaaggcaaagaacctctgctctaagaatcacagcagggccggaatagtgtttggagaatttcagacatgtggggtgagcattacttaatctggaaagccccagaagtcacatgtccccgcagataggcagccttcagagcagacctgactggcagctagaggtctgcttcaatggcttcttcattctcccttcataataaattcacgtcgatcagggtcc

SEQ ID NO: 159814 - DNA, 426 bp, Homo sapiens
aagccattctggggctaggatatattttgtaacatcttcgaggtgggctccctcacaagcatgtttctatacaattagtggtttgaggcagcctatttactgtttcatgccttcttgcctcttgttctcttctctagtcaggtttaaggctattttaataaaatttggcacagattaggcattgcttcagttaacttctgagagtagataaaataccatcattttcttttttttttctttttttgagatggggtctcgctctgtcacccaggctggagtgcagtggcacgatctctgctcattgcaagctccgcctcctgggttcacgccattctcctgccttagcctcctgagtagctgccactacaggcgcccgccaccacaccccggctaatttaagtgatcaccgacgaatttaagtgatca

SEQ ID NO: 159815 - DNA, 199 bp, Homo sapiens
ttgggtcctggtattacaataatgaacaagacaggtgaggtccctgccctcatggaatttacattctagcaaacataaagtcatcatggttgtgttggatccccccaactttttttttttttttttttggagacaagagttttgctctgtcgcccaggctggagtgcagtggtgtgatctcggctcactgcaatctccg

SEQ ID NO: 159816 - DNA, 141 bp, Homo sapiens
taatgcaaactgagcacttgctgtgtatttagtgcagtcttaggcgatgggaatacacactgatttgaacagaagagggtttggccagtaatgggacaagcaatgtagctgcaataagtataatataattcaaagcaaaag

SEQ ID NO: 159817 - DNA, 214 bp, Homo sapiens
tctagtgttgtcttatagaataggagcctaccatgataaagcacaatgtttaccaaacttcagttatcagtacaacagaagactttcattatttttgccatagccacatgctttgaaattattcactaaatattttatttaaaactgctcacttaaaaaaatgcttccttaaaaatcccaggctattgtagtggttcccaatgtgggaactttt

SEQ ID NO: 159818 - DNA, 376 bp, Homo sapiens
acagaagaaatttgattgttgtgagcgataataaaattaacgtggaactcttcctccatcttcctctcttctactagtggactaagggtagctttctagcctatacagctcaaacagcttccactgttccaacaacacaaaacaaaatatggtacccatatatagctatgtctgtagctctcagaagttattctaccttcagaatccagaattgtttattacccttgctttccaacgtgatgttactcactttcagaagctgcgtgttcctttcattttctgagatctgctagctctgagcagatcatcactccactggccccttgtttctgatcttctctattcttgtttcctactgattctgcagttttttttt

SEQ ID NO: 159819 - DNA, 126 bp, Homo sapiens
aggggagagagacagagagagagagagagagagagagagagagagaaagaaagaaagaaagaaagaaagaaagaaagaaagaaagaaaacgcaaggcaaaaccaaaaagcaaaaaaggaggaagca

SEQ ID NO: 159820 - DNA, 371 bp, Homo sapiens
aagcaaagggtacctccatgaggaagtccacacgtccatggtcagagccttcaggtggtcccggggtagtatttttgggcagtggtggcaaggaggggcccagagcaatggggcagcccgaaggggtcttcctgagagatggcctcttcctccgaggtctccttcagtggccacttgactgggttccagcgggtatggtctgtgcacagggactaccccctgagcttacttagcccaagtcacctcctatcaccccaaactttcaagaaactcaatctccagctcagaaataatccagcgcagtgctcagtggcggtggctcctttggttacttggaagggcacaaaaccactcctggatgggaagggggt

SEQ ID NO: 159821 - DNA, 209 bp, Homo sapiens
atgagccaccgtgcccggccgaaagtatgaatcttaaatgttaataattgttttagcacttttcaataatggaaccaagcaattgccatcaggaaagccaattcctagtctgatagaaatccaccacaaagctgatcttgcagagtggctagtgtgaagcacactggactccaggattcagatgtgggttaggagaccctcctctctca

SEQ ID NO: 159822 - DNA, 741 bp, Homo sapiens
ggcaggggcccatgtgtgcaggatagctgggctgtgtcccagtcggaggaggaggagcaggaggaggccagggctgagtcccagtcggaggagcagcaggaggccagggctgagagcccactgccccaggtcagtgcaaggcctgtgcctgaggtcggcagggctcccaccaggagctctccagagcccaccccatgggaggacatcgggcaggtctccctggtgcagatccgggacctgtcaggtgatgcggaggcggccgacacaatatccctggacatttccgaggtggaccccgcctacctcaacctctcagacctgtacgatatcaagtacctcccattcgagtttatgatcttcaggaaagtccccaagtccgctcagccagagccgccctcccccatggctgaggaggagctggccgagttcccggagcccacgtggccctggccaggtgaactgggcccccacgcaggcctggagatcacagaggagtcagaggatgtggacgcgctgctggcagaggctgccgtgggcaggaagcgcaagtggtcctcgccgtcacgcagcctcttccacttccctgggaggcacctgccgctggacgagcctgcagagctggggctgcgtgagagagtgaaggcctccgtggagcacatctcccggatcctgaagggcaggccggaaggtgaacccccaccccaccccaagcatcctgcatgtccaggggcccccattctg

SEQ ID NO: 159823 - DNA, 636 bp, Homo sapiens
tgagatggggtctcactctgttgcccaagctggagtgcagtggcacgatctcagctcactgcaacctctacctcgcaggttcaagtgattctcctgactcagcctcccgagtagctgagactgtctaagaaaaaaaaagcaatctgattcacaccactgtactctggaaaggccaggaactggaagcacaatgcatctctgaagggaggattgagtcatgtggccagaaacagaagagttggctgacaatctatagaaagagcagttaagtccttagttctcctccctacctgcccaagcaaccaggcaactacccatcctccaccctagataaaggctgcctgtcaactcaccagtccagagaaacaatcagaaaggctctggactcttcatccatgtccctacaaaggacataaaccatcattctgagcgaactatcgcaaggacagaaaaaccaaacactgcatgttctcactcataggtgggaactgaacaatgagaatacttggacacagggtggggaacatcacacaccagggcccgtcgtgtgtgggggaatggtggagggatagcattaggagatatacctaatgtaaatgacaagttgatgggtgcagcacaccaacatggcacatg

SEQ ID NO: 159824 - DNA, 347 bp, Homo sapiens
tgctgggattacaggcatgagccaccatgcccagccactggttccacaattttttaaatgaaaataaaacacaaatcagtacacgaatgaaagattaatacccctgagatagatctatgccactaaatttagacatgcatgtgaatatatacttatgatatacatgaatatgcatttaaataaatttgcaaagagtacaaataacaaaagaacaattatttaaataatcttctaacactcaatatatctatctaatttacaatgaccattcccttctcctgtcttcctctatctttctaaggataaaatatccagggggttttgtttgtttcatattagtataagat

SEQ ID NO: 159825 - DNA, 373 bp, Homo sapiens
  misc_feature (275)..(275): n is a, c, g, or t
  misc_feature (320)..(320): n is a, c, g, or t
  misc_feature (332)..(332): n is a, c, g, or t
ctcagaacagcttatcctttccccgttgaagtgtaatgttcctctgtcatatagtatgattctaaatagacatattttttatgtacacattatcatttgtctctttctatgctaataccaactgttttgattactgtaacattatcacaagtcttttttttttaagagatggggcctggccagcatggtgaaaccctgtctttactaaaaaatacaaaaattagctggtgtggcatggtggtgtgtgcctgtagtcccagctactcgggaggctnaggcaggagaatcgctttaacctgggaggtggaggctgtggtganccgagatctcancactgcgctccagcctgggcaacagagtgagactccatctc

SEQ ID NO: 159826 - DNA, 289 bp, Homo sapiens
ccacagaacttatatgacttcacactgtgtagcctagttttggcaattttcattaaaatgttatcttattgtacctgtaagactgtcatttcaattttattctttgttctttcttgcatgactcacatctcttaaaccagaaggatatgacagaaggaattcacaaaaggtttggacaaatttatgaatgacatagtcataaatgtctgggtataagaagtgagcagcatgcaaagaagaaggagataacttgcatttttttttcttttttttgagacggagtgtcaca

SEQ ID NO: 159827 - DNA, 190 bp, Homo sapiens
aaggcaagtgttcagtcctctctgcaggagagatggggtctgagagtcaaggcgagtgttcagtcctctctgcaggtgagatggggtctgagagtcaaggcaagtgttcagtcctctctgcaggtgagatggggtctgggagtcaaggcgagtgttcagtcctctctgcaggacagatggggtctgagag

SEQ ID NO: 159828 - DNA, 436 bp, Homo sapiens
tgtacaagtcactgctctgccagatttgtaaccaaggtgtacgaaactttgcaagtgaaaatgctaattataataagtagctcattaatacagttttcattaaatatcaataccagatgtagaatgtgaacaattatgcttttattgtttcaaataattttgaggtactactaaaaaaaaactgccaagggctaaactagatggtctctgagatccctacgtcaaaagcctaggaactgtaaagaatcagggttatggccaggcgtggtggcccacacctataatcccagcactttgggaggctgaggtgggcagatcacctaaagtcaggagctcgagaccagcctggccaacacggtgaaaccctgtctctactgaaaaaaaaaatacaaaaaaaattagctgggtgtggtggcacatgccagctacttgcgca

SEQ ID NO: 159829 - DNA, 486 bp, Homo sapiens
cgcggtggctcacacccgtaatcccagcactttgggaggctgaggcgggcagatcacaaggtcaggagttcgagaccagcctggccaacatagtgaaaccctgtctctactaaaaatacaaaattagccaggtgtggtggcgggcgcctgtagtcccagctacttgggaggctgaggcaggagaatcacttgaacctgggagacggaggttgcagtgagccaagatcatgcccttgcactccagcctgggcgacaagagcaagactctgtctcaaaaaaaaaaggaaaaaacacacagtaataataatagctaacacttgttatcatcatttctgtctgtttcaaggtaatagtcgatataaagtgaagcacaggtccaccagattccagaagctgtgcttttatctatgatgttctaccagctcccatccttttttttttctgtcaggttgacttctttcttgagaatagagacatttattatta

SEQ ID NO: 159830 - DNA, 545 bp, Homo sapiens
caacgatggtcctcagctctcagcagtcctccctcctcaacttctcaaagcactgggattatatggtgtgaaccatccatgcctgtaccagcaaaagtattctgagaaaaccttcgaggggaatgccagcccatttttatttaaaatttcccaatttctccccaacgatggtcctcagctcagccacggtgcctggccccagatgtctctcttaatgagtggctgagctgtatgttttttttactctcagagacatggctttcccttatccagaggcagtgtcactggtagggaggatctcgattatttagtctttgtaactgccctgctgttttagataggtagggcagggctgggcacagtgactcacacctgtaatcccagcactttgggaaactgaggtgggcagatcgcgtgagcccaggaagttggagatcagcctgggtgacatggtgaaactctgtctctactaaaaccacaaaaattagctgggcatagtgtcatgcacctgtagtcccagctacttggaaagctgaggcaggagg

SEQ ID NO: 159831 - DNA, 506 bp, Homo sapiens
tcaatttttttggtagacagtcatgagaagaaatggctaattcctccactttgaacatttacagtacaacatcccagttagttttaatgatttgggtattgaagatagttgtctggtttaagactggtatttaatctaagtatcacttgaaaacacaagctctaatgttctttattttggaaatttgtgattttgtaaaatattaatcaacatattgtttctattaggaactctataatcagaagggtttactacccagaggtagacaacctctttccaagtctattttataaatgtgtgttgatttttactttataaaaccaaaactgaattagattatttcagaatcacctgtagtcaggctgaagaaaattaaagcttttttcttttttgttctgcctaatgtgtatttctttgcgcacaattttttgttggtaagagtttgttaaatacatagagacagtgggattaaaaataaagcagtctctattctctttaaaatgtgt

SEQ ID NO: 159832 - DNA, 632 bp, Homo sapiens
ttatgcattttccacaggcttcagcttgactgatcctgggatggcacctgaaggaggggctttgcctgtgccgcctttaccctccaattgttctgtacttagtgactctacacatcagtcagggacttgctcagcttcaggtgcaatgatcccacccacttacgttgtactattcccagtcacctccatctgtcgctgcccatttctctatgtgcaattgatataagaggtgaaagccccaaggccagttctcagaatgctctgacccactctcttcccctggctgtacagtccactgtgtccactgcattagagtacatttactactcccaggataaactgctgcatcctggtccttcccctgctttttctaggtttctggaggtagtaattctatattcataggaaagcagacagctttgaatttctgcttttgcatttggaagtggtcatttcctctcctccatctgggccttccactatttaaagactcatgctgacagtggtgagaaaaatgttgagtaattccatgagtcaagaagtggtcactagcaccattgatattctctggcaagggccatgtccgtgttcaaaagtttgagtggtacagtcgtcctgcaagtatggttcct

SEQ ID NO: 159833 - DNA, 381 bp, Homo sapiens
ggtatctatagggatatcattctgaaaattaaactattctacataggaccatagatacaggctgactagatgactgggctggatgtgttccacagtgtatcagtcagggttctccagagaaacagaaccaagagggtatatagacacatacatgcacacacaccaggagagccagtgatgtaagccctgagactcaagacccaggaagagctgatgtttcagccagagtctgaaggctggaaaagaccaatcttccagctcaaacaggcaggagttccccttactcagcatttttgttctgctttggttttcagttgattggatgagacccactcagcagtagggagggccctcgcctcactcagtacaacctgccggtgg

SEQ ID NO: 159834 - DNA, 158 bp, Homo sapiens
ttcatctataagatgaaagtaatacaatgcaccatgtagcaaactcacaggagaccctagagatcaaataacactgtgaaagccaccaaatgaatattttaaaattttatctcatttctgccaaggtgagatatcaatctaaaaacaggataaatctt

SEQ ID NO: 159835 - DNA, 269 bp, Homo sapiens
gcagcatgactaatatgtgttgataattgcatattgttgataactgtaaactctgagattgcactaataaaaggtaataattcccaaggcaaccaggaagggaactggggagcggctgcaaatttagcctttgccattttgccagttgtttagcgtcatttacgttggtgggaattctagtgctcataatgcactggaagatttttttctggactacgtaagagtaattggagattgataatgtgtcgatatgggggcatgggaagtga

SEQ ID NO: 159836 - DNA, 218 bp, Homo sapiens
cgctggagattcactaacatgataaatatggactgaaagggaaatgtcaagagaaggaaaaaataccaccaactgtgacaaagaaaaaccatattggaagggatattcactgcttctcaagagaaaacaaggcaaaaaagccagaaatcatacctagggctagaggagtctacataccgatttagtacgactggtaacaaagttattaggatgcttga

SEQ ID NO: 159837 - DNA, 876 bp, Homo sapiens
ctaatacaaggcacatagtaggagcttattatggtgatggggtggcattggccacagggccttgggctcagcctgtccctctgtccctctgatctggatgggtgggtatccagggaagtacccctacttgataggcctcaagccctccctccttgtgtccagatcctttcagcacctgcctccacgtcctgcccctctgccctctctccctggcatgatcctggccttccagtcacatcccaaaatcactttgcctggtttcctttgggaagcaaagcctgtctggggccctccatagacagagaagctgtgaaggagataaatgctgaagaaggggtgaggagacagactcaggggccaatcaaagtcaggaaacaggctgggtgtggtggctcatgcctgtaatcccagcactttgggaggctgagccgcggatgacctgagttcaggagttcgagaccagcctggccaacatggggaaacctcatctccactaaaaatacaaaaattaaccgagcatggtggtgcatgcctgtaatcccagctactcggaaggctgagacaggagaatcacttgaacccagtgagccgagatcgcttcactgcagtccagcctgggtgacagagcgagactccatgggggaaacctcatctccactaaaaatacagaataaccgagcatggggggtgccatgctgtaatccccagtatcggaaggtgaaacgggcgaatccttgaacccaggaggcagatgttcactgagccagcctggtgcgaacggatcctctccgaacacacacacaacggggggggggcaccgaaccacctcggacgggggagccagacgagcacacagaagggaaccgtcaaaaacgg

SEQ ID NO: 159838 - DNA, 885 bp, Homo sapiens
  misc_feature (41)..(41): n is a, c, g, or t
tgagctggccccgttagtgtcgctcgataccacgctgtcangatcttcttgatgtcttggcgctgggggaggagttgccccctagggcagccagcaggtaggaggcgacgtagcgcatcgcggcggcgtcttgcgggggctgccagcccccgcagacgccagttcgtccctttccagttttacagtgaattgctgccgtcttgcgggcccgtcttgcgggggctgccgcagcccccgcaagacgcatcccaaaatcactttgcctggtttcctttgggaagcaaagcctgtctggggccctccatagacagagaagctgtgaaggagataaatgctgaagaaggggtgaggagacagactcaggggccaatcaaagtcaggaaacaggctgggtgtggtggctcatgcctgtaatcccagcactttgggaggctgagccgcggatgacctgagttcaggagttcgagaccagcctggccaacatggggaaacctcatctccactaaaaatacaaaaattaaccgagcatggtggtgcatgcctgtaatcccagctactcggaaggctgagacaggagaatcacttgaacccagtgagccgagatcgcttcactgcagtccagcctgggtgacagagcgagactccatgggggaaacctcatctccactaaaaatacagaataaccgagcatggggggtgccatgctgtaatccccagtatcggaaggtgaaacgggcgaatccttgaacccaggaggcagatgttcactgagccagcctggtgcgaacggatcctctccgaacacacacacaacggggggggggcaccgaaccacctcggacgggggagccagacgagcacacagaagggaaccgtcaaaaacgg

SEQ ID NO: 159839 - DNA, 283 bp, Homo sapiens
atgtggaccaagggggggggctctcgacagtcactggatgggtgccatcgcgtggaccgggtcgataatgcgtacttcaatgaagaaaagtatttttgtctgacagtggaatatatctggagaccacaagtaccactcctattctgttatctggactagaattttcaatcaatgtgtttgaaaataatgttgctatcacctatttggttgagttttggttttttctttttctttttttttccaaaaataaagacagcccatttttgtcatttccattaccaca

SEQ ID NO: 159840 - DNA, 833 bp, Homo sapiens
cagggactcgggtgcctggggcagacgaggccggcttctccgcggacagctagggagagtgtcctgggtgtcagccagaacatgtctttcaacctgcaatcatcaaagaaactgttcattttcttaggaaaatcactgtttagtcttctggaggctatgatttttgccttactcccaaagccacggaagaacgttgctggtgaaatagtcctcatcacaggtgctggaagtggactcggaaggctcttagccttgcagtttgcccggctgggatctgttcttgttctctgggatatcaataaggaggggaatgaggaaacatgtaagatggctcgggaagctggagccacaagagtgcacgcctatacctgcgattgcagccaaaaggaaggagtgtatagagtagccgaccaggttaaaaaagaagtcggcgatgtttccatcctaatcaacaatgccggaatcgtaacaggcaaaaagttccttgactgtccagatgagcttatggaaaagtcatttgatgtgaatttcaaagcacatttatggacttataaagcctttctacctgctatgattgctaatgaccatggacatttggtttgcatttcaagttcagctggattaagtggagtaaatgggctggcagattactgtgcaagtaaatttgcagcctttgggtttgctgaatctgtatttgtagaaacatttgtccaaaaacaaaaggggatcaaaaccacgattgtgtgccccttttttataaaaactggaatgtttgaaggttgtactacaggttcttcttgttgccaattctgacacggcagtgaagacgcagg

SEQ ID NO: 159841 - DNA, 879 bp, Homo sapiens
caggtgtggatggagaagatggacagtgttagttgggtcttgcccaaggtttgaggagctattgcatctcatcctcacagtagcgccagaaaggcagactgatgacctcattttacagttgaggaaactgaggtctatgagctgagtcgattgcctaaggcggcactgcaaatgacagagctaggattccagccaggctcatctgcccccaaagcgcatgcctacaggacaagacttcactgcttcctctgtgtcattgtacagtggagtgatgctttggaaaccgaaatgagaagtgaattgaataacttaagccagaagacctgtcaaggccctgggcgagtgtccccggatatagtgaacaaggcccagtgaccctgaggcgggtagcactcaggctgcatagtgtgtgcatgagtgagtgacttcatctgccacaagaggtgacactgcttttcagtagaggtggtaaagaggctttcatgaatgataataaagaaagtttattcttgtgttctctttagctttttgcccctcaagacaggactgcttatagctgactatttgggcatccttcatgcaatggatggctttgttgaccaaaagaagaagctctaaagaccaactctatggctaaggtcatctgatacacagtgttacataatgcgtacttcaatgaagaaaagtatttttgtctgacagtggaatatatctggagaccacaagtaccactcctattctgttatctggactagaattttcaatcaatgtgtttgaaaataatgttgctatcacctatttggttgagttttggttttttctttttctttttttttccaaaaataaagacagcccatttttgtcatttccattaccaca

SEQ ID NO: 159842 - DNA, 1272 bp, Homo sapiens
cagggactcgggtgcctggggcagacgaggccggcttctccgcggacagctagggagagtgtcctgggtgtcagccagaacatgtctttcaacctgcaatcatcaaagaaactgttcattttcttaggaaaatcactgtttagtcttctggaggctatgatttttgccttactcccaaagccacggaagaacgttgctggtgaaatagtcctcatcacaggtgctggaagtggactcggaaggctcttagccttgcagtttgcccggctgggatctgttcttgttctctgggatatcaataaggaggggaatgaggaaacatgtaagatggctcgggaagctggagccacaagagtgcacgcctatacctgcgattgcagccaaaaggaaggagtgtatagagtagccgaccaggttaaaaaagaagtcggcgatgtttccatcctaatcaacaatgccggaatcgtaacaggcaaaaagttccttgactgtccagatgagcttatggaaaagtcatttgatgtgaatttcaaagcacatttatggacttataaagcctttctacctgctatgattgctaatgaccatggacatttggtttgcatttcaagttcagctggattaagtggagtaaatgggctggcagattactgtgcaagtaaatttgcagcctttgggtttgctgaatctgtatttgtagaaacatttgtccaaaaacaaaaggggatcaaaaccacgattgtgtgccccttttttataaaaactggaatgtttgaaggttgtactacaggctgtccttctctgttgccaattctggaaccaaaatatgcagttgaaaaaatagtagaagctattctacaagaaaaaatgtacttgtatatgccaaagttgttatacttcatgatgtttcttaaaagctttttgcccctcaagacaggactgcttatagctgactatttgggcatccttcatgcaatggatggctttgttgaccaaaagaagaagctctaaagaccaactctatggctaaggtcatctgatacacagtgttacataatgcgtacttcaatgaagaaaagtatttttgtctgacagtggaatatatctggagaccacaagtaccactcctattctgttatctggactagaattttcaatcaatgtgtttgaaaataatgttgctatcacctatttggttgagttttggttttttctttttctttttttttccaaaaataaagacagcccatttttgtcatttccattaccaca

SEQ ID NO: 159843 - DNA, 334 bp, Homo sapiens
ttttacaactggtacaggccggggaagagactcaagtaggagcgcctgcccgagctgagactagatgtgaacctttcaccatgaaaatgttaaaagatataaaggaaggagttaaacaatatggatccaactccccttatataagaacattattagattccattgctcatggaaatagacttactccttatgactgggaaattttggccaaatcttccctttcatcctctcagtatctacagtttaaaacctggtggattgatggagtacaagaacaggtacgaaaaaatcaggctactaagcccactgttaatatagacgcagaccaattgtt

SEQ ID NO: 159844 - DNA, 120 bp, Homo sapiens
gttgaggaatgttagacattaggatatcggctcttaattctttgattcacaatctaatttaagaagctgataaaaagtggagcctcagttccagaaaaatacaccttcacagttaattcc

SEQ ID NO: 159845 - DNA, 243 bp, Homo sapiens
caccagatgcaaacttgatcttgactaggagggcccctcctagtcaagtagattcacaccttaagtcagtaaatcctagccactcctttagtcttcatcactggcatttgatggttttcctcttcttcatggccccaaatttctggttctctttttattatattatctatgtcctttactgtaactcacctcacaaccttttcggaaaaaaggactcaatacaggaaaggaaaaacagccgcg

SEQ ID NO: 159846 - DNA, 362 bp, Homo sapiens
aacgactaatatactactcacttgcattttattcaagaaaagaaaatatgtccatctataagaatacagaaatgtttttatttcctgttgtcttgaaaacagttactaaaatgtaattcaagatactgctgggcttctcatttgtatcatgaaggtgacagcacagacagtaacaattcataacatcatggctttccagggtgggcacgcacccgctatgctccttatgctattgccactgtcctaactgaacagtagcatatctccctcccttacccagagctgggatttgaacccaggcctgtttggtgcccaagactatgctattatcattaacgaaccacttctcacacggtccttta

SEQ ID NO: 159847 - DNA, 1546 bp, Homo sapiens
gtgtccctatcattaagcaagagcctttctcttttattcttcctgcttccctaagctgctcagggttctctgagtcttgccctctgatggcaagtcttatatataactaaacctatttttgtcacccatcaaaacacatcctcagtagactgtgtgaaggtgtgaaggtctgataatgacttgatgctttatctccatagacatgaaagccatgccctctgcctctagatagggtgatccaagagctcctgaaccttaggaggttcaaagaagctctactgtctgtgcccaggaggtagcctgccagcaagagccctcaggagttgcacacacagccaaagggtgttcacacagatctctgccggtctagccaggggaggccagagtctcgtcagtcaaggatgggcttcccccttagctgtgtccacagctgctcaagctatactggtcagagtgggctttgaagctcctttgtgagctcgagctgctgactgccactatgggagccttgccacctccagcccctccatcccaaagacgctcctgccactggggccccaggtcctgctgtatcagttctctttggtggggggctaaggtttggggcgaggcaacctgagacaagaaaacgcagtaaacattctgattccctgtacacagatgcagcaccaggggaagggccagtggtgcaagtatttctttttaacaggtgaagtttttggaaaaagtcactctccctacccctcagtatccttaccatcaactttggttttatccttccagtctttattatatgcttgcttttacatagttgtaataatatacacataaagtattttgtatcctgcttttatcattcaacattgtacatgttataagcattttactatattgttatatatcttcacaaagttgatctgtaaagctgtgtaatttgaaggcatccatagggtgactgtaccataattttgattcatcccttgttgttggattcttggtcaggggttgtttgttttgttttattggtaactttaaaattttgaatacaatttcagatttacagaaaagttgcaggaatatcacaaagaactcctatatatcttttatccagatttactgagtgtttacattttatcccatttgccttatctatatttcatgttgcattttcttaatcatttgagaataatttgcacagataccccattatgcccaaaacagtatgcatttccctaagaacaggacattctcttctaagagaagaagagaattactttaagcattattcagtatttttttaagtattattatcaaaatcaggaagtttaacagtgatttaatactgttatctaacccatgattcatatttaaattttgccatttatcccaataatgtcctttgtagccattcttttaccttgtgcaggatcatgttacatttgtaaacgtgtgtctctcaatactgcagattcctcaactttcttttgtctttcattaccatgacatttttgaagaatacaggctattttgtcgaatgttacctcag

SEQ ID NO: 159848 - DNA, 532 bp, Homo sapiens
ggaattcccgggtcgactactactactaaattcgggcccgcgtcgacagaaaagttgcaggaatatcacaaagaactcctatatatcttttatccagatttactgagtgtttacattttatcccatttgccttatctatatttcatgttgcattttcttaatcatttgagaataatttgcacagataccccattatgcccaaaacagtatgcatttccctaagaacaggacattctcttctaagagaagaagagaattactttaagcattattcagtatttttttaagtattattatcaaaatcaggaagtttaacagtgatttaatactgttatctaacccatgattcatatttaaattttgccatttatcccaataatgtcctttgtagccattcttttaccttgtgcaggatcatgttacatttgtaaacgtgtgtctctcaatactgcagattcctcaactttcttttgtctttcattaccatgacatttttgaagaatacaggctattttgtcgaatgttacctcag

SEQ ID NO: 159849 - DNA, 628 bp, Homo sapiens
gagctcggtactttcacaggggatcttgcccgtggttaatgatggggcttatttagttgcgtttgggccaatcagcttaaagggctctgtagaaattagctcattaatcctcacagatcaagagtaagcactttgagtgcgtccacctgcctgtgttgtggaggtaggcaggcagaggcctggctctcctgaggtcttaggactgagaggtggcctttctggctggattaaaggacccagagctccctgccacagttctggcatctgtagacattgtagggtggagtgggaaagtcccacactgcccttcaaaagctctagagctttcttttcttttgtatatcagtgatctctctctcttgctgttcatgtatttatatataacactcaccttgaagttctgtggagcctcttcctgtgtaggaatcagggctgctggagacgatcagggatgcaggtgaaacacaggagcagaattgcagaacaagtggctttcaaaggttgttaggatggcaggagttctatttttataaattataagggactgacatgataggatggctgtggtacctgctaagaccatagaaccgggtcattctaatagatgttataattcctttacagtgta

SEQ ID NO: 159850 - DNA, 146 bp, Homo sapiens
gatgatcactccaccagcttgacaagactccagctaagaaagaagtaaggaatgttcctcctagaattcatcattaggtaaactctgtgagtttgttactgatgtcggacttttataaacctggattaaaaacaaaacaaaacaaa

SEQ ID NO: 159851 - DNA, 466 bp, Homo sapiens
gtgccctggaacatctatggctgttcgggaatctcagttattactctcttgtgtaaagtataaataaattgaatgaatgtgtagtattaggtaattctcacttatttgggggataatattcaaaattaagtaatcatcttttcagaaattcatggcctttgtgaaaaattcgattaaaatggacaagtagctcatttagttgtagcaaaatgattctgaaagtgttattcatatgaaataaaattacagatagtttaaaatggtccttatatgatatggtgtaatatttttattgagaactttagtataaacataatatttgattaatatcattatgaggattcttaagaaataaaatataatatacttcactcgtatttctctgtaattacatgtgtcatggttatcgggagacggatgggttgaattctgacttttactctaactagtctaaggctaaactgag

SEQ ID NO: 159852 - DNA, 235 bp, Homo sapiens
aaaaattattttcatcatttcaattaatggataaaaaatttgggtgttgtcatttttaataatggggctgcattatataatatgatgctattgaaataagaaagagaaaatctataaaggcataattatagccaaatgtgcagttattttggtctcttagtttggagagggcccttaggaaatttttcttaaaaagagtttgtaatgattcataatttcatcagatctacaaaat

SEQ ID NO: 159853 - DNA, 378 bp, Homo sapiens
ctttgcaatccagagagcaggtggaaggtgtttgctgctgtttccctggaatgtgcccaggaggagctcccctgtgcctttcttggctccaagggttcaagaaagcatttctggcttcatttcccacaaccccgtgcaaagaccagggactcttgttgctgctgtgaccaagactgggagtcagataaggaaactgctgtgcctttcatgacaccaaggctcagggagaatatatgcagggaagatggaacaggtcctgcagtccttggcccttggcctgagtccactctctggacccactttcagcttgttcttcttgccacagaaaacactccacagtcaccgcaacatcaggtcaccgctgcatttgcttcactg

SEQ ID NO: 159854 - DNA, 367 bp, Homo sapiens
gcccaggtcatgtaattagaatgcaacataacttgagccccaacttagatctgaatgactccaggactagagcccttcataagtgcaccttattcctttccacttttttgacaaattggacagatcatatgcatacaagtgtacatgatcctccgaacctcttgcacaataggctagggcagcgctcaaatgatcaatcgtggtttagtagaattgctcaacattctgccttaacagatcaccatcacatcccactctcctttattgaatctttggaaccagacaaatcttggttcaaattctggttagcacttcatatctgtatcatgtgggacaaatgacttcatttccatgtgacttagttctc

SEQ ID NO: 159855 - DNA, 242 bp, Homo sapiens
ttatgtcagcataactaaaagtaaagctggataggaagaggttacttgaaaatgatttcacctgaactcaaatgaataagctggctactgcataaagcaacagaggggtccctttaatttaaaagctcaggactctgaatcaattgctggttgggagaaggtagagacattctttacttctgcctagaactggggaaaatggcgtagacttctgctctgaagcagtcctcagtgctgcttcg

SEQ ID NO: 159856 - DNA, 555 bp, Homo sapiens
gttgcatgcccaggacccatatctccaataatgatatcattcagaaaaatagtaaaagtagataaaattaaggatatatatcaaggtttgatataacccaacatacataacactcaaccatttcaataatccgaagggtaatttagagtcaaattatcaataaaattaaaaagatgcctgtggcagattaaattattgctttaacacttatttcatcacagtctgtattcattcccgttgttacatcattttgcaagttcctcaacaataactgagatacacttttctccctctttagaattggtcgtttgatttacttcagccaatgaatgtgagtgcatgcgacatgcctgaaggcaacaaaagcatggcatgaatggacttgttcccttgtacttttgccatcatcgaaagagcatgcagctagccctgttgtctaacgagatgagatagcctggagtaggactacatggctgatgtgaaaacctgcagcttgagtattatttcggcctcagtagctgatcctccactgaaagagactcatgagcaagctta

SEQ ID NO: 159857 - DNA, 483 bp, Homo sapiens
agagacatgatgtggtataaaaggtatttggtttctttctgccccagaactcctaaaatcctagaaatttcctgagtgctaggaggatcttctgttattcataattagctcctttgataagtcctgagtttatgctaatgaacctgcttagggcggggcccgtagatagcttcaggatggggctagtcaccagaaagtccaggtgattagaggattagaggattggaacttaagccccacccaccaacatctggaagggctgagggtgcaagaaatttagctctattaaaaatttaaacactgcagtcggctcgagtactcccagtaacgaggaggtgttctcggtcgtcccaccctcccctgccgtcgccgggctgcgccgccggagccgggacgcgcctccgctgccctcgcctcctccgtccccgctgccctcgccgcccccgtccccgctgccctcgccgcctccgtccccgcggccgc

SEQ ID NO: 159858 - DNA, 582 bp, Homo sapiens
cacagagtgagactgtacttcacatctggaaattccctcattcctcttttgctgctctactgttggtattactttaacatgaaatggagctgacaatttgaactgtgtaaatagaagcccttaacaaaatgtacctcatagtaaaatgatggtttaatgaaacctacagattagagttctgctttaagtcaacaaggtgttattttaacaaacttccaagctctaaagatgtagagcacagtttacaggtatatggcacactcaaagatctgctacctacaggctctgacttgcaatcagaggcatttatcttatttggttcaggcaaggcagtatcaggtgcagctaagatcctttaagaaaaagagttggaaaactcatagcttggccactcccttgctctgtgactttgggcaagtcatttcatctatgtgggcttgtttcaacttttataaatcgaggtggtgctgaattatatcatcctgaagtctcttttagttttaacattatcattcttctaaatatgtttttatgcatgaagtttacaatgtttgtgattataaaatgattcattaaagaaaa

SEQ ID NO: 159859 - DNA, 249 bp, Homo sapiens
aaaggggaaaattcaggggggtggggggagaaagccccttgcttagtgcaagtggaccccccctaatccttatgtcttttcccagttcagaccaggttgaattcctcgggcaggggttccattggtgtggcagacgagaagtgcccatccattggccctgtagggtctcagctaccaccatggctttctaccacccacctcccccatcgtggctgttgggctcagaccttgcctgctgcaggcatgcat

SEQ ID NO: 159860 - DNA, 245 bp, Homo sapiens
gtattatgttgagtgaaaaagacaaagaatttgtactgtattacttcatttatatgaagttcaaacacaggcaaaattaagctatagtgtttagggatgcatactgaaatgcagtcttttaaaacagctttagttcatttattttcattgctgcataagattccattgtgtaattatacccacttgtctattctgtgttgatggacatgttcccgtttttggcaatttgaataatgttagagata

SEQ ID NO: 159861 - DNA, 310 bp, Homo sapiens
cgacggtgttatcgatgccacccactcttaatcagtggtggaagaacggtctcaaactgttgtttcaataggccatttaagtttagtagtaaaagactggttaatgataacaatgcatcgtaaaaccttcagaaggaaaggagaatgttttgtggaccactttggttttcttttttgcgtgtggcatcgattgatttgccctgataccatctcttgctgcagccttcatgcctagtgcctgatcctgcctcaccctgctgcgcgttggcattcagatttgacttaaaatccgagtggctcagcctctgct

SEQ ID NO: 159862 - DNA, 475 bp, Homo sapiens
gggtgaggttgggggttgagggtgaggcccaaggatgagactgaggcacaggagtgctgcccaggctctcggttcttcctgcccctcctggtgctcacagtgggtgtcagcctcgcttttcccaagtgggagaaagcagatctgcggaggtgggaggtgttgggtccatggcagagcccttctgctgggttcctatctgagagcaggcagagggtcctgtgccagcagacgctcttcctcctctgccccaaccccgtacccctgcatccctctttctcccctctccaggtggccggtgaagagccctggcaccagccttgacctcaccctctgggacagactgaggcaggggaccgcgggctgccggagccctcggggcgagctccccagctccccttcccctccagcatctgccttttgttccacctctcttctccctcccttgactcaggaaaaccttcatccctatctcctg

SEQ ID NO: 159863 - DNA, 548 bp, Homo sapiens
atgctggagaatgagaagaaccctacatggggaaaagctctggggtcacatcctccctagaagtgtctgggtgcacctcaggaaagaagagtctacttattatgccctgacaggatcccacaggcccaatcccgccggctcccagcagcctccgcaaccctgggtcatgtgtgaggtgagacctggcacgtgcctgttctgaacgctcccacctcacatgcccgtcccaagcttaggatttaaacacttgatgctgccaccaccctacatccatccatcaccaggtcctctcgattctgcctccgagtctgtcctacttctctaccctggcagcctgccctgggtctcatctggattctgctcccgactcttcctatccaccaaagtcagaccccatttcccacagtgaaccacccctcagaatgcagtcggagtcctgcacaccaaatgtgccaggctcggccatccacccgcttctctgctcccttcccagcccagtctcttcacccagctgtggagtctgggtggcggcaagcgtgttgaggagg

SEQ ID NO: 159864 - DNA, 156 bp, Homo sapiens
tgcttaacccaggtctcagtccaaacctcccttcagagaggccttccctcaccccaatatctaaataagcatacacatacccttatcaagcttaatttttctatcatcattacctgaaattgtatcatatatttattatttggtttttttgttctt

SEQ ID NO: 159865 - DNA, 287 bp, Homo sapiens
agaaaatgtcatagattctagtcagaacaaaacagaaaaagaaaatattcccttcagaggaaaaagactacctgcatcagacatcttttctgcaacactaaaaatgtccgaaggcaaagaggaaaatctttacgtaattctaagaaggaaaagtggtgaccatggattctacatcaatccaaactagcagtcatgcttgatgaataaaataaacaaattccagcttcagataggcaaggacttggaagatcagtcaccaagagattggctaactacagtgcactgca

SEQ ID NO: 159866 - DNA, 543 bp, Homo sapiens
gggaccagtagataagatctaaatgtagccaggcacagtgcattacactctgcctgtaatctcagcaattgggaggccgaggcagggggatcacttaaggccagaagtttaagaccagcctggcaacatggcaaaaccccatctctactaaaaatacagaaattagccaggtgtggtggtgtacacttgtaatccaagctacttgggaggctgaggtggggtgatggctcgaacccaggaggcggaggttgtagtgagctgagattccactactgcactccaggctacggtgagatatgatcatgccactgcactgcctgatgacggagtgagactctctctaaagaaaaaaacaagtgtatgagatcattgtgtggatgagtaaagagtgaggaaaatgcctagaagcaagttctgaggaactctaaacacttaggggttgggtaatggaggagaagctagacaaggagaacaaagaggaactgtgggggaacagtagtgagtggtgagaggaaaactactagagtgaggtaggaagaagct

SEQ ID NO: 159867 - DNA, 606 bp, Homo sapiens
tccccaaacacagtactttagtagtaattgtgacacacaaaataattgcttttgctctttctagattatagtcaataaatgtcattttttcaacaaaggtttgatgggcacctactgtgagaaaggtatctgccctggaagtcactaacatgatcctaatccacttggaggttagcctggaagaaggaaaagacactcaggaataaatacaaagccacaacatgtataggtgctcaagaagagtccagggggctgcatgagtcagaagagaagagatgagatgtggctggggttatcaaggaggcttcacaacaggtagcatttgaactataccccaaaagacaggaatgatatgccagatttaggggagaaaaagaaaagaaaaaaaaggaaagaacattggaagaagtgaactgtcctttttttgttttgactttttatttggaaaatttcaagcttacataaagtaggcctagtagtataataaatcctatattccacttcaatggttatcagcccatgagccatcttgatccacctactgtctcaccacttcatgtcccactctctgaccagattactttcaaacaaatctaagacatccca

SEQ ID NO: 159868 - DNA, 277 bp, Homo sapiens
caacgatcacttgaggaagctttctgtatttgtcaaaagagattatttttacttcggctcctaaataaatcagactaacagttcctaggacttcacaggtatatttaagattatctcttgtatcttactagccttttttgggggcgggggggggacgcagtcttggtgtgtcagtcaggctggagtgcagtggggcaatcaccgctcactgcaacctcaacttctggggcataagggaccctcccacttcagcctctcaagtagctgggaccacagg

SEQ ID NO: 159869 - DNA, 379 bp, Homo sapiens
ctgatccggagcaggagggaacaaggtgagctgtgcttccacaggacgggcgggctgggtggacacagccccttaagttggccaagctgatccgcagcagaggccaggcaaagatttatacctcaaaggtgcagagaaagaattcgttaattgcaagtttttgacaataaagtctctaaaaatagggaggtcaaagacctatagccaggaagaaacctgtccaagatttagtcaagctgaagagaatgttaatgaagtccattctggtcacagcttgggctgatattcactttttgggtatgaaaataattgttttcaattatagaatgaatttggttactgagggaggattattgggcttctgcccataaaaaatgaa

SEQ ID NO: 159870 - DNA, 350 bp, Homo sapiens
cactcttactgattaccacacactgacccatctagggagtggtttaccctgaggccaggtcactaagccagtcaaaatccagctcgctttaatttgtagtccatgcacgtaacaaacactggtccactgctccaggtcatcattcgaatgtcagtataaactcaccagtggtcccaagagttctgtttctttggcatttgctttctctggtattatgtgccattttacaacaacagaaatcctgatctgtcaatgtcactcaattattaacatttcctggggtgttctacaaaccccattaagtgggatttgctggaaaggttgatgctctgctttgccccttggcccct

SEQ ID NO: 159871 - DNA, 294 bp, Homo sapiens
atgagaaaactatggggctaggagagtgcggttattcaagagagtgagtggaggctgtgtggcttcttgaagtagagtctgcaggaatggggggtgggggtcctgaatcatctggaggtgtcttcactcagaggtcttgcaattgacgccagctgttggaggggctgtggactagggcaactacacaggtctctatgtgtggctccggtttcctcccagcatgatggcctcagggtagtcagacttcttagacagagagcacattccttggccccacccaggcctctaaaagtg

SEQ ID NO: 159872 - DNA, 288 bp, Homo sapiens
ccttaacttccctattaagtcacaagctacctgagggcaggatctacatccccctttattttaattttacttttttataaatagacacgaggtctcactttgttgcctaagctggccttgaactaattcctgggctcaaacgatcctcctgccatggcctcctaaagtgctgggattacagatgactcaccatgccccgggggccccccttatcttttaatctgaatataggtttgctcattgaaaagtaataatttgtccgggtgaggtggctcatgtctataatca

SEQ ID NO: 159873 - DNA, 439 bp, Homo sapiens
atggctttgaactgcgtgccagcacagtgtgcctgccgcagttgttccccactccttcagggttctgctgtattgccagaggctgcactggaggctttgtttcagtgacgctttcaaactcctcctgccctgtttctaattgctgctcttcaactctgtacaacaccaatgctgttactttgctgccttccctcccttctgtgcagcattgctagtcctgcagctcaagtgatgagtcactcactttcttgaactcgcctccttcttcacctcacttgacttgagaggtgcccaagaggctcagccccagccaaaggatagtaccaatcctaactttatttcagggaaactcaaggaactcttgcactcctgctcacactttagtgggtggttttgccagagttcctaaactcttcacatcagttctggaactcagttc

SEQ ID NO: 159874 - DNA, 464 bp, Homo sapiens
ttgttggggagggtgaagctctgtctacactgcaggcagtggaggggcagcaggtagcaggcttggcagtgaatgagcctctgtctacactgcaggcagtggagggacagcaggcagcagactttttgggaggtttgaagctctatctacacagcaatcactggaggggtggtgggcagctggcttgtcaggtaggtgaggctctgtctacacagaaggcttgtggtggggggcgaggctctgtctacactgcaggcagtggaggggtggcaggcggcaggcttgtggtggggggtgaggctctgtgtacactgcaggcagtgaaggggcagcaggcttgtggggtgggtgttgtcccacgccctgcccttaccctccgaggcctttttcttgcgtgaagcatgaagggcgactttgcggttggagcctggtcccgcttcttcccatgagtgttttgttttccc

SEQ ID NO: 159875 - DNA, 379 bp, Homo sapiens
gccacatctccagagactctgaattgggctggtgtagcacctaggtccagggacagatccaggtccatggggcctaaggagcatacagtttgagggcctggttaagaagaacaaaataatatcttacttttacaacttttacaaaagtatgactttgtgaacacatcactgtggtcccttctatcctggagccttgggaatagtttgtgcaaatgagtgaccctgaaggttcacttcattgtttgagagtaagtctagggatgccccggcatcagtatgttgtaaacgttccccacatgatttcaccacgcacagttgccatgtgagaaccactggggtagacaggttttcaatccaaaggttggtactccagagtatg

SEQ ID NO: 159876 - DNA, 376 bp, Homo sapiens
tccttcttctctttcttctttccttcactcctagataccagcaattgccaattgcaactgaattctattttacagtcttgagaatctaccagttgagccatctatcctacttcaggctcttctcattcagtatagagtatagagcaatagtttcctaattggcatccttttaggcagtctttttgtcttctaactcatactgcacacaatacctcttggtgcatgttctccagtactcgactccttgtgctactttgtcttcattcaagctctactctccacctggaaaggctggtaatctctctaagtctaggaaattcataactttctctaaggatccagctcaaaattgaaccaccatctacaggacctgagc

SEQ ID NO: 159877 - DNA, 222 bp, Homo sapiens
gccgggagggcagcgggaagtggtggtctaccgtcaccggcttcaactgtcactatcaagcctaaggctgcttctagttatttttctccactttgaactttttctcttccttcttcacttaggttagatgaaaagtgcaaagattttggggtgagtagcttgcgtattaagctgcaatgctgtccctccttgacagctgccgttggaaacccaggagcccag

SEQ ID NO: 159878 - DNA, 807 bp, Homo sapiens
gcgcgaggatgtggagccagcgcggacaccttcccccagcgtctcgcgtgccttcaggcagggactctaggatcttaggtatttagtggaggtctgaggttgggggggaggaggtgggtattggcgtgcagtagccgctctagaggttgttacttgtttttttgcggggtgcagcgaggggaacttacctgaaggtagaagtggagcgacctcctccttcatttggctgctgagctaagtaagggtcggtgcctaggtctgtgttgggtccagtcctaccctgccctgctgtctagggaggaggagggccgcgccagagaagaatgatgggaattggattcctgcaggtgcctggaagacaatggagaaagtcacgttgtgtagaggacagtgactttttgaaagtgccttcaatatgcgcaatttctggcttcttaattttcccgaatccccctctatggaaagatgcaggccagaacttgtacgtttcgtttaatccagggagaagtggggagtcaacagctggatggctgatgatgccagtttactgacatgcgatctcagagcaggaaaaagatttgagagggaagaaacgagtttagtatgggattatgtttttaggcatctgggatttccagtaggtctacggatagtcaagtgtatagctcaggaggagaactgatttcgaaatgccctgttaccttgtaaatggtaactgaggccttgtaaacaaattaaattacctagggagagtgtactgaggagtaggcagagggacagggccctgaaggacaaataagaaataag

SEQ ID NO: 159879 - DNA, 461 bp, Homo sapiens
gagcgtctctctctttgtccagtccctgtcttctaacagatgtcatccaagcctaatcaagcataaaatggtcataaatatttctttctggtagatttcacattcacatttcatgcagggacatgatatttttctgctacctccagggagagcctaatgcaaaaaccagttacttacattctagcctcatgttcctttagtaaaatgcagagcatgttctcagttcaaagacataaaaaggtgtaagactttatcttctggcttttgtttaactgcaccttttatctttccttcctcccccaccgccccccgcaaatgtatcttcatcttatagtttatcctgatgcattagaaatgttcttttgtgcctgagaaaatataaaacagggtctaaaatgagcccatgtctaccatatttcagttactttaggttttcaacattaggctccttaattactggc

SEQ ID NO: 159880 - DNA, 412 bp, Homo sapiens
aacagaacaaaaagaaaagaaaagaaaagattagattctaggccaggcgttcacacctataattctagcaccacgggaggccaaggcaaggggcttacttgaagccaggagtttgagatcagcttgacaaccaagtgagaccctgactctaccaaaaaaaaaattaaattaaattagccaggcatggtggcatatgcctgtagtcccagctacttggaaggctgaaggctgatgcgggaggatggctgagcccaggaagctgcagtaagccaggattacaccagtgcactctagcctggatgacagagcaagatcttatcaaaaaaaaaaaagccaattctcaaagaaaaatccccatttaagtatagaaggtatattactgaactccggcatgtacatattcataccatgc

SEQ ID NO: 159881 - DNA, 287 bp, Homo sapiens
taaaatctgtgacctttgaaaaggcttcaggggattgtagttcccctgaaattgtatgcaaaataatatgtcagttttctagggtaggtgttcacagcttcccttggattctcaaaaggatcatttacacgtccccacccctaaaattcaaaactgctaagctaacctctctgcctgttttttcttttcactttttcctcttgtaacacattactttgaccaactcctatcaggcaagactacccaagggttaatgctgtggcagaaggttggaactcttgatttag

SEQ ID NO: 159882 - DNA, 638 bp, Homo sapiens
gtggatcacctagtgaggagtttgagacgagcctgaccagtatcgtgaaaccccatctttactaaaaatacaaaaattagctgggtgtggtgggggggtactgtagtcccagctactcgggaggctgagggacgagaatcgcttcaacctgggaggcagagattgcagtgagccgagatcgcaccactgcactccagcctaaaagtcaatttgcaaactcaataattaaaaaaaattaatttaaaatggtcaaaggatctgaatatacatttctccaaagaagatatgcaaatggctagtaagaacatgaaaagatgctcaatgtcgttagtcactagggagatgtgaacgaaagccaaaatgagagcccacttcacactacaggatgtgtaaaatcatttataggatggctatactaaaaaaaaaaaagagacaataacaagtgttaaagatgtacagcaaatgaatggttggatacggttggagttaaatgggaagcaactgctaatgggtgagggtttctttttgcggtgatgaaaatatcctaaagttaattgtggtgataatcacacaactttgtgaatttactaaaaaccagtgaactgtatactttaaatgggtaaactgtatctcaagct

SEQ ID NO: 159883 - DNA, 322 bp, Homo sapiens
ttgagccaacgagaaagaatcctaaagcccttgtttctggatggtctgtcaaaagaccagtaaggtagcctcagaggaagtgctgaggagcctctggaagcacagcctggaccaggagtgaagactgaggtctgcccttccactgagtgaatgactgaggggtccctgcatctgttgagattccctactgtgaaatcaggggactgacaggtgatgtctgcagcccttacaatagtcacatttgatctctgaatcagaacccttgattgtatctgaagaacaaacatcataatgtattatttaatgccttcaaacatattca

SEQ ID NO: 159884 - DNA, 215 bp, Homo sapiens
cttctagagctatacaaataaggttaatttctcgtttcatgttatgcctttaatatctctgaagctaactatacccagtatgttctcaatcctgtctcctccctgcccacccaccatagaattaatttttgcttaggcttaatattttccattccatccatcacttctaataagaaaatatcttattctcattgcttttcccagaagtcattaca

SEQ ID NO: 159885 - DNA, 269 bp, Homo sapiens
agcgagactctgtctcaaaaaaaaattaataaataacaacaacaataataataataagacctctccataaaacatttgataagaactagcaatatggcaggctataacctcaaacctctctaaggattaacacttagaagtgaatctgttatgaaaaccatacgtttgggaaggtgcatatctgtcagggctgtaagggagacactcttggagcgggaagaaaagagaccattctggaagtactccatggtcctagtagacagtactcg

SEQ ID NO: 159886 - DNA, 694 bp, Homo sapiens
agaaaaaggagagcaaagcggggcaggagaaatggaaaagaggtggtggggagtgggaggagagacaaagcaagccactgtgccactcatgggcacaaatactgcttagttttgagtgtgtctttatttctacatcatggtgcctaatatctcttacaggacaggaaaactcgacacaaagggtaactttagggtactgaccctaaaattatgacagcttgtcaacattaatatttatcatacttccactgccacacgatagagtaatatctattattcatatggaaacattccatgtaacacacaagcttaaaattacaacaacttgtcaattaagatttacttaactggcttaagtcagtatttctttaatttggctaagaatataaatcatctgggccaggtgcagtggctcacgcctacaatcgcagcactttgggaggccaaggcagatggattgcctgaggttaggagtttgagaccagtctggccaacatggtgaaaccccatctctactaaaaatacaaaaaaaattagccaggcgtggtggcacatgcctgtaatcccagctacccgggaggctgagtcaggagaattgcttgaacttgggaggcagaggttgcagtgagccgagatcgcaccatcgcactcgagcctgggcaacaagagcaaaatctctgtctccaaaaaaaaa

SEQ ID NO: 159887 - DNA, 256 bp, Homo sapiens
ccttcaggacaccccttcttcttgccaggcacaggcagatgggtcagcaccctccagggtgctttagcctcagcacctgaggctggcaaccagtagtcagtgcctatactaccccacaaagaacaggtcaacctcccctggatctaaaagaggaatcattagtccctccacccaacagaaaaggaaagagagaatcctgcccgccccagccacacatcactaaaaagggacctggacaaaccatcctgcagtaaag

SEQ ID NO: 159888 - DNA, 440 bp, Homo sapiens
tcaaagtgctgggattacaggtgtgagccactgtgccgggctaaccatctgtatttctagtaagttcccaagtgatggttatgctgttggctttggtatcacactttgataaccactgttctatggtatccacctcagaatagattgtggaccaaagattatgggaatcttcaattttgctagataatgattttctgaattgtttgaaccagtttatactcttgctggcagtgtatgaacatgttcattgacttaccaacactatactaatctggtaggtatgtctcattgttcgtgtgtgtgtgtgtgtgtgtgtttcttttttctttttcttttttttgggacaggatctcattcttttacccaggctggagtacagtggcatgatcatggctcactgcagcgtcgacctgccagctcatgcaatcctccttcctcag

SEQ ID NO: 159889 - DNA, 415 bp, Homo sapiens
agttacaacagctccagttacaacagctcagccataaccttcagggttttaaatgtcactgttaatgcatcaggaagcccaaagacagacagtctggagaaatagtatgtaatgtttagatgattttggtaaacagctaagtttttaatgtatgtttaatgtgcattctgtttggggcctctgagtttgaatccctgagaccgagctgatgtttagcaaccatttcttaaccaggaaaagcctcccctactcccagcccatagccatttgagcttcactggcttttttgaacagaagcatttcccagtttttgcttggttcagtgaacacggttactgtttaaaaacagtggctgtcgagttgtatgtctcaccaccctttgctctcctcttgagctacctcaagctgtgtgaga

SEQ ID NO: 159890 - DNA, 425 bp, Homo sapiens
ggtgaactttataagtaatatgatgcaaatgtctggtatttttccttatacaatattttaaaatatctttgtgtgcaaaatacacttatacaaggtgtattagtagtttaaaaggtgctcttgagtgacttgggtcacataatttggttttaaacttctgttgctttattttaaacatggaaactgtgtgagcatgagagtggagtgggagagagtggagtggcagagatcgagtgtgtatgtgtttctttttgcctgtcagagagagagaagttatttagaaatgtccagttgtgtgatatatagcagtttggtctaaagttgattgatgtgatacttccttgtttcttgactgtttttctaagttattttgatagctttggctgtttttgcagattctggaattgggatgccatcttactgaa

SEQ ID NO: 159891 - DNA, 690 bp, Homo sapiens
atcactccttccctgcctttcctacctatcactctcgtgctgaaagttggagctccttacccaaagactgggcggaaagggtgaccgccctggacccctgcccgacttcccgttaggccaagccgctgtcctgaaaggggatcgtgtccaggccggcttcctggagacacacctgcgcctgcacacacccaccgcggtcgcgtcaccagtgccgcggccacctggacgaagaccaaagtctggagggaattccctcagccacaaagcgatgggaaagcgggacccggtggagaccagagtcttgctatgctttccaggctggttttgaactcctagcctcaagcgattttcctgcctcagcttcccaaagtgctgggattacaggcacaagccactgcacccggccctgttgttgttaagaaaattacaagttaaatcttgtaccagtgaacaagattagggatcgtgatgtggagctgcacttcctggttccaaatcctggctcttcccctcatccctgggtaagttgagggatgagagcaagagaaggttgatcctgactcagatctctgcatggggcatgtcactgatgacggcggcattccctgagagagggaacactaagtttgaagttgggcatagtgagcactattttggatgagttaagtttagaagtgcctgaagacatcc

SEQ ID NO: 159892 - DNA, 734 bp, Homo sapiens
atcactccttccctgcctttcctacctatcactctcgtgctgaaagttggagctccttacccaaagactgggcggaaagggtgaccgccctggacccctgcccgacttcccgttaggccaagccgctgtcctgaaaggggatcgtgtccaggccggcttcctggagacacacctgcgcctgcacacacccaccgcggtcgcgtcaccagtgccgcggccacctggacgaagaccaaagtctggagggaattccctcagccacaaagcgatgggaaagcgggacccggtggagaccagagtcttgctatgctttccaggctggttttgaactcctagcctcaagcgattttcctgcctcagcttcccaaagtgctgggattacaggcacaagccactgcacccggccctgttgttgttaagaaaattacaagttaaatcttgtaccagtgaacaaggtttgtatagatgattttattgtcttgaaattttattttatctcactttaaaaaaatagaagcatattagaatatactttgttctatacccaaatcttgtgttaaactctttaaaaatgtcttttcagtgtttggtaaaagctgcaatgagtcgtacagatgtatatttcacattaattattaataattataatttagaaatgttaattacagtcatttaaaggaacttcaacaaactaatggttattgaagttacattaagaatatctataatcatga

SEQ ID NO: 159893 - DNA, 440 bp, Homo sapiens
ggaagcgtggctcgcctctctttactcattcggtttaccacgtcttagcttgggttatttttgagatggagctcgctctgacgcccaggctggagtgcagtggcgtgatctctcactgcaaactccgtctcctgggttcacaccattctcctgcctcagcctctcgagtagctgggactacaggcgcccgccaccatgcctggctaattttgtttttgtatttttagcagagatgggtttcactgtgttagccaagatggtatccatctcctgatctcgtgatccacccgcctcggcctcccaaagtgctgggattacaggcgtgtggctctgcatttattaactgtggattaataactacttgagtctgttctctctttaaaagtaaggacactactgtaatttctaaagcttattgtggggatcaagttaagtaatat

SEQ ID NO: 159894 - DNA, 236 bp, Homo sapiens
tacgtcatagcatctcacagaatttaaccctttcgaattgtccctaagagataatgattggctccaaaggaaattaaagagacagaacaaagaagtttaaatatgcaacacacgaattacacaaaattctaaacaaaggttaaaagtaaaaaataaatcttttaaaagatgcaaataaaggctggttgcagtagctcatacctacaatcctagcactttgggaggttgaagtgggt

SEQ ID NO: 159895 - DNA, 140 bp, Homo sapiens
tcccaccatgtgctagtggtgagtatagctaacatacttgtgctgacagtgaagttttgttggagtctgtgaaagttaactggaaatttataagaaaattgcaagactgttattaggtgattttagttttcttttttatg

SEQ ID NO: 159896 - DNA, 210 bp, Homo sapiens
acaaatatgaaatacaactaagtagagccggtattcatttacacataattatcttataccatttggaataagaatttggggcacgttagcaaaccaaaaggctcagaaagaagttgtgatatttagttcttgtctccctctacaaatgtgaagcactcttctatccggcattactagtggagttcctattttcaactttgcaaattctgg

SEQ ID NO: 159897 - DNA, 403 bp, Homo sapiens
ccttgcctgctttgtttttatttcttagctcccaatcaccatttggtatactacatattttattatctatcttcttttttgtctgtttctcccactggaatacagagttctataacaacagggatttacctgctttattcattactatattcccaacacccaaaacagtgtctagtacatggtattcaaaaaatattttggaattaatgtgcagtcaacagctaatctttttaaaccaatcatttatctagaaattatactcataccagcttattacataaatatatgtatgtaatacaggacttgtagttttcagagtaatttcataggtactttattccattaagaaacagaaagaatggctgggcgtggtgcctcacgcctgtaatcccagcactttggg

SEQ ID NO: 159898 - DNA, 353 bp, Homo sapiens
tgagttctgtgtggaaatcgttgtgggggaagtgatgggagcagggaaaggaggggcgcaactgtgcggggcatctggcacctggggaggaactggggagccatggagggggccggccatgagcaggggaggtgctggggctggtgggaggttggctggaagggaggaatgcgaggaaggggcaaagagagctggcggacggggggtgaatgtcctttgttccgtccagcagcctctcctgaggacacttgcatgctaggccctctgctcggtgatgccggggaccctgaaggtccagtttgggggtaacccatctaggtgagctgtgtgacagtggcagtcgcagcactgca

SEQ ID NO: 159899 - DNA, 317 bp, Homo sapiens
ctaggttttctaactggggatagttaatgcatccacatcatctgaggttggcaaacagctggggaactgtagccataaggcagcaataatgaattccagaaagagaacaaattttccttacttacaatgtccagactcttacattggttgtattcagcactgcccttaatgcattgtcgtttcaacttgttttaaggttctgaggtgttttgcatttggaaagggaaaattagtcactgagacgtaacaggaataaggtttgagaagttctgctttctaactttttccagtaatgacattttctaaaaagatactac

SEQ ID NO: 159900 - DNA, 175 bp, Homo sapiens
agggaacatacctctcagttcccatgagctaagaaatgcccgcaggctgtggatttctagtcggagctggtgaaggcactccctggggccacccagcctctcctggaagttgcccagaagcagacagagaattagcaagtgaaaggcagcagccagccctcaacaggtgctgggg

SEQ ID NO: 159901 - DNA, 225 bp, Homo sapiens
catgcaaactggtttgtttccattttacttagctctgtaaggtgccatgttttacatattctgcaaattctccccatgtacaatacacataaacccagtattatttttaacatctccaatattttggtacacttcaatttatttaccacttgttcccaattcttggtgatatcaatgtgtcaagctctttcaaaagaactttggtttatcatccgcctttcaccc

SEQ ID NO: 159902 - DNA, 147 bp, Homo sapiens
gcaaatcccctatttccactctcaaatatatctagaccctattccactctcaaatatatctagaccctacactgttcaccacctcatctgctatcagcctagtccaagtcatctcacctcttcactggataattgcaagtttcctga

SEQ ID NO: 159903 - DNA, 685 bp, Homo sapiens
cttttacttgtagctatatgaaaccagcaagtatttaattaggctctgtgaacacttcggtaacaatctaaattaatattctgaaaagatgagttttaaggttctttctatgaaatcattaaagaaaaaaccctggaatcattaaaaaaaataaaatttgcaccagatgctacctttattgtatgcaaacaacaaaaccaaagttttctgaaccagccatctgtctttgctgcatggagtggccacaggacagagctgaaccacattttgtggttccacattagtaccctaatcagttatcgatgttatagaatcttgatccttcatcatactaaggaaaagggcaacctatgcccttgtccccagtcgtcagtcattatatagtacccaatgattgagacccaaagagacactccatagcaatgatgttttggctcatcctggattagtctggtgatcctggcaatgcctgattcactctgaacttcagtttccttacctctagcacaaaaacactggactggaacagtaacattaagacccatgcaacagtaacattataagccaatgtgcatgttaaagtcacattccattgattttcaaatactgagaaaatagccaaaaggaatggtgcgaagagaatggtgggtccttactatgatttgctctgactttcaataaaaat

SEQ ID NO: 159904 - DNA, 474 bp, Homo sapiens
tttgaagtaggcaaagttgttggtgttatcaaggaactgcaagaagaccagtatacatcaggtattatgatcaaggtgggcaagagtaatagctaatttgctagggcatttaagagtgtagagcccattttaaggattctagattttatcctgtgaccatgaaatgccataaaaggctttaagcaaggaaagtgatatgatctatgtttccagaaaatcactttgactgtttaaggaagtttaacaatgatacattttagttcttttccatattggtagttgactattattaaaactctaaaaactcagaattcaggatgtccttaggtagtagtaacttgattttgatacatatttttcagcaagccttgcaggacagaaaaagagagcaaaaaggaatgctttttggggccagatgacattttattctttggttaaaatgtcttcacttcctgtgaaacacgtttacaaaat

SEQ ID NO: 159905 - DNA, 227 bp, Homo sapiens
actggagatccagaaagcactggcccttgactccttgttgagcttgtgtttgtagattaggaagtgattcacaaaacgtggtgtagaagcgctagaaaagaaaattgggggctgggtatggtagctcatgcctgccatcccagtgctttgggaggctgaggtgggaagattgcttgaggccagaagtttgaggccaacctgggcatcacagcaaaacctctacttta

SEQ ID NO: 159906 - DNA, 252 bp, Homo sapiens
agcagggcaaggggagatcttccaaagtctcccaaaatctcctagagagacaccaagggaaagcttcagtgttgctgacacatagggttggtcttgccagagcagacgcctgctttgctctctgggcagcctccttactccaccttccctgagttctccggcggcctctggaggggatgcatggacagaaccagagctgagggtgggtccttcaatggctccagcagcaactgataggaagtgatagggatg

SEQ ID NO: 159907 - DNA, 290 bp, Homo sapiens
tctttcaggcatcactgacccaacagctcaagaaaaactgcattctgtgagactggtgttatgccaagtactttgcctaatcctgatgccacagggccaatctcattatttcccccctttccagattaggaagtggaaacttagagaggcatgtcacttgcctaatgtgacacagcttataagtaatggacctagataacaaaggggatttaaaagtcaagcaataagaaattcacatgcagctcacatcatcaaaggcattctgcatgactttggaattctttagtggg

SEQ ID NO: 159908 - DNA, 425 bp, Homo sapiens
aggaccacaggcgtgcaccaccacacctgactaatttttttgtttgtttgttttgttttgttttgttttgtagagacgggtcttgctatgttgcccaggctggtcttgaactcctaggctcaagcaatcttcctgcctctgcctcctaaaatgctgggattacaggtgggattacagagcaccatggcactctgccagactcaaggactcaggtcggaccaatcaacagcagccttgaggctgtggccggcccctccgcgaaccaggggaacttcactctccattagaagtcctaagttggctgctcaggagctgcaggtctggaaggtgacttggacattcgggaagaaaaaaaaccatttaaccaagttcccaagagaatccagcacttgaggctggatctgttaagggtcatgttcaccctc

SEQ ID NO: 159909 - DNA, 329 bp, Homo sapiens
accatcgtcacgtttgtgcttcgttgttgactgcaacatcactatgcggcacgtaactgtctatctgcttgggccttctaaaattgatattgaagccaaagatcttacttaagtgtaaaatcttatacatcagtttgtgccagactattcccctggataccatttctttcctgggcctcattttgggcctgtagactttataccagttttgtttggtctcttttccgttttctttccttctttcctacatctttatcattaccatgtcctggttggtctctagtttttaactctaggtactaatattttcatctttcttctcaatacac

SEQ ID NO: 159910 - DNA, 209 bp, Homo sapiens
ttaagacacaaaattgttctatagtggaacaccagcccctttgatttccccaagtggactgtccactggctgctatattacctacggtgctcagcaagctcttttcccatttctttgaacaacagagcttatcagtccaaccttgttctaattacttgctaccaagttttcacacctagaggcacaactatgtactaatgaaactttgg

SEQ ID NO: 159911 - DNA, 539 bp, Homo sapiens
cccttcttcctggaggtactttgtgataattctgagtggaaatggccccctggagaatcctgtactatggacttcttcttctcccacaaagattgcatggtcctcttgggctcactcccttgcctggcttctgccctctattgtaacactctgtgcaggaactgcatgggacctaaagcttctaaaccccttgctcttcctggtactgtcttttgtatcatgtgtgtttaatacatatttgtggctacttcctccagaaaaataaaggtatgcatcccaaataaaggtttgaaacccctaaccaatctcagaataaagctgaaaggttgtaggataaacattctaacccagctgaactcaggtggaaacccctaaccaatctcagaataaagctgaaaggttgtaggataaacattccaacccagctgaactcaggtggctacagcacctgtctgtaatcctctcctttatccttgtgaacgaatatggagaaggagttcaacatttcaacagaacagctaggtgaaatagctgagtaa

SEQ ID NO: 159912 - DNA, 482 bp, Homo sapiens
catcagtatatacacattcactaataatatcataatttttcactttatttgaaaaattattttaatattttgaaatacttcaaattcttaatttttgcttttatctagctcatttacataccattttggtgtttgtttgtttagttattttctttctccttaagagaatctcaaaacacattctcgattctccaggttgccataacaataaattgtgttgggggtgccaataatccacttttctttttctccaggtttggaaatagaggaacattcagtagcttctttagtgaatcacctcctaaatatggagctgaatctccaactgtgactgctgtttaccatctaatggatgttttatcaaaagtctatcacttggggcacttctgttcctattcttttttctttttctgggttcaaattgtaattacaaaaatatgtagttaggaggaaggagaagaatgagtcaaaatataagtggg

SEQ ID NO: 159913 - DNA, 287 bp, Homo sapiens
aaagtgctgggattacaggtgtgagccaccgctcctggccctcctctgccttcttggagggattaggtgtttgtattttcatggcatgctgtgcatacttctgccatggaatttatctcgctgtgttacctccctcctctgtctggcttactctaatttctgggagggctaggattttgtcttgcagctactcgttcttcacaccaggcaagtgttgtctccttatgaatgactccagtgtcttttgactaaagataagcattgaaattgcctgactagcccaagga

SEQ ID NO: 159914 - DNA, 169 bp, Homo sapiens
ctcccaaccaatagggtctcatagttcgaatactaccctgctcattgcagttaaatgattcttcctacttgaatgcctttgctggctccctgaagtctacaagaaaaatgatggcaataaatctgctccctccaagaagcagtcgctctctctttggtgttttcagttg

SEQ ID NO: 159915 - DNA, 1873 bp, Homo sapiens
  misc_feature (581)..(581): n is a, c, g, or t
  misc_feature (597)..(597): n is a, c, g, or t
  misc_feature (718)..(718): n is a, c, g, or t
ttcaacctgaccctcaaggagatccacttcctcaagtggctggacatctactgcccccacgtccccttcattttcaaaggcgacgatgacgtcttcgtcaaccccaccaacctgctagaatttctggctgaccggcagccacaggaaaacctgttcgtgggcgatgtcctgcagcacgctcggcccattcgcaggaaagacaacaaatactacatcccgggggccctgtacggcaaggccagctatccgccgtatgcaggcggcggtggcttcctcatggccggcagcctggcccggcgcctgcaccatgcctgcgacaccctggagctctacccgatcgacgacgtctttctgggcatgtgcctggaggtgctgggcgtgcagcccacggcccacgagggcttcaagactttcggcatctcccggaaccgcaacaccggtttggccctggaagtggacattcctctattactgtgaagttttatttatgaagaatttggagggagaaggctccaggcttcaggagggggtggtgtcctccctggccctcctcccttccctcccctcattccagctgcctnccctcagcacccccangcccctcacagcccagccccctccagagccctgccccaccgcaccctgcttctccagggcctagcagaccagcatctgccccggtgaagggatggatcagctgtgggggtgggtgcagaangttgccacctcctacctcagcgggagtcacctaggaaagatggagggattgacactattttctcaataaaatgggacttttttttttttttttttttttttttggtgtgaaacttcctgttcccagctgcatcagagagcctgtctggggccaaggttgccagagatttctgaagacacagcttgttccttgttcttggctggtgggtgcacaaggacttctggaagggatttagacggggctgagtgctaggattaaagtggggatgggagtacggcaacagaaaaacctgggagctagcaatgcacccagcccttgactgtgccctggtggacagccgagctgtggctctagcgtgagccagtgccttcctgtccctgccaagggtgaggccagagttggccccgaggctaatgtttcagtgggtgagattaggtcggccgtacagaggccggtgggctccctgacatcccttccaggcaacctgaaagcactgaaatagcttatggccctgtgccagggaccttggcccaagctgctgacctccagggtggggagggagctacccccaggagaagagtcactcagacagcagtatgagcaagccagccagcagctccgtgcctgcacccagctcaggggaatcccagggggttcagatgcccaggaaggaaaaggggacagcgctactgctatggaatgagaccaccacttctcctgttgtccttcccagcttctccccaacctccccttttccctagtttataagacaggagaaaagggagaaagcaaaaagctggaaagaaacagaagtaagataaatagctagacgaccttggcgccaccacctggccctggtggttaaaatgataataatattaacccctgaccaaaacgactggtgttatctgtaaatcccagacattgtgtgagaaagcaccgtaaaactttttgtcctattagctgatgtgtgtagcccccagtcacgttcctcacgcttacttgatctattatgaccctttcacgtggaccccttagagttgtaagctcttaaaagggctaggaatttctttttcggggagctcggctcttaagacgcgagtctgccgacgctcccggccgaataaaaacctcttccttctttaaaaaggtgtc

SEQ ID NO: 159916 - DNA, 549 bp, Homo sapiens
tgagtttggtaagtatttactgagttatgatacagggccccaggtacctgtgagggtctctaatcacctcatggatagtcccatgcccaagagagcttgtcattcaatagcaaataaaaaataagtgacaagttgagagagacacctgggaagaaagataaaggaattcattttcctggtgtttgaataaaaggcctgcattttcattttgttctggacaagtgataaagtcagccctgacaattgttaatagtgaactagtgcttggaaacaagcttcacctttggaacttattgattcgtttccataatttttacattttttttaaacatggtatatgaatagatttggttgtacttagaaccctaaggaattcccaaatattttataataagaattgtctttccacagattaaattgtttgaaattgagctatttatagccttatagtagtaacaaaaggaatttgaatttaaaatatggatttgcaaaattaatatcaaagttttacaattatttttaccctgaaattgttgaaaaaaaagcaac

SEQ ID NO: 159917 - DNA, 463 bp, Homo sapiens
ctcactgacgaggtacaaatgtaccgtcgtatagcaaagtcgatattctgtaagaatggcgcgcatgctcgctactgattacgttttacaacggcaggtgtagggaaacataaaaagacctcaagatgagaattccatctatgaaaaccatctaggctttatcttaatacccaaacttcgtatccatttttctatggaaaaaaatacatactctatatatttttctcaacttccaccaattctttatggaataaaggggatgagtgaattcattcattggaaaacacaggaaagtgaccactccttctttaaggcaaaaattagaaatttatttatcttcaattaagcaaatctctacatattgttggcttctttcttttcatatctgtaaatagttagactaccatttactactaactatagctccttgatagcaagcgccaggccttattaactcaaccca

SEQ ID NO: 159918 - DNA, 517 bp, Homo sapiens
ctcacagagggcctccacagtgatggctcgccgttggcgtgggctgatgtgggctgacggctgagaagctctgggcagaggcacgcccgtgctcaggcagtgaaggagggcagggggtgggggtggtgatccagacagaaagcccagcgcctggacatcccaggaaaggttgtgccggacgcccctgggtgcagagggaggagcaggcaggatctggtcagttcacatttcctccagctgaagattctgaccctgactcagagccctcaaggggcatggcaagcataggcttttctacaagcgaggtccctgagagtttaggcattactggttgaaatgctgcaacggggcaaaaaagagaaagctggggggaataatagcagtgctacttcataagagtgtggggttaaatgtggtaatgcatttaagcacttagcacagtatgtaacacgttataagtgatcaattaatgttactatgattctcacatatgatcactggttttatcccaatctct

SEQ ID NO: 159919 - DNA, 166 bp, Homo sapiens
ttttggggagttggaggcctgcagacctttctgcagcagatgcataataaaatcttagaacagtctgctgtatcctgctcagctccggatcccatttccaaatatatatccattttccccattttttaatcctaggggactctgctcttcattgggttctttttgt

SEQ ID NO: 159920 - DNA, 236 bp, Homo sapiens
cttgttctttattccctatgaatagggaagttcagatgattattgtacattattggaagttaatatcacgtctacgtcttgatttagaactaaaaaattggtcctctgccaggagacatgaattaagaaattgggaacaaattaaaataacatttcagttacttttaaacatatttgtctttatggttgtgtttattacatgtgcagtgaagtggagaattgaggcagttatttca

SEQ ID NO: 159921 - DNA, 423 bp, Homo sapiens
tccacctcagttcggtcctcagctccagcgactcataggaacaccacagatgcacgaaaagcagccgggtcactcctcatggaaggcgtgccagccgggcacagcaggtcccatccgtccttctagggcggccagtaaagagcctttctggtaataaatgtaatgaacatgtgatcattctgctgactgcagcctgctaacaagcttacgattaggatcaccgagattctccaagtgcccgagtgtctcagcctattacatggaggtgacacgctctcataccaccctgggaaatgcaggatggctcctggcagcacaggtggcagtgggcaccagtgggcaaggttagaaaggcattgagacccagagcccagagtggagaccaggaccctgtgtttgtccagaacaacagtgtttccaaag

SEQ ID NO: 159922 - DNA, 191 bp, Homo sapiens
ataggaattgcttggcccaggtcactgaagcattttctgcttactttacttaggaacgtttttgggggtatgttgaacagttttcatgtttcatataaaaacacgtcagatgtgtttatatgtttttgaaaaatgtaaaacaaggcttgaaacgttccattgtatgcgtctgtaggatacacattttgaca

SEQ ID NO: 159923 - DNA, 238 bp, Homo sapiens
agctcggtgacctggcatcctcctagctcatcctcaagaggccttttgggccaggtgtggtgactcacttctataatctccgcaactttgggaggccaaggtgggaggatggcttcaggccaggagttcaagaccaggctgggcaacacagggagaccccatctctagaaaaaatttaaaattagctgaatatagtgatgtgtgcctatagtctcagctacttgggaggctgaggcag

SEQ ID NO: 159924 - DNA, 241 bp, Homo sapiens
gaatgccaaaggattacattagtaatctctgaattattatgcttttatggaagaactattcctgaagttactcaaacccagtagttttcaagtgtggtgctcagatcacctgcatcaaaatcacagttttcaaaacttttttccttgagataaaccttacatataataaattgcataaatcttacgtataatattcaatgggttttgacgaatgcacacaactgtatgacccaaccccatc

SEQ ID NO: 159925 - DNA, 344 bp, Homo sapiens
ccacctgttaaagcacaccagagataggaaatgcaagagaagcagtttagggtataggtagggaatggaaagtgagtccagtgtggaaattgtggaatttgaagtacccagagggagcgcaggacattttgacatcattttgagctcttgtatgttttgaccctgctgttttttttgttcttgaatataaacattgccgtcaagatgatatcaacactgatgaattttgtggtaaagatttattccagggttaacttcgttaagctagtttaatttattgacctatttcctatattgcaaatttaatcttttccaatttgttccctcctgtattgttttactag

SEQ ID NO: 159926 - DNA, 207 bp, Homo sapiens
gctgccttcgtggagcccgaagagggcttggccctggcctggacaccttcaccacccctagaggggtgccagagctggctatagttgcttccgagagctgactgggaaatgttcccatgtaatcatgttcatggtttgaaagccaccatggtgggagtatttacactttggaaactctggtaaatgctacaaacctgggctttcctc

SEQ ID NO: 159927 - DNA, 644 bp, Homo sapiens
accccatgtaaaaggaagcatttgagagtcattaagcagaacagagcactgccgttgccaaggtgttcctaatagcgtcttggttgtcctgctgccggcaaggccagagtgtgacgctgagtttcttggagctgcagactttccaggaaggaaagaggtagccacacttgagaacttagaatctttgagaagagggcatctccaactaaggaagaaaaggtcactctcaaaacaggctccctaaagaacagattcctaaagagctccaatcccatatttcagaccttcccatggacattccagaatcttactcttaggcagagcagaaaaaatagcagtagcagcagcagtgtctctcaccatgcaagtctaaataggtcttaacagctcagggtttgagctcataaacaaggtactgaaatttttctttgatgtcagtaatacatcccaagatccttttctccacatggtaatgtgtccctgaattatagttgcaggctagaaaggttgcagagtgagcggagtagcatactaatttttgcatgtgcacacacagtctcagagctactggaagctcaggaggtcatcctgaccctttgtctgccttaggcaggactacactattaccattccctctccacaaa

SEQ ID NO: 159928 - DNA, 540 bp, Homo sapiens
acatgattgaattaatagtcagaatgtctattgagtccactttctctgaatgactgcccaactctccttgatggtggatgcaataggattatctccattgcatcattaatcaagtagaactgcctggaggtagcatgggccaccacctgagccagggaagtattttcagtgtatttcagagacactgtaatattgaccctggtatggtttcattaatagagaatggcccaagagctctttctttctgcatgaagggtagatttggttaatgtcgatgtaaataacttcccgtctttatcagaaatacgcatcattaactcatcacaggaaggacttccaccaccatcagtcaccttctcaaacatggacccagactttcttcctcacccttacttcctggtgattttaaacctcctaactaaaggaccaacatccctgctgaagaaacttaggaaactcacactctcttgatccaagagaaaactttctttctagaccccagtaacttggcattatttacctttccctctacaaaatcct

SEQ ID NO: 159929 - DNA, 587 bp, Homo sapiens
actgacgtaggaggtgggattaaactctggaagcaaggctcagacactagaccaaattgaggactagctaaaacaggtcagggcagaagtaactccctgtaagacctgcccaccagtgtgccatgtcagtctaccattgccatggcaacatccagaagttaccaccccctttttttgtttgtttgagatggagtcttgctctgtcgcccaggctggattaaatcaaattcttacttcgcaatgacagcagcagcagagctcattttcgtacggagtgtgtactgtttctgtaagaattgacataattagcaaagtcttgactcctgtgtaaattccatcagagtgcggtacatctggtgtttctgactctgggatccaggggaacagcttgagatggccttccccaaacttcccctggaccatgggatgtagggtaggacacacccattacccacagaagcattctgtggtatattaaaagactgtgagaaatgctgggttcaacaatgggaataaacaggtgtctttccagcaggacttttcagaacctttaatatgctgatttgccttttaggccctctaaagca

SEQ ID NO: 159930 - DNA, 404 bp, Homo sapiens
gctgtcctcagactggacattagtgaatttggatcatttagtctgggaaagtttcaatgaagaccccagtgtcaactgggagttttgcccccttgacacagagcttttatgacgtagttggtccaactacatgcaagtgagagcaaggatggctgccccaaccagtagttgtaatttctaaaaccataccttcattttactaaagatatagctccccctaactttcaggtaaactagtgcaactcaatacaggttattatttcaaaccttcaaagttcttccccttctctaagcgaattcccttctttaagctggttttatgatatgggagctgagttttcagaaacagaccctattggttctttgaaatatgcttcatttctcccctactgcttacagcttcc

SEQ ID NO: 159931 - DNA, 239 bp, Homo sapiens
aatttgggcataaaacatggaaaaataatatctacaatttgggcagaagtagaactttagagatttcctagagctaatttcaaatgtacaggtgattttggcataaaaacagacatacagaccaatggaacagaacagagaaaccagaaaagaactgattcccaacgacgctgacaagaatacacaatggagaagcacagtgtcatcaataaataatatttggaaaacttgatttccac

SEQ ID NO: 159932 - DNA, 562 bp, Homo sapiens
ctccagcctcagcctcctgagtagctgggattacaggcgtgtgccaccatgcccagctaatttgcatgtttttagtagagacggggtttcaccatgttggccagactggtctcgaactcctgatctcaaatgatccacccacctcgacttcccaaaatgctggaattacaggtgtgaggcactgctcctggtcaagcaaccagctttaaaaagcatagaattcaagggtagagcagagctgcctgacagctaaaccaatagatgaattccctgtaaattgcacagtgctttaagatcaggaaatacttcatctagggttcttccctattgctgttaatttggatgaacagagcaatttaaagatgcatagacttgaaaaaagacagacacttggattctgccccgtgggttgtttaagctctgggtggtaagaacaggccacacagctagggaacactatgcattgggtcagcacatctaaaacagctactgtctatggtaatcacaatctatggttccaatcaaagtgagaaattgggggcacgtggtctgaccaagacta

SEQ ID NO: 159933 - DNA, 561 bp, Homo sapiens
gtgaacaacagctctagttcatttgttctcattgctatagaataatgacaatttgccacaatgtatatatccattgaactggtgacaggcattattaatcttttttttaatcttctgatacgagccccacaaagcagggttcagagtgcagggtagtagaaagagcacagtccctggagtaacaaaaatctgttttaaactagcttctgttaataactatgtgtccttctacaagttatttggccattatgggtcttgacttccacatctgtaggatacaaataataataattgaaaggacataaaccaagtacctagtacatggtagttattattgtaaggcttataaaatgtttgctacagacttggaaatcacttacggattactgtcacatagcttaattctttagcaccttggccacttgatcttccctgctaatgcactctggtagccattgaaacccaaacatggaaattcaaattatttggatctatcaatgggtggtttgctgatgtttccttcccctctttcccagagcaagcactggcctttggaatgca

SEQ ID NO: 159934 - DNA, 386 bp, Homo sapiens
gcgggtgctctgaggatcccgaaaaccaattgtaagtatagtaggcataatttgtagactgcatacttaaatatacaaagatgtaattttctttctttctttctttttttttttatttttagagatgacttttggtttgtttgttttttgttttttgaggcagtctgcactccagcctgggcaacaagagggaaactccttctcaaaaaaaagaaaagaaaaaagaaaataatatggtgctgtgctatgggataatggggaatacctactttatatagggtgttcagagaaggccttgaaaagaagaaacatttaaactgaaattaaaggctgagttgaagcaacctattaaagagctgtgggaaaggcatcctaagtgaaggaaa

SEQ ID NO: 159935 - DNA, 235 bp, Homo sapiens
tgaagggttgggagggtgaatgtgagaaattctgtactgagaaattacttaatgggtacaatgtacattatttgggtgatgaatacccttaaaagccctgacttgaccactgcatgatctatgcatgtaacagaattgcacctgtaccctataaatgtttacaaatttcttttaagttttgagaatcccttgtctaagccacgacatagacatgggtatattttgctggagatca

SEQ ID NO: 159936 - DNA, 281 bp, Homo sapiens
aaccaagcacagactcactatcacgagagcaacactgaggggcaaaatccactcccatcatctcatctccttgtaccaggcccctcctacaacactggggattgcaattccacatgagatttgagttgggacacaaatctaaaccatataaccctcatacacatgtattgtaattcagaatttgtcattttaaaaaaaaatttttaagattagcttatcaatttaaatgtttccagccctgaactctcaaagtcaactttaatgagttttgatttttgccg

SEQ ID NO: 159937 - DNA, 383 bp, Homo sapiens
atgggggtgtctgattggtgctgtgacctgcggcagcacagccgcctgcgttgagtgcccacggtgggctggacattgcactaggtgctgacaggaccggcagaggtggccactgccctcgtccccagcctgcactcctgggcgaaggctgacgctgaacaggtacttgtaagagtcgccgaagtgcgtgccgggagggttctgggaagaggcagctgtggggcctgaagcctaaatgtggggtgggaggcatccaggctgcggctccaggcagagggcacagcccggctgtgagccaccacgcctggccccaagggccttcctgtgtgtccaattctgggctcagaaggtggggctgggctcagaagcagggggtcaccctg

SEQ ID NO: 159938 - DNA, 282 bp, Homo sapiens
gggaaaagaacattgatctcacttggaaaatgccacagtcagaaagctcgcagtcctccaatacatggaccagagaaagaaatttcttcatcccctgggccaagaggcaaagaagttgtttcaaagcctaacaagctcagtggccactttgtccttctgaacatctcaacgtagaccatgaatgtgaaactagggtgcccagcacaaagtgagctgttgtgattcttcattctcattgccaaaattcagacatgcagaatgagcatcaccagagaaggagca

SEQ ID NO: 159939 - DNA, 631 bp, Homo sapiens
atggaagaaagacaaatgttgtataagtttagtgcagtgttaagcgaacagtgtttatgaagcctgcagtagtgtaatgacttaggccttcacgttcactcagcagtcactcactgactcacccagagcaacttctctcgtcctgcaagtgccattcgtggtaactgccctatacaggtgtaccattttaatcttttacaacatatttttactgtaacttttctaagtttagccatgtttaggcacataaatacttaccattgtgttacaattgcctacaatattcagtatagtaacatgctgtacaggtttattgcctaggagcaataggttataccacctagacttgcatgagtatactgtatgaagttcacacaatgacaaaatagcctaagaacacatttcaccgaaggtatcctcatcattatgcaatgcataattgtattttgaaatatcttgtacattattaataactacagtcacctaactgtgcaatagaacatcaggacttattcctcccatctaactttaactctgtagccactgacccatctctcacaatataccctccccgtgacgctacccggactccggtaaccagcattccactccatacttcaatgagatcaac

SEQ ID NO: 159940 - DNA, 289 bp, Homo sapiens
tgggtgggaaagggagctcggagtaaacactgttcaatatttagtctgatgtccatctcagtgtctgtgtctttgtttcaggagtctcttgagttccatttctccagagaccataccacctacctccggtgggggaagggttgtcagcaggtaaagacggaacgtcgagttataactgactctaacacagacttcaaataatccctgttttcagcctctctccttacctgtgccatcttggtgtttccagtgtctgaatatttccagagtttaacatggtgacttagct

SEQ ID NO: 159941 - DNA, 511 bp, Homo sapiens
gttcattatgtatctccagactatagagaagagcaaccaggagagtcattgaggagactgatcagaggatacagaggatttctttgaaaggagttactggcctagaggtcagggctattcctaccctggacctgaagtcaagtcagaagtctccattagccgcagtgctgccctgtactggagcaaaagatgctgagagagatctggaaaaatgtgacctgtgtctcctggagttaagggagtgcagagtccacttcccaactctttttcttttttcttttttgagaagaagtctcgctgtgttgcccaggttggagcgcagtgtcacgatctcggctcacctgcaacctctgcctcccgggttctggcaattctcctgcctcagcctcccaagtagctgggactacaggtgcccgtcaccatgcccggctaattttatcctttttaatattcatacaccaagtgggggagataagagacataagcatatgataccaaatagaccataaaa

SEQ ID NO: 159942 - DNA, 182 bp, Homo sapiens
gtcgacgaaactgaagcagtccctgcccccttccagatccgcagtcccctgctctccacgcgagcccccttcacagtccctgctaccttgtaactaacttgcacttttcccgagtccggttcttagcctttgccctgcagctcagctccttaaagctttcagatccccaaacttttattgta

SEQ ID NO: 159943 - DNA, 373 bp, Homo sapiens
gtaaaaagggagatttagcccaaccccctaattctcgagataagggagcagagatcaaccaattacagagtaagagaattcagacttgagcccaattcctgttgctgagtctatttctgagtgtatagtgatataattcaaggcaaggggaacaaaattaataattctccaaacaggaaccttgatacacccagcataaaaagtcttgagaaatcgttgacctttgggattggatcaaaagtcaacatggtcaccaagcaaagcggctttgtttcctctccccaggttgttaactaagtcagatacctgatcctacacacagcctatccgagccagggccaagccatctgtcaatttgtttcagctacacgac

SEQ ID NO: 159944 - DNA, 120 bp, Homo sapiens
aagtgctgggattacaggcgtgagccacagcacctggccttttacaactctttctagagtaaaattagcagaaacagtggtagagagaaggaatttggccaatcacaaaaatttattttg

SEQ ID NO: 159945 - DNA, 396 bp, Homo sapiens
aaatcccagcttttcttcatgccgccacggaaacggcgtcccatgcagaactgattctggctctccttagaccctcctcagactcctttggcgggaaactaatcttacaaaggaggcttcctctttccttttccagtggcattccaagcttcctttggagtgccctccctcctgatttacaaattggcctgacgttatcggagtacaggcttttttctggtggtttctggcctaacaggagacagattagtaagtaccaggatctctaataggtcaactttcatgatctctgctaaattctcagctgtttagacttacaatttttaacagctaaaaggaaagacaaatgctatctaaaactgtcccatcagcccatttacagggagcacctccccc

SEQ ID NO: 159946 - DNA, 529 bp, Homo sapiens
aatgattatttgtgagctgaaggtgtcccaggaagcaaacctcaaacctcctctccttctaggtccttggcctgcagcttgcctgtggaataaaccaacagaggaggtgagaaagtaaacggcagctgaaagcatctgcagctctgtcccgccttggctgagggaacactctgccagccagctcctgccctcaccagaatgcacttcaaaagggaaacaaatgacaatcagctcttcagaggctgctctgcttgatttaagtgtgtgtggccagggactctacaaacatggaagattggattgttttaattataaagggtggggtgagtagaaagaaaatgaaaaaaaaaaagacagtattttgaaatcctaacattaaaatagttattctggatgcagagaaattgctttctctgccaaaaccctgagggacttcagagagagaatgccgaattatttaccttctttacgggggacggcggggggaacaaaaaaaaattactgatgtatatttctttttaattcggtg

SEQ ID NO: 159947 - DNA, 109 bp, Homo sapiens
ggttgtcacaggaggtgcacgatgtgaagtcacaaggggacgcattatttccatgagttctcacagttcccagggcagccacagatggtagtggtttatgtctgcctct

SEQ ID NO: 159948 - DNA, 237 bp, Homo sapiens
ctgataggtttatgtgtggtttggggaatgctctcaagtctgccacattttctgctctgatggctcctaaatgggtgcagcttagcacatcttcacagccttatcaactctctgagttgattgtgatccatattacagagcagatatgtttccgtagaaaaagtggatccccactcagttctggtgcagtagtgcaggagtaccacttaggggaaaagcagggcataaatccaaagt

SEQ ID NO: 159949 - DNA, 537 bp, Homo sapiens
aatttcagatggtgatacaatttaggagtgttaaaaaagtaaaattgaaggatgtgataaaataactaggaaggcaattccaggttgcaaagttctcagaggtaatgcaaaagataattttgaagagatagtgcacagagctaaagacaatgtttaataaagtgactatcaagtcaaaccttcaatgaagtctccaaaactaccagaagcaaaaaattaccactcattccctgattatcagaaaagataactaaggagttatctcagtcataacctaaagcagtaagttatatagttagtcaccagatggcaagtatttccacatgaaccaaactattgaaggcaatgggccaaccaaattaattcttagatgccccagcacctacatcagtgcttaataaattactgctgaacaaatatatgacggaaagaagaaaacaatgttaagatgtcactgccatgagttaaataaatcccttttctggccaagtggcttcaattcactccaccctacccctgacacccgtcttaatcaca

SEQ ID NO: 159950 - DNA, 238 bp, Homo sapiens
tttgttaactggcccaagaaacaaagactgcatcttatgaagataatccctgtatttcatgctgtctttattagggtttttggttacttaggaaaactgggctttagaagggttaagggtttggggtttttgtttgtttgtttcccatccatgtaactttctgtattgcttttgaaatcttttgattattactgtggttaaattaatgactattatttcacaatgacctatgattctg

SEQ ID NO: 159951 - DNA, 403 bp, Homo sapiens
aaaaatgtggactagcggaggtttcctgatgtggtgtaaagaaaacagattcaagagaattgaagatttttttggtttctgggtacttttttctttttaaattaggactaatgtttctttggtggcgcttgagtccacctaaagcgtttggtttcattcctcaggaagtgagaagccacctgaaactttcaaacagggataaacaaggctgggcgcggtggctcacacctgtaatgccagtactttgggaggccatggtgggagggctgcttgatgccaggggtttgagaccaacctgggcaatgaagtgagacccccatctctataaaaaattaacaaattagccgggggtggtggcatgtgcttgtagccccagatacttcggaggctgaggtgggaggat

SEQ ID NO: 159952 - DNA, 381 bp, Homo sapiens
attccagattcctcaaaaaattaaacacagaactaccatatgacctggcaattccacttttgggtatatatccaaaagaactgaaaacagggactcaaacagatatctgtacacccgtgttcacagcagcaccattcccaatagcaaagccgcagaaaacacccaaatgtccaaatgaacaaacaaaacgtggtgtatacatgcaaggagatatcagccttaacgggaaagaaatgctgatctgcccgacgacacagaagaaccttgaagacatcatgctaagtgaaataagccagtcaaaaagggacaaatacatgattccgcttatataaaggacctagtagaggcaaattcagagacacagtagaacagtggttacca

SEQ ID NO: 159953 - DNA, 160 bp, Homo sapiens
ttttatttgggaagttttagttctgtatagttaaggcagattcttcatttgcaacagttgacattgggacatgtgtgaacatcttcaaggtattaggacatcttcaaggcattactttttggcagtgttgagaatttttttttttttttttttttttttt

SEQ ID NO: 159954 - DNA, 363 bp, Homo sapiens
atgttccccaacaaaaaaactaacaggaaaaaaaagcagccatgggtcctgttggacaaataatcatctaagttatctacacagatgtcacaacatgggagctaatgcatttcaggcaattctccagtatcaaacactcatacagccacaataggtaacattttcctatagagaaagcacttttaaccttacagtgagtgaataaacagaaacagtgcttttagtcaaaattcttttaaaagctttgtcactggaatttcttaatgacacttgaaataatagtttccacggattaaaaaatataccacagaggccaggcacagtggctcaatttttttattttttagtagagatggggaacag

SEQ ID NO: 159955 - DNA, 349 bp, Homo sapiens
tggtgctggtcaccccaccgaggtgcctcatagccaatcggactcagcagggtgtgctcctgtcctggcttccgcctgccaaccacagctttcccatcgaccgctacatcatggagttccgtgtcgcagagcgctgggagttgctcgacgatggcatccccggcaccgaaggagagttctttgccaaggatctgtcacaggacacgtggtatgagttccgggttctggccgtcatgcaggatctgatcagcgagcccagcaacatcgccggcgtctccagcacagacatcttcccgcagccggacctgaccgaggatgggctggcgcggcctgtgctggcgggaatcgt

SEQ ID NO: 159956 - DNA, 404 bp, Homo sapiens
cacattctacttatggagtcttgatcaaacaaaaaagcaagcagaagaacctgaatctgacctagctttagatccaacatccaatttacaggaaatacatgggataaagaaacatgttaattgacaccataaggatgcaaccagcaaaatccagaccatgagaatctccaaggacaattggcccagtttcctgaacaaataagttaaaagggacttcaaagacaaagcatgggccggccacagtggctcactcttgtaatcccagcactttgggagaccaaggtaggtggatcacctgaggtcaagaccagcctggccaacatggtgaagcccccatctctactaaaaacacaaaagttagctgggcgtggtgtcgcactcctgtaatcccagctactcagaag

SEQ ID NO: 159957 - DNA, 207 bp, Homo sapiens
atgatgaacatgagagatgcccagcacacagcctgctcgccgtaaacagcaattcttcttaccaactgctaaaggccattcgtgaaatgcatttctctggaccgtgaagcctcttagaaagaagccgtgacagcagcatttgtgggtcgttaggtcaggtctttgaaggatgtggagcaacagaaaccctcattcattgctggtggg

SEQ ID NO: 159958 - DNA, 715 bp, Homo sapiens
agaagatgagttcttgcttcatgtccgtgaaagctcctttcctctataactgtgatcatcccccttactcctcatggatcatacctcgctctcctcagatgttttaatatatccttgagatggggtcttgctgtgtcacccaggctgaagtatactgagtggtacaatcattgctcactgctggccttgaactcctgagataggaggcgatccccccatctcagcctcctaaagtgccgggattacagacgtgagccatcgcatccagcctggaagtattttgaaggttcagtgtgaggcatttgctgacagattgagttggagagaaatagaggagtaaataactccaagggttttatcttgttagaaggatggtgttgccactaactaagatgggaagcctgtggaagactggtttttcagggaaggtcaggactttgtgaacatataaaactgcagatggctattagatatccaagtagagatgctgaagagatgaatgtatatagaagtctgaatttgggagagagatctggataggagatacttacctggtgtttaacagcttacagattgtgtaaagtcatgaaacggataagaaccttaaaagagagaaaagggaatagaggttaccaaatgaattgcagtttccaaattgcagagggcagagagacaaggagaaaccagcaaaagagagtaggaaagaagcaactag

SEQ ID NO: 159959 - DNA, 480 bp, Homo sapiens
cgttatgaagattatgccagatgcagaagcatgacccgtgccggccagcgcaccaggttcaaggcatttgctgacagattgagttggagagaaatagaggagtaaataactccaagggttttatcttgttagaaggatggtgttgccactaactaagatgggaagcctgtggaagactggtttttcagggaaggtcaggactttgtgaacatataaaactgcagatggctattagatatccaagtagagatgctgaagagatgaatgtatatagaagtctgaatttgggagagagatctggataggagatacttacctggtgtttaacagcttacagattgtgtaaagtcatgaaacggataagaaccttaaaagagagaaaagggaatagaggttaccaaatgaattgcagtttccaaattgcagagggcagagagacaaggagaaaccagcaaaagagagtaggaaagaagcaactag

SEQ ID NO: 159960 - DNA, 419 bp, Homo sapiens
tgcggatcccggggaccggcccctgcgcccagatccccgctggtcgcgcaccccctgccctgctgcagccacccggccccgacgccgtaccggacgccttagacgccctcgcctggcgctgggggatcccagccgccaagcccagccccgccgcgtcctcgctggccccggcgtcccctcgtcccgcgggccccgcgtggcagggcggctgagctccgagcggcggtggccagcgcggcggcgccttttatgcggcgcagccgcccttcccggcgccggaatgtgcccgcgccgcgctggcccgaccggtttttccgggcggggcggctcccgggcccataggtcccgcgactgatcctccacggcccggggacctgctccgcgcgcccgcgcgggggtggccctgactcagcggccgc

SEQ ID NO: 159961 - DNA, 206 bp, Homo sapiens
tcaagatattcaagaaagtcctgaggaaaataataaaatgattacggagacataggatttatgaaaacagttggaggttctcagtgtaaacagatgaagcctaaggaagggaagaatggcaaatctaatatatttgagagtcagaattgccaggtgaaaaacaggacgtaggccgggcactgtggctcacacctgtaatgacagca

SEQ ID NO: 159962 - DNA, 551 bp, Homo sapiens
taagtaaatccagctccccaattaaaactagctcctgtcccaccatctcctagggccaactacatgtgcctggcacatgaaagacaagaattccaaatctgacatttccatgaggcgggtactgttaccacattcatggaagaagagactgaagttcagagtagccagggagtgaaagagacaggtggacctcttcttactacactctgtggccttctcaatcccagctgggcttgattccagaccagatcccaccctcctctgtctcctccttgggtagggccctggtgtctctgccatggaggcccgtctgtgagactgggttgttctctctggtctctggccttcaggtgggactgctttctcagcccctcctctctggcaccaggtctctgccactctgtctacacaatcagtcttggatcctgctgctctgtaattccaacctcgaatgtcctttctcttccctagcctaaatcctcgattaggctgggctcagtggctcatgcctgtaatcccagcactttgggaggctgatgcaggaggatcgc

SEQ ID NO: 159963 - DNA, 629 bp, Homo sapiens
ctgacattttatagggggacatgatggtaatagaggaatgtatttggagcaagtaagaccctccttttcagtgccctagaaaggatgattctaacaacccccagatgttgctgacagatgtgtttatgagtatgaacaaagtgctggatattattagtacccgatgttactaatatcactagaattgaatgctattctaaatacgtagtgacattatgtagcattaatgaagatgaggagtagggataaaataagaaaagtcaaacaacagcaggatagcaagcaaagaaatactgtttctttgaggtttgtaagtgcgtacttcagggtgttcgtttctattcatatttctatccacagaaatttctaaatgctacagagaactttgaaattaccttcatttacataaataatgtttctcatttttcgtactctcttaatcttaaaaaatctgtttttcttaaattttgtgtctgagttaggtgaaggagtgtgttgaaaattcagtttaatagactagcaggtaagtttaaaacactttgtttatcacaattgtattttggaagtcccatttataagaaagtatgctataaagatgtacctcattattcgtaataaaggttttcctt

SEQ ID NO: 159964 - DNA, 525 bp, Homo sapiens
  misc_feature (374)..(374): n is a, c, g, or t
gactacatacttccgcatcagaattgagtgtgagggctttcgtgcaaccagctgaaacacaaagctactcaggagaccagtttggattttaaatgttctcaatccagactaaagacaaccaagtattcttctcagaaagtgataggaactcctcatgccaaaagtttggtgcaaagattccgagaggctgagtccttcacacaactttctgaagaaatccagatggcagttgtatggtgcaggagctgcgttcctttggaggaggagaggcactctgatttttagttttcactttttctgctctgttattttcccatgtttgtggttttatctacctttggtctttgatgatggtgatgtacagatgggttttnggtgtggatgtcctttctgtttgttagttttccttctaacagtcaggaccgctcagccgcaggtctgttggagtttgctagaggtccactccagaccctgtttgcctgggtctcagcagcagtggctgcagaacagtgcatattgatgaac

SEQ ID NO: 159965 - DNA, 820 bp, Homo sapiens
gactacatacttccgcatcagaattgagtgtgagggctttcgtgcaaccagctgaaacacaaagctactcaggagaccagtttggattttaaatgttctcaatccagactaaagacaaccaagtattcttctcagaaagtgataggaactcctcatgccaaaagtttggtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactagtttgccaaagaaactagagtgcataaaaacgtctatttgcaaccaccttcttcgtggctcaggtatcaaaacttcaaagcatcatctgagacagagaagatcacagaataaatttttacggagacaaaggaaaccacagagaaagtttccggtttcggagagaaagacttattgtgtgtgcgtgatcaagtctgttttaaagattcactcgctgctttcatctaataacttctggtttttcataaaatgctgacatcttcattggaaatttttttcatgtaactgttttcattttcagaaaatatataagggggtcattccaaagttcagaatgatcctatttttttaaaaaacaaaattcctgtaaaacaattaactccaggaacttaaaatttactccaagacatttccctcataacaagcaaaaaaccccagcaaagatcgttacatcacaaaccaacacaagaccgcctcggaagtatgtagtc

SEQ ID NO: 159966 - DNA, 156 bp, Homo sapiens
ggaaactgcaaaggaacaaattgaaaaagaaaagggcagataagaaagcacaaggaacattgtttcaaatctgctcaagactcaaggtgaaagagagagtagaggaagggcaaaggacaaagaacagtagatgagagattctgagggggaggaagg

SEQ ID NO: 159967 - DNA, 392 bp, Homo sapiens
taaatgtctcgttagcctgtcattcaatgctaaatactctagcctcaaagggcttttctggcttttactctccttgtttccaacatatttcagccaaccttgactattccttatttctcaagtaagttcaatttttcctacattttcttatgtttctcctttcacttggaaaaaaaggaaaatttactgaaaaccatgttcctgtaaatatttccacctatagatattctcctctttctaatgcctcactatgtactgctatttttctctttttatcccaaatgctatttaatttcacttagagatttaggaaatcatccttttatttgactcctttcctccagaatatgtcctctgagcactttgaagctttcttatggatgtgtaccatg

SEQ ID NO: 159968 - DNA, 341 bp, Homo sapiens
tggtctctttcctccccctgccagtgccacctgattgcagcagtggttgtggggtaagggggtggagtgggcagggccctgagcaggaccagcatgagacagggagctggcagccaaaaacccatcccaggaaggcaggacggcatcaagctgaggttccaagcccagcacatgctccacagtcccatcagaccttgcttacaaaatactaattccaagttaaagttatttggaattacaagactgtgactgcagagaattaaaccaagcatggagcccatcttcatatgtccatcaagatagccctgaccaacaacgaatatgcaaaggggagatgttgg

SEQ ID NO: 159969 - DNA, 469 bp, Homo sapiens
ccaaattagtagacagagataataaagattaaaatagaaataaatgaaatgtagactataaaaacaccaaaaaaaattaatgaaaaaagttggctttttttttgaaaatcaacaaatctttagctagactaacaataaaagagagaagacacaaataaataaaatcagaaatgaaaaagaagacacaactgagaccacagaaatacaaagaattataaagactattatgaacagctatatgccaacaaagtggaacatctagaagaaatgaataaattcctggacatatgcaacctaccaacattgaaccatgaagaagtagaaaacctcaacaaactaatacctagtagcaagattgaagccataataaaaggtctcccatcaaagaaaagcccaggacttgatgtcttcactaccaaattctacaaaacatttaaagaagcaatacaaattatattcaaactcttcc

SEQ ID NO: 159970 - DNA, 374 bp, Homo sapiens
ttcaagttgatacactgacaaaatcagaagcatgacattttagttttaagtcataacctgtaactggccagtatcttgttaacggtcttatcaaacaagaaaaataatcacaggagtatggatctgtatcaggctatgaacataaagggatccaatatgaaaaaggattggtcaaaaatctctcctggagatgcaggtctgatcaaactaaaacgggcgcggatttctctgaagccactggatctgtccagagagccaaccagggaatccaaggagaagagaaagaccagcaaaactcaaccacatccaggatgctcgtttgaaccaattttctcagctgttcctaatccactttgacagagaaggaagccatg

SEQ ID NO: 159971 - DNA, 458 bp, Homo sapiens
tcacgggtcctacaggggctgcatcccatcacctcccacatctctgtcccaccggactcgggcgaaccttatgtgtgcacacaataagaggaaccctggaccagccctactcccagcgatcaggtgatctgcaggtacctttgaggactgggcacatgacttagcaaaggaacttcagatgctttatgtgaaagctgcctcaaagacggtgccactcctgcaaactgtgagtctctctactacatgcaaggcagttctcgaaggcctgggaaggatagtcagggtgacccacaggttctgttttcagcaacaggctctgccccaataaaacaaaactaagagggatactagaatgcctccgagggaccaggcactgcagactgagatcctcagctttattcgaatgtacttgtttgttcctgagaattacgtgctggccagcaccccagggcgagctc

SEQ ID NO: 159972 - DNA, 515 bp, Homo sapiens
tcagagggtacagcacaagcaactggaggagaagctgaagcaagcagaggcctggggctgcagctgggaaagttgcccgcctggttgactacatgattgtcagagcctcatttctgtcttggaagagcagataacctcttttgtggccaacatccttcaagtgaggtggtgggtggcatgtgtggaggtggcaggcagtccagggccagatgctgaggaatgtatactgacatctagcccctcgacctttcctgacccttttttttacaggccccaaggcagaaaccctttctctcatcacagctggtctttgatgatcatggtcaactgtctcatgtgccctgtgttgaaaatatgatccagactctaactggaggcctacagtctgtcaagacctctgccttgcaggtattctgaattgggcagagagctggctgtgggaattcccagttcctatcctctgagtaatcagaagctcacaacctggtttgaatccctcattgcttgttccgctg

SEQ ID NO: 159973 - DNA, 694 bp, Homo sapiens
gttaaagcccacatgcctaagaccagtttactttttagtaaggtaaattttgtttacttcaccatgctaaacatctgaagtcaatatgagcttatataaatggatttttctgtaattaagtagttttatttgatgttgccatatttaaattttaccttaaattatctcagcatacatgttaaaactgatgaatcatagctttcagaagtaggattctgttttttttttctagttttagagagggatagagaaaactcgtttagcgtgcggagtactttttgagaagtcaagccttacatagcctacatgactgttttacttggagtcattagaatgcttaagggacagcgtcataggttgccaagcttactgaaaaagaaggaaaaagacaccaaaaaggaggtgattggaaacttagagcaactgttagaagtttacctgtgaccataatgtcaataactacctgtgtagcgttaaaaatcattcctaatgcagtctcttgtgctatagaattaagctgaaggccataataatctcagagggtaaaaaatttgtttctacttctctctgatcctttttttaaaggaataataatggctagtatttattatttacattaatattatatttgactcattaagttatatcacctcttattgagtttctgatgttggtacagcttattaccaataga

SEQ ID NO: 159974 - DNA, 298 bp, Homo sapiens
ttggcctcccaaagtgctagtattacaggcgtgagccaccgtgcccagacctttttgcttttaatgttaggactaaacttcaattttcatgttgcttaagtgtcggtgattttccctggtttaatgcataaatggtcaccataagaactcggtatttttatttctgtagggaaaaacttgcatcctgaaatttactacagacagtattcagagaaaactgctgttattgggagtttgtacttctagcagcagacaagaaaacttttgaactttgttttagaataatggcttaaaatga

SEQ ID NO: 159975 - DNA, 165 bp, Homo sapiens
aaggagcatggggaaactttttgggatgatggaaatactctatatcttggttttggtgggactatatacctgtatatattactcaaaactcatagaactgtatgcctaaaatgagtgacttctattgtgtgtaaactatactttgataaaccttactgtaaaaaa

SEQ ID NO: 159976 - DNA, 485 bp, Homo sapiens
gacaattctaatgatgttcctgtgtcttcaaaacccccactcattgacttcctttatagttgtcattagttctgctccaaaatattttggctgtctgccttcctaacacagagtaagaatgcatttcctagcctctttgaagttaggcatatgacttgtaatcaccaatgatacaagagaggaagtgacttatgttctatccaggaggacattttaagggctggtacaaggtttgctacatttccttttcctgcctgcatgaatggggaaatatgtgtccaaatggagcttctgtatgcctgattctctgagtgactaagaagagcagagcactctcctgatgacctgtgttgaccttgaagcatgaatgagaaataaactcattgtattaagtctctggaagaaaatgacaagttcttagattgcttgggtttgaatcctggctacacaccatttactagttgtgtgatcttgggcaacttccc

SEQ ID NO: 159977 - DNA, 224 bp, Homo sapiens
cagggatagaagaacaaggtcagcaacactttgagcaagcactatgctaaatctagaatttggggcatcctataggacagtggaaccagtttagttaatgagtcagtggcctgtgaaaagaaggaaaaaaggaagagataactattctatgttaaaagggattaagggatctcagagacataaggaaatataatgagtagacattgttaggattcttatttgtg

SEQ ID NO: 159978 - DNA, 326 bp, Homo sapiens
gaagttgaagtgggagaatcacttgagcccaagaggtcaagggtgcagtaagctatgactgtgccactccacaccagcctgtgtgacagagtgagactccatctcttaaaaaaaaaagttaagttctggacttctgtcaaactttactcaatctacaatgaagagtaattcaagtctgaatttatcaattccatgaatatttactaagtacttgctatttgcaaggcattataacagatattggtagtataatgatcaactagaaattttctctaacctgtatcaatagttatttcattctaaggtactgaagaactaattatata

SEQ ID NO: 159979 - DNA, 555 bp, Homo sapiens
ttcttgactcgtcaaaccaaggtcatattagattatctggtgtgggggggcactggctctcagccccaagccctctaggccagagattttgagctcctcccaacaggtcaaagctttgtttttgttgtttcacttcccaccactgtgcacacatctcatctttgcctctgtttttaaaaaacattttctggagcaaatgctgaaatcagaaacctgcatttctcattttttagttgcccaccagagctgttgctcagtgcagggaaaccaggaaatggtgactaccagtcagaaacaaaaagactgtcttttaaatcagctgctgcagccttggtattcccagcatggaacttctaaaacttttggaatttccttagcgataggactgttttcattctgctaatgagggaactcactttgtccccagatagcttcagcttgggctctgatcaccagaaagatcaatcagatgaaattgcagggtttcaggaggctgaggcaggagaatcacttgaacccggttggcagaggttgccatgagacaagatcgtgcca

SEQ ID NO: 159980 - DNA, 614 bp, Homo sapiens
cttcgacggtgttctgtgttaagtgtgagagtagaaaaaagtttttttcctatatattatggatgtctattagacactcaagcagcaatattgaataggcagttagaaatacaagtcattatatgtgcatgatgctaacacaacaatagggaatgagatcccatgggagttagtgtggatacaggagaggtctgaggatggagtctgtgggcactcaacacttacaagttggggaagaagctaacaacatactgacaggatcaaatcagcatatattaaccttgaaaataaacaggctaagcaccccacttaaaaggcacagagtggcaagctggacaaagaagcaagatacaactgtatgctgtctttaagagacctatctcacgttcaatgacgcccataggctcaaagtaaagggacagacaaaaatctacaaagcaaacagaaaacacaaaaagagcaggggttgctactctaacttcagataaaacagactttaaatcagaaatcatccaaaaagacaaagaagggcattacataatgataaagagttcaattcaaaaagaagacttaactatcctaaatacatatgcacccaacaccggaacaccaag

SEQ ID NO: 159981 - DNA, 312 bp, Homo sapiens
aggcttcaggggagaatccatgcttgtcttgaggccaatggcacttgctggcttgcaccgctcccacctctgctcccaccatcacgtctctgggcccaaccctcccatctccctctcataagtcccctggtgactgccttgggcccactggataagccaggctcatctttccatctcaagaccctgaattgaatcacacctacaaagtccctttgccatgtaaggtcacgtattcacaggctccagggattaggacacgggcacctttggggggccattattctgtctactgcacacctagagtctggctcc

SEQ ID NO: 159982 - DNA, 151 bp, Homo sapiens
tgatccaaaatataagtagcaattagccatgcaacagtgttccatgcaatgggaacaggatatgcaaaggctctaaggatgcaaagggtttggtgtgtttgaggaactgaaagaccaatgtggctaaagcattgtacaaggatgacagtgg

SEQ ID NO: 159983 - DNA, 281 bp, Homo sapiens
gaataacttgagtcaggctgcaacatgtgaaagaattcagctgatcaggatttataacactagctggattttttgctttctttggggttcatgaagcatggtgttgtgagataccacaggagtcccagagtaaagttacatacctatttctcttccttatttttatttttttggcatgttcatactattttattgcctagtccaaatgtcttcctaagcagggtccagcctcctaggggacacgtctcttctgacttttgaaaaattaggaccacagacag

SEQ ID NO: 159984 - DNA, 166 bp, Homo sapiens
cggagtatcgccggagtatgctcagccggctggtgtatcgttaagtattcaagagcaactgttagtttcctttcatttcttacgccaaaataactggctaaaagctgcagaacattccaagtgggaaactctaaaagcatggccaaaagatcactgtacccagtag

SEQ ID NO: 159985 - DNA, 653 bp, Homo sapiens
taaaacaggtgctctgcctgaaccattgaattaacctctctgggcctcagttttttcatctgcaaagtggggagatacatcttggttgctgtcaagatcaaagccgtggcagcccttggaaaacagtgaaggaaccgccgtctcaccagcttcatttctcagacgcagaaacccaccaagttacttggaccctggctcctggcccctcctagggatatgataacatccagcattgcgcactggggctgggggccacatggtcaatggaaagagtgtgtggtttgatcaaaagacagacttgggtttgaatcctagttccagcacacactggctgggtgaccgggaggcaggttacttaaatgctgaagtctttggctgggcacagtgactcacgcctgtaaatcccagcactttgggaggccaaagcagatggatcacctgaggtcaggagttcgagaccagcctggccaacatggtgaaacctgtctctattgaaaatacaaaaattagccaggcatggtggtggacacctgtaatcccagctactggggaggctggggcaggagaatcactggaaccctggaggcggaggttgcagtgagctgagatcatgccactgcactctagcctgggctagagtgagacacagtgag

SEQ ID NO: 159986 - DNA, 332 bp, Homo sapiens
acagcaactccttattattacgtaggtcaaagatttttgagcccttgttagcaatacataacttgccaaacagctctactgggattaaaatttaagagaaagatgaacttaacaccaaatgagtactcatatagttccttcacctttttctcattttcccttttcaccgcatgttctcttatatttaagagtcaatatatcaaggagaaagaaaagaatcattatcagctttttaaaaatggctgctacctcttcctctcctctgttaaaaatatgtaggcttgcaatgtctctgagatatttggggctgatgagatgtgataaagtcaacg

SEQ ID NO: 159987 - DNA, 278 bp, Homo sapiens
tctggtaatttcttttttttcggattctttgaattatgaattcagttttcttgatagtggtagggctattcaaatgatctattttatatttggtgagttgtggtaatttgtattatttgaggaataagtccattttgcccaagttgtcaaagttacatgtgtagagttgttcctagtaattcctaattatcttttttggtatctttagagtccgtttcatcactaatgttggtaatttatgtcttttttttttttttttgtcagtcatgcttagagag

SEQ ID NO: 159988 - DNA, 836 bp, Homo sapiens
cttctcacgattcacaccacctgagtccattcctcggttgaaagggcacttcccagagtggcagtgtagtgaagtggttgagaacacagatttgacaactcataatgctaagtgactttggggaaattatttaatcttgctaagttttatttttcctattgtaaaagggagggggaagttatagagtaaacaaattatagtttataattacaaattatagactaagcaaggcaaagtttgtacagtgtttagtatagagcctgtagcacaataagcattcaaaaaataaaagctattgtttatttccttgttatgaccattattgttttgttgctctgtgcattttcttgctgatgttgtgttgattctctgttgatgtgttaggtggctgacattgcactaaagtgatgtgcgctgtaataaccatgcacttctttgcccactagggcagaagatggggctggttgttcccactgctactgtgcttcttcacttacctaatggtcagtttgggggtcctttggcccctctcaagtcacataagggaggcaacagccttgtcttttggggaccaacatgacctgggaatagacaagttcctttcaagtctgtagtcatttttgattgccatctatgcagccttttctttttctttctgtttttgttttgatggctgcctatgggtattggagacttaaatttcttttacttatataaatcaagagtaaaaaatacctaaaacaaagactctatcgattatatatttgaggaaaaccatgggcaagcataaggaaaaccatgggcaagcataaggatgcagcattctgcaagcaggt

SEQ ID NO: 159989 - DNA, 179 bp, Homo sapiens
tcaggagctcgagactagcctgggcaacacagtgagatcctatctcaagtcataataattataagatatgataaaggttatcttagtgagaagtacagaatgctcaggaaatacagccatcctctggtatcttgggggcttggttccagtaccccctcagacaccaaaatctgcgcata

SEQ ID NO: 159990 - DNA, 255 bp, Homo sapiens
acctgtaagatggggatagtgagtgacaatggaagtggagtttcatacaaatggatcagagagttgatcagtaagcaccgactgaatggcagacacatggctagtagtgggagacgctaggtgagtgatgtatttgccgtgccttcacaaaatgtgtggctgtcaaatggaaggatgagttagaaggaggaggtgtcaaagtcagagagagtaattaaaacacagtctttactcatgaggcgattagagcctggg

SEQ ID NO: 159991 - DNA, 350 bp, Homo sapiens
aggccccaaagtccccactcttgcattccaatcactgctgagccatccccaccccctccgctcccccatgtgccatgagcttgggtagacacatgcacgcacacactggtccagctcactccacatcaccatcaaggaagcagttccagtggaagtgtcctgggcacatctcccctcagtgagacctgaatgtcgggctctcctgccccagctcctcctccctcatcataagccccatcaggcctaccaagagataggaagactcggcattaaaaatacatcagtgttccctaattaatctctaaagtttacttggccaggtgcagtggctcatgcctgtaatgccaaca

SEQ ID NO: 159992 - DNA, 525 bp, Homo sapiens
ttttatagactgagcaatccaggagagcatgatggtccctaaaataactttcatgccctaactttggaagtcacatgccatccttttgtttatatcctattggctatatgagtcacttctatacaagggcatgaaagctaggaagcatggattattggaagccatcttagaagctgtctatcacattcatcatcatcatcatcatcatcatcatcatcatcatcaacttttgaatgaatgaatgacttaagcaatgagaaatatacaaacattaagaaacgtgctctctagataaaatttctttaaagggaaaactatattttagatgtgctttcttcactcctgacatgacattctttactttttagttggaagtgggcaacaataatttctacctaaacttaatgccaattaacacagtaattacaagacagtagctagtcttacatgataattgatgataattgcttcctgctttaattgccttataaacaagactgcaatagcaatccaaacatttcctca

SEQ ID NO: 159993 - DNA, 266 bp, Homo sapiens
catcccttacttaaacgatatagaaattacaaaattttagctgaaaaatggaaagattcactgggaaacaatcgctacatccagatgtttaatttctgtcccaagacagtggggtgacgtctcagtgccccagaagacaggacttgaatgagtacgcggatgttctgaaaacatttgttttagttgactatagaaaaaaaatttctctcaggccatattggggcaagagagctatgaatatgtggggaaagtgccacgtggcagtt

SEQ ID NO: 159994 - DNA, 452 bp, Homo sapiens
tttttctggatatctttctctgagaggcttctgtccttcccctaattccaatctatactcacttctctctgggcctgctgccaccacagctgctgacctaggctttcatctgtttgcaggatcccatgttttcttggtttactttttgttttagctggaatatatcttcatgtagcttcctaagaaaaggttgtagtaggtaaactccttccatccttgagtggttaaaaaatctttattctgcctccatagtttggctgggtacaaaattctacattagtaatcattttcccttgaattttgaagataataccttatcttcttgctttagtgttaccagtaagaagtctagttttcatttagttgcaggtgcccagtttttccctctctggagacaggatctttttgtcttgaaaagtaaaatgctatgtctctaggtttgtttttttcac

SEQ ID NO: 159995 - DNA, 910 bp, Homo sapiens
caagttcctgagtcaacgactagtgggatttctatttcacagatgaggaaacttactgtattttacccattatcaggcatgcattttccccaaatttcaacataattcaaagtggaatctcgcatctctgcctctcgcaatgataactgggagtactgtcttcctcctccttcttcttctttttttttttttttaagagacaggggtcttgctctgttgcccaggctgaagtacagtggtgcaatcatagctcactatagccttgaactcctgggtcattcaggcgattctcctgcctcagcctcctgagtagctaggactacaggcatgcaccaccacgccccagcaattaatatttttacgtttttttggagagacgagctctcactttcttgcccaggctggtctcaaacttctggcttcaagcaatcttcccaccttggcctcccaaagagctgggattacaggcgtgagccaccacgctcagcctgctgcctccttcttagtggcacatccactcacggtgtgccttaccctagaggggatctcaaagtgaatgacatgctcagtgcacaggctgggacctggctcagcgtccctccggaatttgagcccatagctgctgtgcctgaccatccattaagggaacgactctccacacctctcagcccagcccgactcctgcacggaggctcactcagggcccccaggactcaggagcacaagtcagcaacgctgccatcccacagcctggccagtgcctaccctggcaggcagagccttggatgtacccaaccaaggacagccaagctcagggccatgattgtctgtggagagatggctgcaggggtcagccacatcctctccgggaaggctttcctgagagccagacaagcaaggagacagtcag

SEQ ID NO: 159996 - DNA, 426 bp, Homo sapiens
tgacatattacactgtcgagttcggtacctgtgggtagcacaagaataataaagaaaagtttaaaacttcaaaccccctagcccaaaaaacaaaaaaacacagctgcacagtcaccacaaaaagaacaaagcagttctaatgacttttttgagttgttgcttttttacacactgtgaaactttgttctctaaaatcagttattagaaatttgctgtttgaaattctatcagtaagaaatatcagaaagactgaaatatcccactttcacctggagggcttatgtaatattttgacaccaagaagaagtatccatttacaacccaggtgctgagtttcaaagaaaagacttctgacacaacattccacatctactcaaatttactgttttccaaggaaatgcgacaccgtgttgtgctcaccaggta

SEQ ID NO: 159997 - DNA, 363 bp, Homo sapiens
gcaccacatatgctcaaggtcattccatttatgaaacaggaataataaactatgatttttaaacagctgtattgggtaagcacaagaataataaagaaaagtttaaaacttcaaaccccctagcccaaaaaacaaaaaaacacagctgcacagtcaccacaaaaagaacaaagcagttctaatgacttttttgagttgttgcttttttacacactgtgaaactttgttctctaaaatcagttattagaaatttgctgtttgaaattctatcagtaagaaatatcagaaagactgaaatatcccactttcacctggagggcttatgtaatattttgacaccaagaagaagtatccatttacaac

SEQ ID NO: 159998 - DNA, 519 bp, Homo sapiens
ctcggggatgcgatggaacctcactacctgataagcaggcctcccagggctctagtggcaggggagccaaatgggcagtgcggagctgtgagtaggaggggtgttccgttggctgtgagcaggcagctgcttatcaggtagagagggaggccagtattcggggcagaaggtgtgccaggtgcggcggcacagcagtaagccaggcacagccagattggggcacagagaataggctggcttggttagaactaaggcttcgtgtcacagtacaggaggcttagtgccacaccgcaggagccacgtctgccagggtggagaaggcagattcactctgaatcagtggtcttaaaaagtatggtcctgggggtgccctgacccatttcagggatttgataaagtcaaaactattttcagagataccctggttcctgccttttttttgctgtgctgatggcacaaaagcagtggtgggtaaaactgctagcccctcaacgcgaatctaggcaggggccccaacat

SEQ ID NO: 159999 - DNA, 177 bp, Homo sapiens
acgggagggagatcttgtatcctaacaacaacaaacccaaaacacaaatattgctgacttattcattatggatttttagattcaaaagcctaacaaaaggcacacgaaaaattataatctaattcacatatcgtgcactgtaacgttaacagtaaccttcttcaccccattaaatgt

SEQ ID NO: 160000 - DNA, 559 bp, Homo sapiens
tggcaaggctgtggagaaataggaatgctttcacactactggtggaaatgtgaatttgttcaaccattgtggaagacaatgtggcaattcctcaaagatcaagaaccagaaataccatttgacccagcagtcccattactgggtatatacccaaagaaatataagtcattctattataaagataacatgcacgcgtatgttcattgcagcaatattcacaatagcaaagacaggaaatcaactcaaatgcccatcaatgatagactggataaagaaaatatggtacacacacaccatggaatactatgcagctataaaaaagaacaagatcatgtcctttgtagggacatggatggacctggaagccattctcctcagcaaactaacacaggaacagaaaaccaaacactgtctgttcttacttatcagtgggagttgaacaatgagaacacgtggacacagggagaggaacaacacacactggggcctgttggaggggtacggggaaagagaaaatcaggataaatagctaatatgtgcagggcttaatacctaggtg

SEQ ID NO: 160001 - DNA, 271 bp, Homo sapiens
tatattgcttaggtgtcataatttcactaagaccaacttgaactgattccacttttgaaatctctgcccttattttatttccattgtctgtctcctcagggtcaagatcttgtggctgggactatcttgagtctcctataaaaactattcttgccgggcgcggtggctcacgcctgtaatcccagcactttgggaggccgaggcaggtggatcacgaggtcaggagatcgagaccatcctggccaacatggtgaaactccgtctctactaa

SEQ ID NO: 160002 - DNA, 245 bp, Homo sapiens
tttctaagtaatgagaaattgttaatcttattattattaaatttaacttttattccattatgatcagagaacatgctctggatgatatccattttttaaaatttgttgagatttttttcgtggctgagaacatgacctatcttggtgagtattccatgagtgcttaaaaaatgcataattctactattctgtggagcattctacataccaattagattctgttggttgcttgtgttgttcagttc

SEQ ID NO: 160003 - DNA, 701 bp, Homo sapiens
atactctaacattaagaaaaatatcagcaggtgaatttatgaacggtgcggtattaaccaaaggagagctctgatggctttctccactggcccaattctgtgtcatctaacacaattgttcccaaacacggctgatagcaaagataatctggaaaggacttttttaaaaaaaatacatattctgattactacagggttaagataggggaaggaagcactatcagaatctcactttcctaatgtaataaaacgattgtgtgtgtgtgtgtgtgtatgtatgtgacaggtcctcctctgttgcctaggctggagtcccacagtgcaattatagctcactgtagcctccagctcttaggcacaagcaattgtcccgcctcagcctctcaagtagctgggactacaggcaagcaccaccacgcctggctacttttaaatattttgtagagataggagtctcactgtgatggccagtgtcatcttgaattcctggcctcaagcaatcctcctgccttggcctcccaaagtgctgggattatagatgtgagctgccgtgcccagcctagagggtttttattttttttaagtaaaagctttattgagctataactcatacaattcaacctctcagtgtgtacacttgagcagtttgtagtctattcacagagttgtgtaatcatcaccactatctaatgttagagata

SEQ ID NO: 160004 - DNA, 391 bp, Homo sapiens
gagccctggaggtcgaggctacagtgagccatgtttacactattgcactccggcctgagtgacagagccagtctgtcacctgtctctaaaaaaataaaaaataaaaaaaaaatatgagccaaatttggcataatgtagatttccatcattaaaacaaaactcacagaaaacagcaagatttcaaagccagcatgcagtgattaagatatccctttggagtcgggtccttgctttgcctccgcaggctgcgtgacctggtgcttaacgcagttaccacatggtggcgccacgtcagctgagagcagaaatagaaaggtccccgttcttcactagtgcctggcgaggggtctgtttacatgcatcagaacacctgtcctgggttttgaggact

SEQ ID NO: 160005 - DNA, 325 bp, Homo sapiens
caccatgctgcctctcttgacatgaagaacagagaaagaataaagtgtgaagacatgccgtggcgattttaaggtgcacagactttatctgttggaggcagaaggatgcctcgctggaggtacgagagcggtaaggttgaaagagaaccagaacattagttcagatgttggctgtggcgtgtaccagtcaagggacttaagtgacttcaccctgagcctcactttcatcttctgtaaaatgataattataccataatgtcaataatattaggttgatgcaaaagtaattgcagtttttgccattggaaataatggcatataaacc

SEQ ID NO: 160006 - DNA, 391 bp, Homo sapiens
tgcagggactacaggcatgagccaccaagcccggccagtaacctaacttcttaaaggtaacagttttatactcgttgaatggttaagaaatacataaatactacaataaatatagcattttaccttgaaaaaaatgtgcagtttgcttgtggaagtgggtatcaaaagaaaggcagtttgtaagttattttgaagtgatggaaggaacagtgtctgaaatcagagggaaagttgtaacaccagatgtggatgggtatggctcataacatgagttacaagtagatgtttaaggtgtgtgcattttgtatattcctgcatggccgagtgcacccaagtgttgttgtctgcattgaccgagtgttctcactgatgaaatctggcataggcaaaa

SEQ ID NO: 160007 - DNA, 567 bp, Homo sapiens
attgagtttgatgtctatttattgctatatatttgcatttaaatacagaaactatatatttttttcttttttatgacccagtgtgtctttggggatagctttatgagctctttcttgaacgcttaattatttctttctaggtggctttgtcataggctgtcatgcttcattgaggtatcagctcagctgatctgttccactttctcttaggaaaggcaccattttggggccttcagtgggtaacagatttctgaagcttctcttagccccattctggcaacactgggctgatttacaaccggcaatatggaaaacctccctacacagctgcctcagctgcatttgaactactgcctgagagtctctggctgccttgacactctaacagaccctggcggcaaggcaggtaccgccttctgctatgctgctgatcattgctgaaaagttgcgtaagtcatgccaattgtttataacatgtatttaagccgtgtatgaacctgggagtcatgagtctgtgctcttatttcaatgtaataaagagaagaagaaatactggatggtttaaat

SEQ ID NO: 160008 - DNA, 327 bp, Homo sapiens
tgtgtccatgccctgtgttgtcattggaggtcacatggggaaaagcaatgagccacttttatccaatgcagctagggtgttattaacatagactgagtggggggcctgaatccccacttctacccagtagtactatggggcacctccccaactcaagtgtcagtggaaactaaatggagaaccttgacttacattcccacctggcaataatgaggaggcactcctccttctttattatcccctgccaaaacagttttatagtaagcctgctaaaacagcagatctaaatgcaatccagagtctcttcacaaaattacctaaatattt

SEQ ID NO: 160009 - DNA, 374 bp, Homo sapiens
gctgccctggtatcagcgtagtaacaattcaggcaagaggcatcaaaggaggctaataccaaagtgtggaagtggaacaaggaacattccaggtattcctggaattccttcagttcctgggattccttaaaatacctattaactacaaaaacgtagatgatgagtaatttttctgaaggttctggtatcagctgtaagccgaagtccttgtttcctattgatatgttacgaaaaaacaaacaaaaaaaaacaaaaacaaaagccctccgtccggggggtggaagtcaagcataccctactccacccgacccgaccagacccgaaaactccgtgcgctgcatcgcttggccaggccggggcctcccagaccggaa

SEQ ID NO: 160010 - DNA, 495 bp, Homo sapiens
ctagaatgtagaggttaggatggtgcagtggaaagagccctgggtggggtcttgggaaacttgagttctggtcctcactcttcttgggcccaccttttaacttgtaatgtcttagtttccttacttggaggtaaagagttggcctgaatcattcgtgttcaacccttgttgtatattagagtcacctggggaatttgatgcctaagccatgccccagattaactaaatatttatccctggggatggggtggggcactggtgtttttaaacaatccccaggttgattctcttgtgcagcccacattgacagcttcaggactaaggatctctaaggtcctttacatttctaatattctgaaagtccatgacttaaacccaatgtgagtgtagctcaaattttatgtagtgacagatccagtgatcactcagcccccatctcaccccagcaaagaaccctcaactcttccatatagttggtcagttatgtggtttacg

SEQ ID NO: 160011 - DNA, 457 bp, Homo sapiens
tggcagggaaaacggggtgtctctggctttctccagcccctgaatgaatgcgactttcatttatttacagggcatccatgtgctgctggctgtatattcagattccccaggctgtaccagggcaggaggaaaatgaatcatgctcttgaatgcattaagtaagggtctaaatttagtcctcctttctgcttctctgagtatttttacaagtttagatagtaatgtgaaagcagaatgtccaaaacttactttctaccatgacaacttaatattatctagccctttccattcactccaaattagctatccaatctacttaatgcctgggttacttttttttcttactgcctagggcttttccatctaaaattaataggtagtctggggtaggaaggtttttgttttgtttttgctttatttatgtatgtatatatttagtacaaaggtttgctataaa

SEQ ID NO: 160012 - DNA, 449 bp, Homo sapiens
gtgctgaccaaggaaacggagttcacgaacttgggtgtgttctggagacagaatcagtggccttacggacaaatcagaggataagaggggggaaaaaatcaagatgacttccaagtttctcacagttaattaggttagagtgtcttacaaaagacgggaaggactggcaagaatcaggattcaaagatacagagaaaccagaatcaccaactgaagagaagctggcttttgtctctttcttcaaaaaggatggtgctttgaggtatcacagttgtagtttcctctgaagctgtctaccattgccatctactgatgcaaactaaggataaaggctttgggggtaatttctctaaggcttcaagtagactcaacacactaaaacagcccaacaaggcagagcacagtggctcacacctgtaaatcccagaactttgggaggccaaggcaag

SEQ ID NO: 160013 - DNA, 215 bp, Homo sapiens
ttcagagttctttcccatcagctcaattcctcctgttttgttttaaaggactcttgagactttcttttgccctggagcagctgcagtgacagtcttcccacagttgctccttgagaaacagaaatgatgttgtgccagggacaagccaggctcctggcctgacatacgctcttgttttgttttggtgaagactccactgggttgctcggagtgca

SEQ ID NO: 160014 - DNA, 373 bp, Homo sapiens
tcacttgcagaagcttcccagttggtgtctgaagtcattggtgtttttagaaatagcaatttctgtatagtgttggatctgaaactgtgttaaagtgggttaaagaagtgagaattctaccagtgattcttaacctctataactacaactgccaaccaagacaaaataaagtgctttttattttcagagtttctgttataaaaacactttgcttttttaaatataaagttataatttcgaatgtagtttttttaaagtcccatatgtctggatattttgatcctcccctttaatattaaaacctaatatttcaagacagttaatgatagaggtcaagagaggaatcagaagcttaagaggaagacagagtaag

SEQ ID NO: 160015 - DNA, 307 bp, Homo sapiens
cagctaggatgtgaataagctgggcatcgctgtctaggtgtcatcccaaatgtcacctcccagagaggcacctgaccacacagcctggcgaaaggaggtcgctcccacacttactctgtgtgtttcaccccagcttactgtcttcatagcacccatctgcatctgaagttacctgcctgcatatccatttccttggtgattatttatctcctgcacagaaggcaagctatccaagagcagagtcccttgctcactctgacttcccattaggagaaaggacccaagccagatcttggtcaacaagcaa

SEQ ID NO: 160016 - DNA, 270 bp, Homo sapiens
acaagatcaatggctcttcaaggaaataataggtatggctgaatacaatgaaggttggcaaactaggacccaagggccaaatctaaacatacccatctgtttacatattaccttctatgacttcttttgatataatggagtagttgcaatggagactttatgctataaagctaaaaatatttactatctagccatttacacaaaaagctggccaacccctgatatagaataaaataagttagaaatctttcaaatagatgcccataatca

SEQ ID NO: 160017 - DNA, 308 bp, Homo sapiens
cctctgatgtgtccattttacttctcttctcctgcctcagcttctgctctgaactctgtctctaacttacaagaaatcaagctcactggattctgagctcttcggggtcaaggactgtgtcagtagttcatgtctctttctagagatcacagcttagtatctggcacagagcagatactcagccaatgccaaatgattcatttgccagaaggctgaatatcatccataatcctagtcaatgcaaatacattttgccggtggggtgtgtttgtcctctgaaggcgttttcccaggctttgtaaatacat

SEQ ID NO: 160018 - DNA, 521 bp, Homo sapiens
caatgggcgttcagggggtggggctctgtattcccttagcctcgcagggcacaccgggctgctcgaatctgcaaaaagccaagtggccagtccccagattcccggccggtcctagagcccacccgtcccaccggcgccccctcctcacccctgtcccagggcgttaaagagctgcgtgcaaagggagaacttcttgctcccgagaccctgagggaggaggggagttagacagcaggccgctcagagcccgcagaaaaccggtccggctgcctcagccttcgcgaagccaggacccggcctctaaccccctccctcgctagacaaaagtttcccctgttcgggagcaggggagggggagggggcattcctcgtgagtgacattatccgtgacctacagctgccgcgctgccctcgcccgcaccccagcctgcccccggccccgcgcggccccctaccctttgtcctcccacccccgcgcgcggggcccggccgactccacccgcccgcccggcgcccgcccg

SEQ ID NO: 160019 - DNA, 290 bp, Homo sapiens
ctcactccgtcacccaggctggggtgcagtggcgccatctcaactcactggaacctctgcctcccgggttcaagtgattatcctgcctcagcctcccgaatagctgggattacaggcgcgcacaccacgcgtggctaatttttggatttttagtggagacggggtttcaccatgttggacaggctggtctcaaacacaccttcactttctccactggaatttttgtttatcatgtaaccagtaacaatattctcatattcccatgagaagaggttgaggaagaaaagaat

SEQ ID NO: 160020 - DNA, 424 bp, Homo sapiens
ggctcaagtgatcttctgccccagcctcttgagaagctgggactacagacatgtgacaccaagcctggatagttttttaaagaaattttgtagacactgtgtctgcctatgttgcccaggctggtcttgacctcctgacctcaagtaatcctcttgcttgagtctcccaatgtgctgggattaaatgtgtgagccgctatacctccattttcatttctgattttagtaatttgaatcttctctcttttttcttagtcaatctaataaatgattgtcaattttgttgatcttttttgaagaaccaacttttggtttcattgattccttctattgtttttcaattttccattttatttatttaaactctaatccttattatttccttcatgtactatctgtggtttgaggtggttctttttctgta

SEQ ID NO: 160021 - DNA, 804 bp, Homo sapiens
gaaagccacactgtaaaaatgcttgcattggtttcagatgagttcacagtctgcaactacaaatgatatgcccctgtgtttgcttttgctaagatctaagtcaaaatttgttaaaggaataaagtaactgataatgggtgatgtcggaacttttgtaggagctcccgattaacaaagtgatattcagaaacacattgtcttcttggcctgcctgcatatatatatatagatatatagatatatatagatatacatatatatatatgtgtgtgtgtatatatatatgcgtgtgtatatatatgtgtgtgtatatatatacatatatgtatgtgtgtgtgtatacatatatatatagtgtgtgtgtgtgcatgtgtgagagtgtgtgtcctatctcttataattaccttatgaatcagtaagataaccaagaaggtaaacatagccattcctcatgattgcaagtggcatattttttctgttgcagcttccaaaatgatactatgtttatagttgcagtagctgttcctttattaatcactaatttcagggctttatgtgtttgttgcaagacaaaaaaagaagcttggctttcttgggtgtgtgtgtatgtgtgtgtgtgtctgagtgtgtgtatatatatatatgtgggtatatattcatacatatagataatttggaaatcttttttaaatagcaaaaaccgtctccatgtgtatgtgctggtgctcttaaaactttagtgtgtaattttaatttttatgacatctgtgaaaactttatatgaatataaaataattcaaacaa

SEQ ID NO: 160022 - DNA, 293 bp, Homo sapiens
gcagggcccttgaccactttgctatttaccatcatacctagataggactcttccttaaggagtccttccttgcttcccaggaggttgctggtgttggatttatactgctcctctccccactcctgcagattctccagcacaagcaagcattttggataatgattgaaaatattgaagcaaaatgtagttcggtgttgttaccttgttctataagggtttgtggttgtccattgtgagagaggaatttgatttttcttgtgactgctttattaattaaattgatcatattgcat

SEQ ID NO: 160023 - DNA, 247 bp, Homo sapiens
cgcaaagaagtgagtggtgggctgctgggattctggggcctgagtgggactggagctggggggccctgagcggcccacccttccaggaatgcgatcggacagcaggagggatttctcagcagccctggcggtgccgctgactcactgccagcgtctgtgatcaactcgcctttggagagagagcattgccaagactcccccaccaccagcctgagctgggttcaatgcgcttcactcccaggacgcg

SEQ ID NO: 160024 - DNA, 243 bp, Homo sapiens
caaaaagaagaaatagagaaaaagaaaacatttgaccaattcctgccagcacagctccttagttctgggctatcttcttccatggagacaaatagataacctgtgttgaggtcttaagatttgcaaatgagagtcctaaacatttttctttcgagtaacatcagagaaggccacaggttttcctccactgaaaccctgtataaactaaaatttaactccgaaactttacttgggctcctagaa

SEQ ID NO: 160025 - DNA, 509 bp, Homo sapiens
agatgtcagagcctttcacaggggtattagccttttcagcagtttccatcagccactcggatatgctatggaatcagtgttagttttttcaggagccagaaaacacactgccaccttatggtagtgacaagggatggtgggatccgtagagtcagcatgactttccaaaaggttgaggaaaagagaaggattcaagcagatgcctcaatatcttgagagtgtgcccttggagggaagatgcttgacccctcactggtcaacttactccagtttcctgctgggaaggaggaccaggagtgtggcacccttgcagactttgggagggtgctgagggctcactgcccaggcaatgccaatgctattgccgatcttttccatttataggtgaggagttagaggctgggcaagttaacctacttgctcaaggtcacgcgggttataaataatgaagctggacttgaaacccaggttcttgaactctgggcactctcccccaggacgctccctga

SEQ ID NO: 160026 - DNA, 480 bp, Homo sapiens
tttgaagcaaatcccagaaattatatcacttagttcataaattaatagaacctctaaaagataagaattgggtttgtgtgtgcacgtgtgtgtttttactatcacaataccatttaaattcagcttggaaacactctttattactcttggggaagttaggaaaacgacttgtacttctttccatgaaggtttaactgctgccagaatttctttcctgtaataaaaaactagaaaatcaaacacaaaatatgtaacaactgttttcagatagcagacaacaggcaatgtaggactgtgagacctgagaggagggaaatcaataaggccggcccaacaattgtcccagcttcctctctgaggctgatttcaggccaaggggcaggaaggagaactgaaacagagcccagccaactcactgaattgaggaggcggagactggagttaggggaaacccactgggatttgcaagacagaatatca

SEQ ID NO: 160027 - DNA, 434 bp, Homo sapiens
cccatcaattcatggttttctatcctttgagggtcccattttgcaaacttgatgcaaacgtgtccaacggtaccttcttcgagaaaacacccagtgacacgagatgcctatcctgcaaggagtgctggaggcccagggcccctagagtcagaaacataggatacaagtaaattcctgtcaacaggatggaccatctggtagaggacataatgaggtttataaagaagcctcctctcctacctccaagactgacttcttcctagagtcatacctaaaagatgaactcctaaaacctcacttggaaatttgcctggtttgccaggtgaacctggtctcaggcattcacagccatcacagactacaaaagccatggtggcctgcttattattgggtattccagggaaatagcaacacaggcctcatctggataaact

SEQ ID NO: 160028 - DNA, 402 bp, Homo sapiens
acctgcagcgatggaggtaacaaacttgacattgacggagaggcttagattctcctggaccttcaagaccagtcctgcgttgcttgcgggattggaagggctgagcaaggactactgtcttggtcctgctttctcaatgaagtagactcttccagggagctgttgaagtcaattatctactgaatatatggcaagccagcccatccatattgccctctccaaattataagagtgtggacgtggcaacatggtgggaggaagatgaggttgaaaggctcctatttccttgggtaatgagccatctgtgtacaggcctgctttttacttctgtcctcaggatgggtcctaaaccacacattctcactatctctttctctctctctctctctctctcttttgcat

SEQ ID NO: 160029 - DNA, 779 bp, Homo sapiens
aaggctcatggattgggcctgtgtgaaactggtagatctcagcatttcttcctctgttacctccatagaagatggaggttgctatttgatgcaagtgactgggaggaatcatgttatagggttaaacttgaactttctttgtctctttaaagtgggtaatttacaagctttgtgacttaattttattttcacactcttcagatggattggaacacaatgcctgtcaaaactccatggctgaaagccaaagtccgcttataaccagatgtaatcagacacagtagaggctagtggttatgaccttccactccagaaccagactgcccaggtctaaatgctggtttcaccactgttagctgtgtgactttgagaaaggtagaaagcctctctgggcctcagctccctcatctgctaaatgggaataacaacagcacctgccttaaagggttgtcatgagggctaaatatatgagttaatatacaaaaggctctcagaatagtgccttatagatagaaaaactctttatgtgccatccagcattacgaatattttctttttattacatcaaacttgatcaccagaacttctagctcccaagagatcagaagtaagtcttaagggggagaaaggcacacatccagaggcagacaccaataagaagacaacgcatagtttaacagggaggtggacactggaagcaagaaaagcagcccaagaactccaaagcccagcacgccaagccatgcaatgcggggcagacagcctctgacaactctgag

SEQ ID NO: 160030 - DNA, 328 bp, Homo sapiens
gaccagtaagctttgatatgcaaatgcaggccattagaaactgggtctacccaatatggcaattcccaccttcctcttatcacaaggtgtgcccagtgtcatggccacctccagataactcaacatgttcaggacgtcatggcagcccacatttacatattaaaagactaaggtgggaggaccaggtttttctgtgggctacgtgaatgatgcagctggtcaaaccaatcccctgggccctatgcaaatcagacactgcctcctccagcctccaatataactgaccatttttctgcggcacacaggatttctctcttggagcctccct

SEQ ID NO: 160031 - DNA, 277 bp, Homo sapiens
aaaaaaaaatgtgaaagcatgcatcacttatgcacttctttctctttttccctcctcccagaaagaaatctagaacatatcttaccatgctccctccttccctgattgtccatggtcgctattgtgtttgcatcccatctctttcagcctggaatgttccccttcagctggtccccctgccagactccactgcagtgtctccctctcttgctattttcccaggtggctttaggcgctacctgtacctcctttgtgcctgcctctagtagagctgtca

SEQ ID NO: 160032 - DNA, 223 bp, Homo sapiens
tatgaaacagacccacagcaaaactccattaaccacctgacctccacaaacccctactttgactgggaggccacactcattctaccaaagtatgggttagtgtcaatttagaaccacgattcaaaaatcccccataaatgtgatacttttcccttccttggggaacacgtccctggtaaatgagcacttgtcccgtcgacgcggccgcgaatttagtagtaat

SEQ ID NO: 160033 - DNA, 498 bp, Homo sapiens
agctacattttcctccttgtgcaagtttcttaaactctacagtcctcagctgcttcttctataaaattaagatattaacacttacctggcagggctattttaaggattagaaatattgtatataaaccgcttaggccacacgtggtagacactaaagcatgatagttattaatcgattctttaaagggggttcttgtagagatacaataacttgttcaagcactggttttgctagtggtggaaagtcaaggcagagtgacaagcaaataatgaaaatgtgtgagggccacaaatggtgagctctgagtgtcccacgagtgcccctggggtggctatgggtctaacccacaggtcatgggataaatggggtgctgtgagttcccagctctgccaacgatattagcatgggaatccgggtaagttgctaatcttcttgcctcaatttccctggctcattttcccactgacgagggtgatgctcaaagatgggtaccgagc

SEQ ID NO: 160034 - DNA, 115 bp, Homo sapiens
aagaaaaaaaagaaaagaccttgtctctaaaaagagagagagagaaaccctgcatggacctccattcagatggccgttctgttactagaagggtccagaccaacacaagagcact

SEQ ID NO: 160035 - DNA, 401 bp, Homo sapiens
cttgatggtggagagattcgaagtctgagtggctgcctgctttctgtcttcagggtatgaaaagccatttatagaccacagctatccccttcaagaactagcattttcaaaggaaaatgcgctctgttttattaattttattaaattaaattttgtctgttcaatgtgcactctcttctcaagatgagaaaaaaatttaatgtgcactctcttctcaagaggagaaaaaaactcctgagccccctctgctggctgtattggagaagaacaggcgagtaaattggaatgatctcttaaaatcatgcacgtgctcacaggggcatagagacacctacgattacagaaacagccacatatactcacatgcctttgcatacaacatgcacacaaagacatgcaca

SEQ ID NO: 160036 - DNA, 436 bp, Homo sapiens
caacgcaaacaacttcagctcctccacaagtcttcagctgcacgacgctcaatctagaacatcagctcctctccgggtctgcagctgcaagaccctcaaactacaacgtcagctcctctccgggttttcacctccatgaccctcaatctagaacatcagctcctccctgagtctccagctgaaagaccatcaaagtgaacatcatcagctcctccccgagtcttcagctgcacgatgttcaatctagaacatccgctcctgtctggttctccagctgcacgaccctcaaactacaacctcagctcttccccgagtcttctgcagcatgatcctcaatctagaacataagctcctctctgggtgtccagctgtagggacctcaaattagaacgtcacctcctcccagagtcttcagctgcacgaccctcaatctata

SEQ ID NO: 160037 - DNA, 271 bp, Homo sapiens
agctatggaagcattaaactatattttcatcatgttcttccccgattctccaggtgtacgtactttccactgctagtacgtacgctgcctgtttgttggctttcggctgcgcgactttgtaatcttaatcttctcagctcttccccgagtcttctgcagcatgatcctcaatctagaacataagctcctctctgggtgtccagctgtagggacctcaaattagaacgtcacctcctcccagagtcttcagctgcacgaccctcaatctata

SEQ ID NO: 160038 - DNA, 415 bp, Homo sapiens
tcctgatgttacttagtaattttccatccattgacccctaaccctgctccttggctataaatacctacttagccatgctgtattcagagttgagccctgtctgtctcccccactgcaaagcccagttgctgcagtggtctctatacctattgcaatggcttcctcactgtgctttaacaagtatcattgaataacttttctttaacaatatatatgtatgtgtgtgtgtgtgtgtttgtgcatgtgtgtgtgtgtgtattctgtatattctaccaaaagtttgagttcatatttaggtctttaattcatctggttttttgtttttttgtgtttttttttcagatggagtttcactcttgttgaccaggctggagtgcagtggcgcaatcctggatcactgcaaccttctcctcct

SEQ ID NO: 160039 - DNA, 279 bp, Homo sapiens
taaatagctggattttgattttgttttttaaagcctcaggatgtaaaaagtttctttattctattcctgggtgggtttcttccctaaggtcacaagatcaaatcaaacaagataggtagactggttttaaattttaaaaatgaccacctgatgctatttggaagctaatatgaaaaaagatagtgatgctgagttcagacctcagggcctgtggtacaaaaagtactatattgtttgagtcacacaaccatagaacatattaaacctcttttttataga

SEQ ID NO: 160040 - DNA, 159 bp, Homo sapiens
gcctgtcattgggcacaggcggcagccaggagaccagaggatggggtgtggcttgggccttgtggtcagaacaggtgagatggtcagatgcaggacgttctgagggcagagtgacaggatttgccagatggatgtgcagtggatgaagcgaaggagagg

SEQ ID NO: 160041 - DNA, 234 bp, Homo sapiens
agggaggtctgtgagaaccagaatacagtgagaatccagggtccttccttcccctaaacagcctttctcccagggttccccatcaggctgagaagcctgggataggtttccgaatgttggagacaggaagtctcccatacactgagaatcactggggttacattagagcctgcagccagagtagcagagctaatggaacgattcctacattaactgaattcctgggtgagtgaa

SEQ ID NO: 160042 - DNA, 227 bp, Homo sapiens
ccactccctgtctctctccctttctcaggccaccctaatgcctgagaccaaacaatattgaaattaggccaataaataaccctgcaatggcctcaaagtgtccaactgaaaagaagaatcgattcagcatgacttggtcaataacaacaacaacaacaacaacaacaagtcaaacatctcctacattaaattttaaaaagctagaaattgttaagcttagtgagaag

SEQ ID NO: 160043 - DNA, 433 bp, Homo sapiens
tcaagaattgaattttccacatcgccagctgcagaaacagcctgctgtaaccctaagaactgttttacctagtagctgctgaaacaacctgccttgactagtcttacctaccgccttcactcaaatcagagtttgcagctcccaaaagcttctctagtgccaatgagcttcctttccaaacaatacatgtttctcaagtaaaacccccaacctctcattgctcttcagacatatggaagatcacaacagtctgtgtgtaggctctgaattgtaattctatgattctcaaataaaacatttaatttagagatttgtctctatattttattttgaatttgacagtgtacacgaaacataaataaattttgtgtttagacttaggcatcatccccatccccaagtcccaagatttctcattactacatatgcaaag

SEQ ID NO: 160044 - DNA, 161 bp, Homo sapiens
tcccagcacagagtaggctcataatgaatgtatcttgaaccaactgcacctctgattctgacttcacttctatctgttgtggtggttcccccgctgttcagtgttttcacctatcctgaagctgtatttcactgcacttttaaggcatttttttttttcca

SEQ ID NO: 160045 - DNA, 415 bp, Homo sapiens
ataaaccttcctttcacaattatcattgatattacatctgcaagactttcgtacttgtaagtagttttaagaatatttgtttttatttttttacccacatctgcaaaaatgtgtgtggatatctgcgaattatttatggatatacaagtttctgaatgcaagcactgaatgtgactctacacacattcaactgagtggttctttttctaatcaagtaagagcagtcagtacaagactcaaaatcacagggggagccaaacttaaaaaaaatctttgacaagaaatgagctaaataatggctttctctttgaaataaataggggctattttgtcttgatctggggccatttgcctccatttccccccaactgaacacatgtacttgtgtctgtacacacactctcttacataggct

SEQ ID NO: 160046 - DNA, 389 bp, Homo sapiens
tcttgttgctcttgagtatcccactagtccacggttggtctagtccacttgttggctactagttcacggttggctgagctgggctgagctgagctgggccgagcaaggctaggctgagctgagctgagctgggctgcgctgagctgggctgggctgcgctgagctgggctgggctgagctgggctaggctgggctgagctgggctgagctaggctgggctgggctgggctgagcggggctgagcggggctgagctgagctaggctgggctgagcggggctgagctgagctaggctgggctgggctgggctgagccaagctgaaccgggttgagcgtgctgtgctgggctgagccaagctaggctgagctgagccaagttgagcttagct

SEQ ID NO: 160047 - DNA, 355 bp, Homo sapiens
ttttgttaccgatacagctaccaggacacctttctcccttttgaaatttccatggctcaacgcttcctactgactgccagcattttcggattcttcgggagagcctttaacatgtttgcacttagaaacatgtccatgagaatgtttgaggaggacacctacaattcattcgttgtttcaggaattctcaacattgctgctggtgtctttaacttaattgctgtgctccagaactacgatgccgtcataaactcacaggggatcaccttcctgccatctctccaaatgcccttcaagccagatgtgcaggaagttggcactgccattcaagtggcagggataggtgtcttgccga

SEQ ID NO: 160048 - DNA, 507 bp, Homo sapiens
cttaaccacatgtttctgagcatttcttagcccagttccccagtacatattattaacagcacctcattatttataaaattcttgggtgggcacagtggttcatgcctgtaatcccagcactttgggaggccgagcaggtgaatcacctgaggccaggagttcaagaccagcctgaccaacatggtgaaacctcgtctctactaaaaatacaaaaattagctgggcacagtggcgggcacctgtaatgccagctactcaggaggctgaggcatgacacttgctcgaacccaggaggtggaggttgcagtgaccagagattgcaccactgcactccagcctggggaacagagcgagactttggctcaaaaaaaaaaaaaaaaaaaaaaaaaaaaaaaaatttatgagaatttttttttttggaaaaatggggggggtacccatgggaaacccttttggggaaaaatttaggccctctcttaaaaagggaagggggcattttgggctttt

SEQ ID NO: 160049 - DNA, 317 bp, Homo sapiens
cctactttatcgaggaaaatggattcatcacttaatagtatcccccaacttcctacccttggcactacacatttatttacatccatatacgctcacctttactctaaaatccttcctcctgttccaggaaaacccttgatcctatgccctcaaactaattacctcctgcctcctccagggcctgcctccaccagcatctcttttttttcaataccccctttcttctgatgccttcctctcagcagatcagtatgctaaaatctctcccttgaccttgcactgctctggttattgcccagttcctctcttccccttct

SEQ ID NO: 160050 - DNA, 280 bp, Homo sapiens
aagattattgtcgaagtaaaaatatgctattagtgaaacactgaattaagtttctatacacagaaagttggtatacacagaaagttcttaaactttcagtatagtgactataaagtaacatgacttaaaaaacaaaaaaacaagcatacccacaagcataccaaaacataaatccaaaagagtaattttctcctcttcagaacttatcttgggattcctttctgggaattgcttcagagcctgcatattggtggtacttgtcctttgagaatgattttga

SEQ ID NO: 160051 - DNA, 339 bp, Homo sapiens
agaatcacttgaactcgggaggcggagtttgcagtgagctgaggtagcgccagtgcactccagcctggacgacagagcgagacttcatctcaaaaaaaaaaaaaaaaaaaaaaggaaaaagaaaaacaatcaaagccccacttcctcatattttattgacattgtcaacacagccattataggttgcataacaatctattaggtggatcctgcatagttagtcctcttattgttggactaattcattccaggcctcaggacatgggcttccagcctgtggctgggcaatggggccagatgcaactcaggtggtgactcaggtgatgtggactcaggtgg

SEQ ID NO: 160052 - DNA, 361 bp, Homo sapiens
atataagcaaaccataagtaatacacatgagtctttaaaaaacacaaaaagccataatgccatgaggggttaaaagaggtaggttaattctaactgagtgggatttgggaggacttctttgagagggtatatttgagctaagctttagaatatgagtagggtctggataaggacttcttaacttgaagtccatggacctttaggtgaagtctgtgaatttgaatgggaaaaaaattacatctctattttcaccaatctctagctgacatttagtatttccttcaggtactaaggtagactacatgcacactagtattagcagaaccagtgatttttgtcaccagtacaaatcccagatatt

SEQ ID NO: 160053 - DNA, 343 bp, Homo sapiens
ctgatgaacttaaaaaagaaaaaataaaaaaaaatcttgatgttttacgaaattctaccaatttgtgttgggctgcattcaaagctgtcctgggatacatgtggcccgcaggctgcaggctggacaagctagcatactatactctgaatatcagacagatgagtgaaatatagacccattgttagaacacattagtgattttggtgtgatgtatatttaattcaatttttaaatgattacacttttagttcaactaatgattggtttaggtacttactgaggcatttacttcctaagcagatttttaaaagatggtgaaaataggaataatttttagactgca

SEQ ID NO: 160054 - DNA, 364 bp, Homo sapiens
tgataaggagtagagcgcacaacctctccattatgtacagggaagtgctcctgtactccagttactccattacacctattttactcttgaggcaaaaagagaaaccccaggcacctgaaaatctaatcctgagcacaacaggcaccagcctgaatgagtaggaaacttgaacttgcttttcttctttcacaggtctgtgttcatctgatcctgccagctacatccaatcacttcatttctcccttcctgtccttttcctatgccctttcctcattgcacaatgcttgaatgctctgctttaaattctcttcagaggaaatggcttatggataaatgtaacaaatgggaagctaaagccttgaac

SEQ ID NO: 160055 - DNA, 361 bp, Homo sapiens
cagggggtcagcagagggagctgaaacagtaagactataagcagaggaagagtggcaggaaagaacaaaactcaattcaaatgttgccagcacacagtgaattgcagggaaccggctatcatgagagagggtcccaggagtacacacatcaaatgtggtttttgaaccagaggacctcctgactgctggtggcaggatgtctctattccatgtagttatcaatgtgttactcttttctttggttgaaaggattttgggtcaggcactgatctttctttgaatatatgtgcctgttggatgcctgaacagtgagaaatgcaggaacgtggtagttagtgatggttaggagagcaggggaagg

SEQ ID NO: 160056 - DNA, 389 bp, Homo sapiens
tgtctacccaaaggtgttatgtttttattgtcttaagggggcccttcatttgatggcataaaaagttatgaccagccatctgtagttcagttaataggtcaagaatatcagcagctattgttatgttgaggtcattatttatcaagcttcaacacataaaaagcaaaagtaggccgggcgtggtggttcacacctgtaatcccagcactttgggaggctgaagccagtggatcacttgaatccggaaggcggaggttgcagtgagctgagatggtgccattgcactccagcctgggtgacagagtgagactccgtctcaaaacaaacaaacaaaaaacaaccaaaaaaaacagtacttacaatgtggtaaagagagacaaagggaaaca

SEQ ID NO: 160057 - DNA, 360 bp, Homo sapiens
tgacgaggcaaaaatcatacaatgtaatgtagggctgggtccagcaaataaccttgttgtatatagaactactttgtccatctctaacaaagaaatacccaagttcttcctaatgccctcacgatcctgcctatgaggaataaaatatcaatgagccttaacgtaataactcagtttcagggaagagtagagagtattttacaacaaatgggaatgctaaataatgaattaataattatagagaagccaggttgaataattctataaattgatatatttaccaaataagtaatcacaaagaggctctaagataaataatcataaactgaatactactcttttgtgagtatgttctcaaga

SEQ ID NO: 160058 - DNA, 443 bp, Homo sapiens
taaccatgagttgcaatgcgtgttttgcatgattgaacttttgtttttgagacagggtcttgctctgtcacccaggctggaatgcagtggcatgatcttggctcactgcaacctctgcctcccaggctcaaggaatcctcagtctcctgagtagctgggactacaggcgcatgccaccatgcacagcttatttttaaatttttttgtagagatgaggtctcactatgttgcccaggctggccttgaacttatgggctcaagtgatcctcctgccttggcctcccaaagtgctgggattacaggcgtgagccactgcacccagcccatggttgaaattatagtgcgtatatagtttgtattttgttaatctaacagtgtcactgtaattttttacttcgttatattcttcacagtcattatcaacattgcataatattccatca

SEQ ID NO: 160059 - DNA, 272 bp, Homo sapiens
caggagacggaggttgcagtgagccgagatcatggcactgcactgcagcctgggcaacagagtgagactccgtctcaaaaataaaataaaaaaatcatgaaacttcaagaataataaccatgagaatcacaacattgtagtaaaaatcgtgaaaatcaaaggtgaagaccttattcctgagctgtgatgctgtttaaaaattaggaaaaaaacctaacgcctaacatcacactacttggtgaaagtgcttgttttgttggtctacaattagg

SEQ ID NO: 160060 - DNA, 937 bp, Homo sapiens
tcaaaacaccacccagtgattgaaaactgcatagcttcggttttccggttaattatgggacactggggcctttggttgactgatgagcaggacagtagtttggacattctgcattcaggaaaatagagtggaaggcaaatgtctcccactgagaagtgtaattgcagagttggccatgatcttatttttagatggaaagttttcactgaaagaattctttttgcagcaagagaagtagcacagtggtatgctgaaagctgaggtgggaacttgtggcttcccttaccttgtaacgagcaggtttgagctggtccttcccaagcacagtaaataaatgtcactttgcatgggagaggagagaggaaaaatgcagcttcccaggccgttcagaagagcagttttctttgttaaataagtttgaaagtcataggggcctttttagttgaggactgagaaagagctttctctggtcaaatatagagttagttggcaggccccagtggttggggacctggctctgagaacacacaggccagggctgaatcctggtcctctcattgagtaatactggaacctggcaagttgtctgaacgctcccagctgttaccacatctgtaaaatggatgtgatcctagtgctaccccctcggtttcttttgaagattaactgagatagtgcccaccacagcacccagcacagacagacctgcggcacactgaggggccagtaagcgcgtggctctggccattgatggtctcatcagtgatgggaatgccaccatcggtgctcccaagtaactgattacaacaagaagcgtcttcacaaagtagtaggaatcgccttgtttctctgtaatctggaaggatttagatgatctgccgtgatcgacgtgaatgtattttctgtctctctctgactttgtccctgctgcctgttt

SEQ ID NO: 160061 - DNA, 363 bp, Homo sapiens
tgttattcctcttcaggacgaggacaagaatgggacagacggctgctctgccctcaccctgactcagaactctcttcctctgcttcttcagagtggactacattccatgaattatgctaggacatgtgcacgtggtttaattgaggttggtagcctgtcgagactgaaaacaaactgctttaaaacatcaccctttacaataaaggaactgcaagtttggggtgcatctccgagactgttctctatggagcagcatttcaaactgttctgtaaccatgcacaatgtaaaaaaccaaacggtgaccaaaccatgaaggcagaatacaacatgtcaacatgctgatatccttgcttgttccgctg

SEQ ID NO: 160062 - DNA, 601 bp, Homo sapiens
ctggccgactctacgaggaccccatacattgtctgatgacaggcaaattattagaacaaaaggatggcaaacagaaaatagtggcctgggtactgggtcacttctttgagtaggtgccccagtctgaactgccttgcttttcacttttctgttcttttctctcgagataaatgaactcctcctgcctgttaaagccactggcagtcagagtttccagtgcttatagccaaataccattctaactgatgtactcaccaataataatcgtaacttcctttcatatgacacttcatggtttcttcatcagcattatgtgtgacacacgcaaaaacaaaaacaaaaaaactgccaatgtatctatttcaagacatccccagaattctgttattaaatagcattgatgaggcagtcagccagaatgtttaagctgtcctaaattactgcctcctctgtgtttagggagtctgctcttggtcttacaagtccaaaagcagaatattacaaattcacatagaagtgatcaggatctagagacttgatttatgccatgcagattcacagggcatttgtttataaaatttgtgctggaagattacttgtg

SEQ ID NO: 160063 - DNA, 345 bp, Homo sapiens
tatttagaatttttagtagtattttgacaaatatagatgctttcctaaggcatatcattttgtaaaaattgtattgcaaacctttttctcttgattttcccttccttaacttctcccttcctttcctcccgccccttacctcctcacctctcatttatgggtctgtatatttttcaccttaagaataatgattgtagcctgggacttgtcttataaattcagttctttctaatgaggcactaaagctgtctcctggcttttgggttttcctgagaactgttaattacctttgcactttcctatacccagctcaaaagtaaattgcagagggaagagaggatgatg

SEQ ID NO: 160064 - DNA, 114 bp, Homo sapiens
ggcaatttagcttcaccacagctaggctatatgcgacactgctattacaacacacagcttttcaagtccttgctttaaacaccaattagaaaacccagaaagggagaaggaaag

SEQ ID NO: 160065 - DNA, 403 bp, Homo sapiens
cgggcagaacccctgaggtcaggggttcaagaccagcctgaccaacatggtgaaaccctgtctctactgaaaatacaagtattagccaggcgtggtggtgcatgcctgtaatcccagctacccaggaggctgaggcaggagaattgcttgaacccgggaggcagaggctgcagtgagctgagatcacaccactgcattccagcctgggtgacacagcaagactctgtctcaaaaaaaccaaaaaaagtagtgactgagggcctgtgggactctccacagaacaaagcgaatgtcttcattttaatgtgtggatcttgtgacgttgcttagcttctcagaggccttatgggaccacctttccatgtgttggaaggattcatcatttgagtgagaatgctgcttt

SEQ ID NO: 160066 - DNA, 741 bp, Homo sapiens
acaaatgagtagttcctggaatggagaagtggccgcccatctgggagacaagaaaggcaagaggggttggtgggagggagaggtggctgcacgggctgttctcattcatttgcttcctgaatcctggaaacagccccagagagtggagtttgcccactggacagatgggcacaccgcggcttctcaaggctgtccagagaaggctacatcccagcgctagccactgaggcctgatcacgcaagaagccccttcccaggctccaaaggagggcccccaatttgtaggctgtagctgggaggcgggcccctgtgttctagcactcggaaaggaatcctgaagtaaggtacccccagagtcctccttccagctgagaggggaagtagggtccaaacctcctccttcagctctgttctcccctctaccctcctaccacccctttccagagccgttgtgccagacactcaggggtagtcatgggcagactaggagatggccagacagacagaagaattcacacggaagagaggagccagcgctagccaggaatcaagctgtaagagtcagccagagagaatcaaacagggtcccctaggagtcagctagccagtcagacagtagaggccagctggtgtcacccaacagagggactgctcagtgttaaagtctgtgaggggcacggatgggcggccagacagcagaggtcaccctggacagctagccagacagcagggggctgccag

SEQ ID NO: 160067 - DNA, 915 bp, Homo sapiens
ttgctagacacgggtttctctaagagatctgtattctccacagtctgtatacagaaaagatagtctcaaatctcctctgatttagggccctgataaaaattacttggtcttctactctacaacctcaccataccccttcaggttttgaacctgggagagacagaatatggaacactttcttaaaaataaatgcatacttgacattaataagggatttacaatctattcactatgaaatcctcaggaacatgtaggtttttccaagaagtaaaaaacaattattttcatttaagtcatatgtcaattaacaatattttttacacaattaaaaatctcatttttgttatgaaatgtgaaacacatttcctttgtttttgaggcagggtctcactcttgtcgcccagactgcattgcagtggggtgatctcggctcattgcaacctctgtctcccggattcaagcaattctcctgcctcagccccccaagtagctgggtttacaggtatgtgcaaccatgcccagctaatttttttttgtatttttttcagtagacatggtttttttttttaaattttattattattatactttaagttttagggtacatgtgcgcaacgtgcagatttgttacatatgtatatatgtgccatgttggtgtgctgcacccattaactcgtcatttagcattaggtatatctcctaatgctatccctccccactcccaccaccccacaacagtccccagtgtgtgatgttccccttcctgtgtccatgtgttctcattgttcaattcccacctgtgagtgagaacatgtggtgtttggttttttgtccttgcgatagtttgctgagaatggtggtttccagcttcatccatgtccctacaaaggacatgaactcatccttttttatggc

SEQ ID NO: 160068 - DNA, 482 bp, Homo sapiens
acaagtgcatgtcctccgtggcaaatgaatatgaacatgaatttatataaatcagagcaactctggaagatcattgattgaatcatcacatttaattgcttctcttgcattccaaacacattgtgaaatggatacttcacaacgggccggaaacagaaatacataaattctgcttatttctcaatgagcctaaaaaggaaccggaaaataccactccttttccagttgatgtaacagaattgaagcagcgttaagaatgattccagaaatcaagaaactggtttgagacctaggtccaccatttactgacagcaaatggtcatttctggccatttcacctttctaagccccaagtttcttaacagtaaatcaagcattttagctatacctgatataaatgccttgtaactgcccaagtgaggcagttaagtaagtgcttggtaacagtaagaaactagaggtatgttatagtcatttggact

SEQ ID NO: 160069 - DNA, 507 bp, Homo sapiens
cgcgggtagacgagctcagaggatcccgttaggcgcgttcagcggggccaggaatatgaacatgaatttatataaatcagagcaactctggaagatcattgattgaatcatcacatttaattgcttctcttgcattccaaacacattgtgaaatggatacttcacaacgggccggaaacagaaatacataaattctgcttatttctcaatgagcctaaaaaggaaccggaaaataccactccttttccagttgatgtaacagaattgaagcagcgttaagaatgattccagaaatcaagaaactggtttgagacctaggtccaccatttactgacagcaaatggtcatttctggccatttcacctttctaagccccaagtttcttaacagtaaatcaagcattttagctatacctgatataaatgccttgtaactgcccaagtgaggcagttaagtaagtgcttggtaacagtaagaaactagaggtatgttatagtcatttggact

SEQ ID NO: 160070 - DNA, 725 bp, Homo sapiens
aatactgttgctcccaatcctactttcacaggggacagaggacagggaagaaaagtgattccaaagttttaaatcttagggaactgaaccgaagctgatgggcaagtagcatatggaaacaaatgaggagaatgatttcaaccagggtaggtcctaggtaaaaaaagttggggaagcttatacattttagggtttacgactgcctctcagaggatcaaactggccttgcacgttcttccttccctcttgcagctgctgtgaacacagcccttctgctgctctgcggagctgcccctcctacgttattcctgctgtttgctctctcctcaggattggagatacccagtacaccttgctccttcttttccttgaggctttataactttacataagggggacaagtttacctaacaacacagggaagagtctaatattaagaaatatgcaaagttcttttagtcgtggatgctggtctatcactcctgcaacccttttgagagtaacggaaagctctgttgagtctcaacttttctttcagtgggcagggctcaccaagtctctctcccggcgtagggcaggttgaccccttccatgagccacggaagaggcaatctgagcagcaaaaggtgcttctcccttagaagtggggaatataaatgctcacctggaccccagaggaagcgcctccttgggccattttcttgtacatagcctgtggaaaagta

SEQ ID NO: 160071 - DNA, 475 bp, Homo sapiens
aatctatatgacaaaggactcatatccagtatatacaaagaacttctataaacaataagaaatgggcaagagacttttaatatgcactttacaaaagaggatatccaaatagccaatatgataagttgtttaacttcattagtcatcaggggaatgcaaaataaaacaatgagataccactacacaaacatacaaccattaatttaaggttaaaattaaaaagcttcacaatatcaagcgatgatgaggatgtggaacatctataactctcattcactgttggtcagaaagtcacttagtcaacagtatctactaaacctgaaagccaagaattaagaactcattcacacatcacttcttggctttttgggttagatcaagactagtatctgtccttcgtttagcaatacaacagccaggaatttaatttttgatatattttaaactacattaaatattgagtctgttgccttta

SEQ ID NO: 160072 - DNA, 513 bp, Homo sapiens
ttcatagggatctctgatacccaaaaggattaataataactccagagggagcagaatgaagctctccattctggtgatccttgatgggtccatgaccacagggagaagtcgtgtattggactagtctagaaccctaggaggaggttgtggggaaatgagagtgggagggagaagagtggcaagtgtgcctgctccaggggccgcaggtcagcagctgcaagtcctgctgtaggtcctggaaggaaaaaggctttggagaaatcacgagtggcctttgaaagcaaaactttcggaaaatttcacagaggcaagatttgagagggtgaaagaaggcttgggtgaatgcccttccatgcattcattcatctggtagttgacgtttattgaccgcctctagaatgccagaacctgctctaggtgcccaggactccacagtttgcaaggtagacggtgctgtgcccttcttggagcccaggactccacagtttgcaaggtggatggtgctgtgccctt

SEQ ID NO: 160073 - DNA, 420 bp, Homo sapiens
ttcaaaacccaggcacagccagttacttcacccccttcccccgtgagcaaaacaacaaaacaactaacagtgtgaatcatttttcttcagctcttggtcattattaagacaacaattaggggaagtgttattctcagattgtctttttaaaatagacacattaatgatactatataaaaccgtgagatttatttaaaatattttcaatttaaggggtgtgcaaatcattaacaccagatggcatctacctaggattttttaaaaggtggatttgggatacttgtagccaaaatgtagaaatttagcttataaacagttactgtgccaacagattggtcagtgcaaattgaacgtgtcgatgcaagaggatttagagcttttgttgtccatctttcctgctaagctctggtacctccctga

SEQ ID NO: 160074 - DNA, 364 bp, Homo sapiens
attttcaagatcgattatcttaacacaaggtaaaatgcttaaacttgtattaagaggctctcagaagtagcatcgggctagtttctaaaggatcacttttagagttaccaagtttaagaacacacttctggctgggtgcggtggctcatgcctgtaatcacagaactttgggaagctgaggtgggtggattgcttgagcccaggagttcaagaccagcctgggcaacatggtgaaaccccgtctctactaaacatacaaaaaattagccgggtgtggtggtaggcgcctatagtcccagctacttgggaggctgaggcaggagaattgcttgaacccaggaggcagggaggttgcagtgagccg

SEQ ID NO: 160075 - DNA, 197 bp, Homo sapiens
cctgtctttttacttcctccctttgcttttcagcagggtttaatcttgatagacatttcaaggatcactgttctcttttgtgttttcagctaactagttgcatctatcacattattattgatttttgactctagctcttgtactaaagatctttctttgataatatccctcataataggttttatagtagattctac

SEQ ID NO: 160076 - DNA, 377 bp, Homo sapiens
tcttgcccatatatttatcctttctatgacatattcattagaaaacatactgaagaaaaccaagtttggtttgggaaaactcatggggcttcatagtgaaaggtaattctgcaaaagctactggagatttaaaaggcactaatattgaataagctgacagaaataaaccaccagtccaataatctgtttaaaattcagaattttaatggtgaccaaaaatcttattagtagcagggggagactagggaaaagggataaacgcattctgggaaagagtaaatacctgtgcactcgtgcccaaaatagacatgatttgtcctcaaccacctctcctgagtttagccctgggccacatgacaaatacaaaacagatgtcc

SEQ ID NO: 160077 - DNA, 231 bp, Homo sapiens
gtatggcatgaggctgagatcccgtacttttttttcttgacaattattccttcataagagatcctgtactttaaacaagcacttcattgtaattggcaaaaaatcaaaaataaagagttttgaataataaaatcatttttccattttacaaacatcactcaatctacttgtagaggatggcccagatgccacgaaataaaaggttatggacacactgctaatagatgagag

SEQ ID NO: 160078 - DNA, 516 bp, Homo sapiens
cctctttcttaattagttctgaactcaggagaggaagatgttatttattaacaccactccctcttaacattagacaacacctttgttttaacagagaattctatacaaatggaaaaagtgagatggtctggatgagatgctctgccaagctgtcaaccatccatgccttggaaaaacctacccactgagctggatagttacccccaggcaagtgctcgcttacagcctcaaagcctgagggcctggggcccagaagaacacaccagcctgcagacaaaggcccttgaacttctgagcctcctaaatgacaacagataccatgaaaggccttcacagggtcctcacttgatcttctgtcaatagggaaaccattagagattgatttctgggaaaaatcagacagtagtattgaaatcatcattcactcaatatgaagtttcaaaccgcagctttctcagaacagatatctaggcataccttggagatactatgagtttggttccagaccaccgcaat

SEQ ID NO: 160079 - DNA, 502 bp, Homo sapiens
tttgtgagttacctaacataattttccaaagatacagaccttttagtttgtgtgcctcatgttgtcattaaaattctacctgaagtcacaagcaccatacacaacagaattagtcccctccaatttgccctatagaagtaagttgggatctccacaatacaacttactgtctttagttttgatatttaacctcatactcctgaataatgttccatacactatttcttgattattttagttttagaaatgatccagtaacctactactatagatgataaagatgcagtccattaaccccaccacctgaaatgcacacacacatgcttatttgatagactgtaaacattattcactatttttgttttaagtcagtgttcagcgtagcttggtgtctttcatcaatttggaaatttttcaaccacaaatattctgaaactttcctctttttctaagatcacaattatatacataactgacactgttttatatgtcacttatgctt

SEQ ID NO: 160080 - DNA, 481 bp, Homo sapiens
aatcaacaagaaaaatattaggctattcctgcatgaaaaaagaatcacaaaaagtatgaacaattagttcacaaaggaaacacaagtgagtcttaaatgcatggcaaattcactcttgctcataataaaagacatacaagtcaaagctcctctgagaagattttctaccttttagattggtgataatgaaaactctgttgatgctgatatggaatgttaagttgggatacctgcagtatgtgggaagaaggggcagtggcaatttgctctttaaaaattagtggtgctcatacccattgacccaacaatttcacttctatattcacaaatacactcacacatgtgcaaaatgatacatatatgaagttattcattatagcattgtttgtaataatgggagaacagaaacaagctagatgttctaaaatagtaactggtcaatgcactacggagcttgcatggacttatattgtgtgcacct

SEQ ID NO: 160081 - DNA, 735 bp, Homo sapiens
cacctggctgcccaccccaatttcagttttcctctaagagttagccactattatcccttcagagtggatattcaggcttttctttcctggcatggacatacatatgtaaatgtacatatataaaaataattagtgacaccatgcatggtagctcacgcctgtaatcccagcactttgggacgctgaggtgagagaattgcttgaggccatcagtttgaagctgcagtgatctatgattgtgcctctacactccagcctgggtgacagggtgagaccctgtctcttaaaaaaaaattcgtatttggggttagtagtagtacctacctcataggttattatgggatcagtacagtaggccagacaaagtgcgtatgctattattttgcatgtagtaagtaccagcatatactacctgttatccagaaatttgctgaaatgtgccttgtattttctctctttcgattttgatcagtcttcctagaagtcatcagtttgagttttttcaaagaaccagttgttggttttattgattttgtttgttttctttttcattgatttctgctttactctttattatttccttttttctgctggctttgggttccatttgttcttctgtctcttctagtttcttaaggtaaaggcttagatcattgacttcagattttttgtcttttctaacaagtgttcaagactataatataaatttccctctaagcattgtttagccacatt

SEQ ID NO: 160082 - DNA, 134 bp, Homo sapiens
agtgagtatcaggtaggaggaaggaaaagaaaaacttgtcaggccagtcaccaagttagcagacagccaaagggaaagccgcctttccattacgatggattttaactctacccgccttcttcccaaaaggattg

SEQ ID NO: 160083 - DNA, 293 bp, Homo sapiens
tgatgagaataatctggctgcttctttggtacttcagttcactgatactgcgaattagagtagcatatacagaaggatgcagggggtccctaaaggaatcacagaattagtgaaaccattatttgagagtggcagtgattcttctgtcctggcacttttcccagtttgggtgcttaaacttactatccactggaaatgtgtcactgcctgtcacttcacaaagtatgtgcctttcactgcagtcaacaagctgtttacatctttgatgaaatgatggccacgcatctccatag

SEQ ID NO: 160084 - DNA, 667 bp, Homo sapiens
ctacttttcacagggtgtggcagagtacagccaaggaggacacagaaaacaaaccggtgcttagcactcagaacgtgcctggcactcctttaagcaccttccatgtttagcttgcttaattaatcttcacaacaaccctaaagaaagtctgacactcatttcacagttaaggaaaatgaggcacagacaggttaagtaactgcccaagatcacacagctagtcagttatctgaaaccccagagtcagcatggctccgtgattcctgcttcagcacagactgtgatgtcaacactgtgctagtctttacgaccgtccacctgtgccagctcaacattaaacagggccaagaaagcagctccagctttacctggagcaatgtgtatgacagtgaataactccttcaaataagaaatatgccaaaaataatctcatattgagagttgtaaattctaatcttgtaaatcaggctaataaagatataacactaagcataaatgttgaaaatgagtaacaaaaaaaggttattcaaagatctgctaagaaaaccagtaacgttaagaataaaatcctgctcgcgtctcagcaactccagagcagacaagctttaatgctgtcaggaaatcctgtgtgctggtggcacaaagaccctccctgtgtgcagcgcta

SEQ ID NO: 160085 - DNA, 534 bp, Homo sapiens
ttcccctctatatctcatacacagctttgttgttctataaccttctacaagttcctaggctggaaatatctgcctaccacaataaccttggcttttatattaaaagatgcccattaaaatgaaaaaacaaacaacagcaaaaaaagaaaagaaaaacaactagctgaggaaattggggttttgaagacatacaatctaatttccacttactagctgtgtgactctgaggtccagagagtcatagatttactcagtgtttgcatttttaaaaatggagccagtgtgacttacatgatctcacaaagatgctgtaaatgtgaaatgagttcacaggtgtaaaaaatgtttggaaactacaaagcactatacaatttattgtataatagaaatttgagaaagtatgtataaggtatgaccaaagtttatttatgaggtggtagaaagacttaaaatttctaagggaaatgggtggctctgggcacagtatctgaagagagaggcacctggtggactctgaattttgcaggtcctgag

SEQ ID NO: 160086 - DNA, 493 bp, Homo sapiens
tcattacagctgtctgagaagcagagggagattagacacacagaaaaggaggaggcaatctgaccgtgtaggcagtaactggagtgatgtggagataagccaaggaatgccagcagccaacagaagctggaagaggaaaggaacagattctcccctggagactctggagagagcatggccctggtgacagacaccttgaatccagcctactaatactgagttcagacttctggcctctagaactgtgagaataaacttctgttgtttcaagccagtagaactggtaatttgttaaagcagccataggaaagcaacacacggtaacttctttaataattcactgtcctaggtttgctgaaatcagttctttgcaggcttctttaatgattcactattctacctggatattcaatagggggaattcctcaaaatacaggacaatctcatctcagaatctttaatgacatctgccaaaatttcccataaaagataa

SEQ ID NO: 160087 - DNA, 518 bp, Homo sapiens
gaaatagaacctgtttcacatggttatgcagaagacaacaaaagatagcatacgtaaattgcacgatagctaagtactcaataagtattagttctttctaatggatagacattttttaagggaggtaactaccagttcagaataagaactaattttctagtaattcttacctttcccaaattgtgacgtaatgaaatttcagcctagaagtgtttagttaatcatcctttagagacgttgtaaagggaaaaacattgaatggaggttgggctacataaactttataaatgactttttagatatttaaacagtgaaattctttattcaaatgaaatctcacagaagcagggccactcccagtaaaacagggttggggattctagagaccccacctgctaggctccacttttgtggaccccttagggttctgaggagcagagcttggaaagtgaagccaggacataagggttctgtgtcacctctgtcacagctgactcagtgaccttcagtgagtccat

SEQ ID NO: 160088 - DNA, 250 bp, Homo sapiens
tccttatcatccctacattcagttgattaccagcttgtttcttgattgcttcaacatctctgcatctccactaacagcattctcttctctattatgaaaatctcttatttagtctacttccacttgctttccttcaatccattctcttcacagcagccaatgtgattaaaaagaagaaattagaccatattactgtggtttgcatcacactgtacttgactatgcatccaaattccgtagtgtgatctgt

SEQ ID NO: 160089 - DNA, 179 bp, Homo sapiens
agcatgtgaaacatattcatgtttcgcaggaatgtttgccatcgccttcatatctgaagaggattattccatgagcgtgatctgtaggcacacgtgtctgaataggtcctgctgtatatgtgtgcgaggacagtgtgtgtttattttgtcctcttcttgatggttgacacagtcggcaa

SEQ ID NO: 160090 - DNA, 281 bp, Homo sapiens
gttttttgcactgtcttcaggaactttacaattccacactgccgtttcacctctcagactgtagttgactttcatcctgaatcctcatcttctcacagagggtctggcacctggtaaatgcctcttattggtcttgtggaatgcatgaccacagacctgaaacagttatttcccactcctatttgtgtttatttgctttgaaagagaagaaaggtgataagaaaacaatatttagccatgtgtaatttttttaaagtttcattagcaagttcatgagatga

SEQ ID NO: 160091 - DNA, 497 bp, Homo sapiens
acatggagcaggggaatcaaactacgcaaacgtcgtgatctcagctacattacaaagaaaaagaaaatggaaggagagatgcccagatatcaacagtcatggtctttgcacagtaggatcgtggatgattttcttttcccctttgtattctttttgtattttctacagtcactgcttttataatcaaacacacatgcacacaggacgtgactgattctgttctcagagaaagctcctgagacccgtggccctggaggggtcggaaaagatgctggcctgttggtggtacagtgggggtctgcacctgagggggtgagagattaggtgactctggagtctaggggcaggccttcaactgctatgcctgccagcctaggaatgaggaagaagagggccccctgggcagatgggggtctagggtactccagacttcagccaagctttgcctaatagtggtgacacaagcccaggcctccagaggtgcctctgaggcccta

SEQ ID NO: 160092 - DNA, 442 bp, Homo sapiens
cagggctgctcaggcatgcaaagggctcctcctacttgacatattccctatctttggggcgtggggcgtgtatgtgtattggccgcatagttgctatgggtgaatggacgaagggataaaggcatgaatgaatgagttgcatgtgtttatctgctgtgcatgtgtgagtgtgagaaaaaaaatcagaagatagagacagacacagagaaggaaggatggtgctagggtttgaatgtccccctccaaaattcacgttgaaatttaatcctcagtggcagtattgagaggtggggcctttaagaggtgattggatcgtgagggctctgcacccatgaatggactaatccattcatggattagtggattaatgggttaatggattaatgggttatcctgggagggggactagaggctttataagaggaagagagacctgagctac

SEQ ID NO: 160093 - DNA, 141 bp, Homo sapiens
cctcgtgatctgcctgcctcggcctcccaaagtgctgggattacagacgtgagccaccgcggctggccaacagttatatttaaatttaaaaacaataggcagtagtgagaagggaagaaagaatagaacagggagttccat

SEQ ID NO: 160094 - DNA, 267 bp, Homo sapiens
gagatgctgagtaggcagtacattgcaaaagcctgaaattcaggggagaagtttaagctgcagacaatgtggatatacactaatgactactaatcagtagtcctgactgcacccttgaccgctagattcacatatccaacttgcctgcttaatttttcattgagataactattaggaatctaaaatatgactggttcctaataaaactcttgattccctcctaaccctaaattcatggttttgcttagctcagcaaatggcattgtt

SEQ ID NO: 160095 - DNA, 738 bp, Homo sapiens
cccgtttcgccctaaaaatctggagatgacggggctactgcttaatcatgacagtgtggggaacggtgtggacaccacacttatgaaagaacatcgctgggatggatccagacacatcagaatggttctgggagccaggcgcggtggctcatgtctgtaatcccagcactttgggaggccaaggaggctggatcccttgagcctagacgttcaaggccaaggccagcctggataacatagggagaccttgtcaaaaaaaaaaaaaatacaaacaagtgtagaaccctagctgcaagagaaataggtatttcattgacacatctgtcatgattcagtatacactgataagctctcaatagagacctctcataaatcaggtgaatagtcccataaagcagtgcctgtctcatagttgcctcatgggcttgttttgaagaggaaatgaaatgtcacagacttgtgtggatacccaataaatgtcagtgttacacaagtttttacttcatttgatgttgaaatgcatcctgtgctgagatacgtccaaagatatacaatcgcaatgatgagggccctgatttttcaataccctgcttaagctgatgaactggagacttccaacgggctgtgatctgatttgtaaatttgaagtaggaactggggaacaaaaaagcacttgtttacaagcacaaagtcatgttttctgatgccataatagctcttggatggagatgggggaga

SEQ ID NO: 160096 - DNA, 564 bp, Homo sapiens
cccgtttcgccctaaaaatctggagatgacggggctactgcttaatcatgacagtgtggggaacggtgtggacaccacacttatgaaagaacatcgctgggatggatccagacacatcagaatggttctgggagccaggcgcggtggctcatgtctgtaatcccagcactttgggaggccaaggaggctggatcccttgagcctagacgttcaaggccaaggccagcctggataacatagggagaccttgtcaaaaaaaaaaaaaatacaaacaagtgtagaaccctagctgcaagagaaataggtatttcattgacacatctgtcatgattcagtatacactgataagctctcaatagagacctctcataaatcaggtgaatagtcccataaagcagtgcctgtctcatagttgcctcatgggcttgttttgaagaggaaatgaaatgtcacagacttgtgtggatacccaataaatgtcagtgttacacaagtttttacttcatttgatgttgaaatgcatcctgtgctgagacagcatatacaggggatcctctagtgcat

SEQ ID NO: 160097 - DNA, 379 bp, Homo sapiens
aaatactttggagaccatttgtttaaaggaataatccccaaatcgccacataattccattccctaaacagctcaaggaatttatatcattagagctcaaacttgcccaggctcagtggctcacacctataatcccagcactttgggaggccgaggtgggcagatcacctgaggtcaagagttcgagaccagcctggctgacatggagaaaccctgtctctactaaaaataaaaaaaaattagctgggcatggtggcctgtagtcctagctactcaggaggccgaggcaggagaatctcttgaaaccaggaggcagaggttgcggtgagccaagattgcatcactgcattccagcctgggctacagagcaggattctctc

SEQ ID NO: 160098 - DNA, 244 bp, Homo sapiens
atcgcttaagggtacaaagtgtctcccaaagtgctgggattacaggaatgagccatcgcacttggctatatttttgcaagttttgttgtgcctgaattgctccattccttttttttttttttttttcttttttgagatggagtttcactgttgttgcccaggctggagtgcaatggcatggtctcggctcaccgcaacctacgcctcctggatttaagcgattctccttcctcagcctcccaag

SEQ ID NO: 160099 - DNA, 356 bp, Homo sapiens
tatcaatagctccccagattaataaataatttcagataaagaagaaatgggcccactccaaaaatcttccattgccaaattcttgatgttgcaggtatctttcatctgcatgaagagtttggaaggcccaggttctaggcccagtcctgctgtaaacagctatgtgacccatgacagccacttaactactccaggcctcagttttttcatctctaaaatgagagggctggaccaggtgatctcttaaggcccttccagctacagcattgtatggtctgagcccttctggttaattgcctctggatgattacatttattgtgtttattaagcagtttggggtttctccattcagagc

SEQ ID NO: 160100 - DNA, 465 bp, Homo sapiens
gcaacctattttcactctgtttttacttcgcctaattgggcttcatcccatttcagaggacggacaagatggctcagggccggctcccttgaagaccgtcttgagaaagggctagagaggcttttagtgcaagccccacgggatcacaagttgaaagaagtatttacatgtgtcagtaccctctcattcctgaacttcaactaggttcagggttcagtattgcaatcacattctcgtaagttctggctttgggaggaagatggagtcagtaatgcataactttgatttttttaagtaatcatgatatttgggtagaaataactcaattccaaagaattatttagattagtctaaagttgtttttttttcctgattttgaaattgttacaccatgacttttcaacaaactcacctctttgtttattttctattatgcttacatcagaatacataacattccctagc

SEQ ID NO: 160101 - DNA, 239 bp, Homo sapiens
ttggtgaaagattattttgaattatgtttggttggggaaaaattatgctggccttggtatgctgagtgaattagagagctttatttacttttttttctcaagtgtctctcccctgacaccccctgcccttgcctccctcactttactcagaatttaagcttcttaaggctgattggtgctgtaagtttcctgtgctatatcccttgtaatagtgcctctcacacagcgtagtagtgtct

SEQ ID NO: 160102 - DNA, 265 bp, Homo sapiens
ctaacatttgtttgttataatttgttctcggtaagcctttttctgtgttttgcttgtggttccattagcttctagatgagcgcttttgtatatctaatttagaagctttacattaagaacagtaagagaaaatcctttaaactgtatttccacttaaagtaagattataataacatatgctccaccacatatagatgttcacaaaacataagcaagtatgaatattttttcataaccacttatgaagaaatagcagggctcctat

SEQ ID NO: 160103 - DNA, 232 bp, Homo sapiens
atgcaaagaggtacaactggtgcttcaaacagtacgtccctatttggactgaagacattgtttcctatcccggccagcttctagtgataactccagtctgcactatcaatcttttccagcctctacaggctgtttctttcagataaggaatttccctttataaacctgtcagctgacaatgactatgctttgttttgtttctcatttgtttctgtaagcccatctgttcctg

SEQ ID NO: 160104 - DNA, 272 bp, Homo sapiens
cagagctgtgagatagtctagtccaacaggttctcaaacttttcgatttcaggaccctttgactctattaaaaattgaagatcccaaagagattttactgtgtaatatatttatcatgttagaaattagaattaagaagctttaaaactattaatttcatttaaaacatatcaataatgaaacctatttcatgttatgtgaatgatgacttcatcgtgggtattaaagcgcctcaaaaattctactctatgcttgttgagagagtaagagtg

SEQ ID NO: 160105 - DNA, 753 bp, Homo sapiens
aaagttttacccagaagcttagccaacacctaagtttctccaggaatacttacagatacgtagaatgatgtttgcaagcacagccaatgatttatatctctgtgatgatataaaaagaatttagacattttctatccaaagcactctgcctataaaataaggaaataacctggaaattaattttctcttcatttcattatgcagcattaaaaacagcctaagactggagtttaaaaatatattttttactttctcttttgctaatctgttatgtgattatgtgaaattaattaacttctttaggctcaagtgttacattctgaaaaatcatggtttatgttgtcccaatggttctattcaatttcaacattcccgaatttaaattttcatttatcagttatctgccataaaatgttgcacttgaactctcactgcttcattcaatagattcaaattcatgtcccaaattatctctgtctaataaaataaccttagaaaccactgccttctatagataataataaaactacttaagctttgatctcattttattcctataaattatattttttggctttgcaaaattaaacagtataattttacccatgatcataagcaaaggctcaaaaacaaaagatcaatattaatgtcattgagagctactacttattgagtgcctaagtaatgactgttaggaatcttttacattttttaccctcacaataaccagcttgaggtaagcattagcattcc

SEQ ID NO: 160106 - DNA, 252 bp, Homo sapiens
agataaagccatagcttgcctgactctcaacttcaataatttccccgttattctatattagattataaatgtataagtgtgaatttataactgcgcccagcctagtcttctcttaatatacacatgtgatatcatgcatgaaggtggcatgtagattataaaacataggaagatgtaatgcagaataacttttattatgtattaataagatgcttggttgtttatggaggagtctgggaaagttatagatgt

SEQ ID NO: 160107 - DNA, 656 bp, Homo sapiens
tggcagatttgtaaccatctaagccaagaatctgacaaggatattattttttctgtttcttctgattttattgaggtctttttcttttgaacccatctgtttccccatctttctcaaaacaccctgagtataccagggtctgcacgtcttatgaagtcaaagttagaatcacttcagttgtgagcttgcctttcttaattacacaaacttcttctgacaataataggtataaactagaatgacataatttgatgtaatataagaccatttttcagagtacagaaaagcatattgtattcaccttgatttgcaaatatctcatgaagagaattactttattctttgggcctatttttcacttgtaaagctggcctgggtccccataaatactctgtccagtttaatttgagtttaacatgacactgaggagtagtctgatattactcagagagggtgatacaactctgaacttgttggcccttatcagatataatttaaatttcccctggaaagggaaataagcactttgaatcaaggcaaagagccaaatccagcagattatcaagatggtcggtgggaggaaagtctgatggtttccgctgctaagcgtgggagatactgacctactctcattcacttacttttgtacatagatg

SEQ ID NO: 160108 - DNA, 454 bp, Homo sapiens
gactctcaaaaatccagtgattccaagagtaaatgtgcaatattcagagttttattgcccaagaagagcttggtctcattattagggattcatatcaggagtcaacactccagctatcctgtggttgccctgatttgaacactttccaacctgcttccatctcgcaacttctaactggttattcatccttcagatttcaaacgaaatgatgcctcctttaggaagccaatctggaacctccaaaattagacaaggtgcccaccattaatgtctctttaatagtttgcattatccttatgataacccttacgtcttgttttgcaattacttatttagtgttcctttcctctctaaactccatgtgggtagaaatttgggctttccatccttagggtctagcaaagagatttttccatatgtttttattcaataaattagttttttcaataacata

SEQ ID NO: 160109 - DNA, 452 bp, Homo sapiens
gctgtgtctctctcccaaaattcacatgttaaaaccctactccccgatgtgagaatatcaggaggtgaggcctttgggggtgattagggtgaagccctcatggtgggattagagtctttgttagaagagacacaacagagatgattgtttctcttcagccatgtgaggacaggacaagacgtccatctacgaaccagaaagagggatctcaccagacaccaaatctgctgctgccttgatcttggacttcctagcctccagaactataagaaataaatgtttgtggctgggtgaggtggctcacacctgtaataccagcactttgagaggctgaggcgggtggattacttgaggtcaggagttcgagaccagcctggccaacacagtgaaaccccatctctaataaaaatacaaaaattagccaggcatagtggcacatgcctgtaactcca

SEQ ID NO: 160110 - DNA, 250 bp, Homo sapiens
gaaagagggaaggagagagagaaggaaaaagggagtgaggaagaagggagggaaggaaagaagggaggaaaggaagcgggaaggaggggaaggaaggagagaatggaaggaaagtagggaatggggaaggaaggaaggcagggagaggggaaggaaggagggaaggaaggaaggatagaggtgggaaggaaggagggagggagggaaggaggaaaggaagaaggaagggaggggagataatgggggtggg

SEQ ID NO: 160111 - DNA, 381 bp, Homo sapiens
gacaatcctgcttacaaagaagagacatcgtattcaccttcccctgaacagtaatcactcccacctcccaggctctgcctttttacaggaaaggaaacatccgcatgtcacaaacaaatgcctttgggagccataccattatataaaagagccaagtaggatgcgtaaaaggtacattttgatagaaacgtcttatttggaaaacagagtctttgcagatgtaatttatttagggatctttccccttagcgccacaataaaaaaaaatgtgtgatgataagtgggacctgacaccactctctgttagggaagcagagcttggaagacctggggggtggaggggaagggtctgcacgcacccaggagtaggatgtgtgcgcg

SEQ ID NO: 160112 - DNA, 109 bp, Homo sapiens
tgcattctttcttactccataggaagagctccaaatcatcaccagcatcaagttatcaccatcatttgttgtggtggtgatgacattaagccgtctactgtttttctct

SEQ ID NO: 160113 - DNA, 564 bp, Homo sapiens
tttaaataaaggtttctgcatgactcgggatttctctgacaatttcttaatgattatcttgccaaggtgaatgaatcctttacaagcatacccgtcatgaacagtgagagcacctcttaggaccaagcatcagggactaggggaacaagcagtagatgctgacagtttctcctctgtccactgaaccccatagaggctatcatttcatgtttttctgactgctgaattaggtttagccacagagatggcacagggaagacagaagggtggtactgtttcctgccaaggcagctctcctcataaggtccaatcaggtctaaaaatgaagccaggatagaatgatggaatgtgaccataacgccacttaacaccgggagctaccacgagtgtccctgatagaggagtcagggcagggccaatcatcctgattaccccgcagggtcttgtgacttgtcagtgatttctagagaaacaacctacaccagccgaagttcactaaactggatactcttcaagctggggaagcccagtctttccttcctgccaaaatgtcgaagttcaaag

SEQ ID NO: 160114 - DNA, 566 bp, Homo sapiens
atagaatcgagctctgtacccgatgagtaaatctggcaagacaatttcttaatgattatcttgccaaggtgaatgaatcctttacaagcatacccgtcatgaacagtgagagcacctcttaggaccaagcatcagggactaggggaacaagcagtagatgctgacagtttctcctctgtccactgaaccccatagaggctatcatttcatgtttttctgactgctgaattaggtttagccacagagatggcacagggaagacagaagggtggtactgtttcctgccaaggcagctctcctcataaggtccaatcaggtctaaaaatgaagccaggatagaatgatggaatgtgaccataacgccacttaacaccgggagctaccacgagtgtccctgatagaggagtcagggcagggccaatcatcctgattaccccgcagggtcttgtgacttgtcagtgatttctagagaaacaacctacaccagccgaagttcactaaactggatactcttcaagctggggaagcccagtctttccttcctgccaaaatgtcgaagttcaaag

SEQ ID NO: 160115 - DNA, 452 bp, Homo sapiens
atgacaacaaatcaccacaggcttggcagtttaaataccactgattatctcacaattctctaagtcagatgcctgagttcagccaggcccagctgggtcctctgctcagtctcatggggccagtgtctgaggtgctgggttcaccctggaggccttcaagcttatgcacagttggctcaattattccttgcagctgtaggactgggtcccccttccttctcatgctttccaagtggccccctccagcaatggtgggttgggcagtctcagcctctagtcttctgccatgtctctcctgcctccggccagagaacattccctgactgtgactatattgagcccactggacaaccccagatactctccctgttctacagtccagtcttagccacacctgcccaggccccgtggagtggaggcaatgcagtcacaggctccaggtcatgggcctc

SEQ ID NO: 160116 - DNA, 393 bp, Homo sapiens
ggttgtcaccactggttatgtagtacttacatatcatacaaggaagctggccatgtcctgaaaccatctgagatgcctgcccctaaggttagtggaactgtctctaggtcttatggacagtacctaaatggcacaaattcaagccatgtacacaggtttatgcaagaatccataaacagtctcagtgtctgtcaccttgctccacatcctgcaatcaagagatggacttcacttctgatctgataatttcacattcaaatgctcattccctccacctcagccagcctcctctgcttctgcaatggtagtcactatcctaagccaacccatctttccacacagcctagacaatttctgtaagcacagaacttccccgtacaataatgcccgtct

SEQ ID NO: 160117 - DNA, 379 bp, Homo sapiens
cataatagcaatgctgatgaatatgaagtggtatttcattgcgcttttgatttgcatttctctaatgattagtggtatttagcatcttttcatgtacttatttggcatttgtatatctttggagaaatgtctattcaaatcctttgttcacttttgaattgggttgtttgttttcttattgttgagtttaagggattatttatatattctggatattaatcccttattagatacatgattgcaaatatgttcttccattttgtgggttgtctttttactctgtcagtagtgtcttttgatgaacaaaagttctaaatttcgtccagtctaatttatctgcttttacttttgttgcctatgtcttttgtgtaaactgatg

SEQ ID NO: 160118 - DNA, 214 bp, Homo sapiens
agaacatctgttactcagagtcccccaggttagcatggaagctcgtggttcagaccaggctgtccttgcctgctgcacttgcaggtctgtctgccttccctgcaaagcagcatctcccagtcctggggggtctctgtaccaggtctaaagggggtcagggtggtgtactgcatgtggtttgtttattctcttaagtttatatgcaataaaattc

SEQ ID NO: 160119 - DNA, 273 bp, Homo sapiens
tgtcacatatgccccagcctgataaaactgaaaaagctcaggctttgtagtcagacagacctaggttcactctatggctttaccactaatagctgtgtgaccctgaagaaattacttagattctttagtgtactcatctataaaatgataagtacatctaccccaaataatttacataagaatttttttttttttttttttggagtgcaggggcttgatcacagctcatgtgcagcctccatctcccaggcctacaagcattcttcccacctc

SEQ ID NO: 160120 - DNA, 575 bp, Homo sapiens
aaaggcaaagtagaaattaaatgttagaaactattgatagaaaaaatgatagacaacctataaactgcaagaaaaaaagacaaaaatctaagaactaaaaataaaaaccaaggcaatcgggaaaactcagcgtatacacattgaaattgaaaataagatacagctatatgtagagagaaaattaaaagaactgtgacaaaatgcaatgtctttcaaactgtaaacttatttaagggcagagcttgtacctatattgcaatcgattttatctccattactcagcctagtgcctagttcaaagtgtatattcaatagaaatctgttgaacgaacaaatgaatataaaaccacatgctcctattatttaaatctaactgaagtagataatattccaggaaattgtaaatgattacagctgaagaactcatgaaaaggtagtaattctaagcagactaataacattgggagaaactgaagaatacagtaattatttatttaaaaagtatagggttcacatggtttcataagcaaactttaaaaaatttttggccaggtgcggtggctcacgcctgtaat

SEQ ID NO: 160121 - DNA, 437 bp, Homo sapiens
aacagagctgagtcaaatttggagtcaataaaggtttgtagttcttcaaacaagaacccttgctgtgaattctaaaaataaataacagacatgctgaaaatacatttcattttatgaaagattctgcaccaaagccttttacaaaaatagtatacaaaacccactaaacatcctgttccatcttccactctgaaatcactgcttggtctaaattcacagtttcattaataaaaatgaacacaataaaacagtactctatgcccccatcccaccccaacaattatcttcaaaggatgtccagattttgtacactatttgccaatcctacataggtcttaaaaaaacaaatctcagctttagaggaaaatcactagttaattaaaatgtcatttagggttgtatttgttttctatgaagggacaataatggaatatttt

SEQ ID NO: 160122 - DNA, 317 bp, Homo sapiens
gcaggagaggtgggacctcaacgtctgtctggaagcagagcctgggcccagtcgctgccatgtcagtgcttagaggtggtgataaagagactctagagagagataggtgtgacttcaaaagccagtctactctgggcatggtggctcacgcctctaatcccagggctttgggagacccaaggcgggaggattgcttaagcccaggagttccagaccagcctcggcaacatagccagactcccatctctacaaaaaataaatgagcaaggcgtgaaggcacatgtctgtagtcctagctactctggaggctgaggtgg

SEQ ID NO: 160123 - DNA, 298 bp, Homo sapiens
ccgcgcccagcctctaattttgtatttttagtagagacggggtttctccatgttggtcaggctggtctcgaactcccgacctcaggtgatctgcccgtctcggcctcccaaagtgctgggattacaggcgtgagccactgcgcagggccacatttaggctttttattggctggttctaggtgcttggtgatgctgacaaaacacatgataacactaagtccttttgtgctaggtcctttgtaataaatcactcagctgtttaacaaattaggtatattgaccacctactatatgacag

SEQ ID NO: 160124 - DNA, 203 bp, Homo sapiens
aagatacacacacaaactcagagacacccaacaaactagggcaggcaaacaaagttttaccctcttcagtgcctaaatgattaacagctaccctttttctgcctacagtaacataaaagggttaactgtttaaagaagtaaagaacacaggagtagctgtgtattcatatatcaaaaagaaaaaagcagtgatatcaagggag

SEQ ID NO: 160125 - DNA, 360 bp, Homo sapiens
tagattgtccactgtctcaccaaatcttgctttgactagtaataatggcagttagagagtactgcctatcacttgaccagactagctaaatgctgaacattcattataatatttaaatctttaaaccaaccttgatttttattttgatttatgagatgactctaccaaaggttagattctgattttggagagctagatcataatagagtcagaattctgttcttaacttctacactgtactccaacaacagtcaaactgttactttctcattcagggtaaaatcctgaccaaacccattactgaaaaccttccttttttatctcagctcccagtctctcaccccatgtatctgatacacc

SEQ ID NO: 160126 - DNA, 216 bp, Homo sapiens
ttttcatgaattaaatttaattgtaactacagctgcataattcctatttttgccaggggtttttatcctctccctggccaaggaacttcagatacaagatagaccttcattttgaatctaacgtaatgaacagtgtattgacttgtaacattacttcaaatgctgaggaactactgttcactgtttcaggtacttctgaatgaaactgttagctgc

SEQ ID NO: 160127 - DNA, 354 bp, Homo sapiens
catttcaggtgcctatttatggataagtgagctactgaaaatctcaatgctttgcaagtagggagatgtagtaaagtcctttttcagaaactggtagagtacaccagtgcacattagacccaacactatctttagtagctccatctttattttatatttaatttttttgtgtgtggcgggggggacagggtctcactctgtggagtacagtggtgcgatcctggctcaccgcaacctccacctccacctcccaggatcaagtgagcctcacctcagcctcccaagtagctgggactacaggcgcatactaccacgctcagctaatttttgtgtttttttgtagagacagggttt

SEQ ID NO: 160128 - DNA, 610 bp, Homo sapiens
aaacgagtaatgtctaataggactttgggggacagacagcagcaggctctgcttacaggtctctgttctgtgcccaggtgagcacatatggactctgcacatggtagtgagtgtgggcggcacaatggattggcactgcctgctccttgccaccaccttggagtgagctgcgttgagtatgggcgatgcttggggttcaaacaggatccttctgagactgatggttcctagaaacagttgcaggataggacttcagagaaaatttaccccagaaagcccagtacaaattactgcccatttttagatggggtgcttgtgtcagtctttgttctggtctatttctgctgacaaatgagacatctggggcatgaatcacaagacaaaaaacaaacaaacaaaaagataaataaatcaaaaataaaaataaaaagcagagagtaccttggtgagagtgaagtctgcttccgggtgcacaggctcttgttcctaaagaggaagaaagatcacacccgagaacgtgtggaagcagcagtgcagtgtgcaaagcagggaccctcagcctgtctcctgggctccatccatgtggcttgttccgctggggatcctctag

SEQ ID NO: 160129 - DNA, 513 bp, Homo sapiens
aaacgagtaatgtctaataggactttgggggacagacagcagcaggctctgcttacaggtctctgttctgtgcccaggtgagcacatatggactctgcacatggtagtgagtgtgggcggcacaatggattggcactgcctgctccttgccaccaccttggagtgagctgcgttgagtatgggcgatgcttggggttcaaacaggatccttctgagactgatggttcctagaaacagttgcaggataggacttcagagaaaatttaccccagaaagcccagtacaaattactgcccatttttagatggggtgcttgtgtcagtctttgttctggtctatttctgctgacaaatgagacatctggggcatgaatcacaagacaaattagataagacaaataagacataaagataagacgatgactgggatgcaaggggacttgagtgcatagtggccctgccagggaaagtcatgaggtgccttgatgtatattcagcccacagccctttatta

SEQ ID NO: 160130 - DNA, 151 bp, Homo sapiens
agccaagatcatgccactgcactccagcctgggtgacagagctagactatgtctcaaaaaaaaccccaaaaaacaaagttctatttgtggggatgccagagagaggctgatggtagggaaaactcaggtaggggtggccatggggatgtgt

SEQ ID NO: 160131 - DNA, 345 bp, Homo sapiens
ggggcagcaggctgtgatagtgtgagttcgcatttgtcagttttttttttttacccatgtgggtgtctaggttagagttgcaatgtttactctcccttttcatcaataaggacatattttcttctgtctgtaagcaatttccttgaagcttcaagaagaatcctcttgtgaaaatgttcatatgattttatgattctgcttccttccctgtccttgggaaagagtatattcaccctcagagaaggcgtgaggaatcaccaaaccagatcttttctcccaaatcagtcaagaaatgttcactggaatgttgctatggtaaaaataaaagtggttttatgatgtcca

SEQ ID NO: 160132 - DNA, 3290 bp, Homo sapiens
  misc_feature (1428)..(1428): n is a, c, g, or t
  misc_feature (1448)..(1448): n is a, c, g, or t
  misc_feature (1452)..(1452): n is a, c, g, or t
  misc_feature (1485)..(1485): n is a, c, g, or t
  misc_feature (1490)..(1490): n is a, c, g, or t
  misc_feature (2713)..(2713): n is a, c, g, or t
ttttaatagagacggggtttcatcatgttggccaggatggtcttgatctcttgaccttgtgatccgcccgcctcggcctcccaaagtgctgggattacaggcgtgagccaccgcgcctggccgatgtggttcatatttcaggggtcccggaagagttgtttgaggtttctatttggccaagtcaggccctggtggagtttggacagtccctagtggtcaactgcagcactacttgcccagacccaggacccagtggaattgagaccttcttaaagaaaactcaggtgggcaaagggcctcagtggaaagagtttcttctggaggatgtcacagagaattccatcctgcagtgcttcttctcttgtgcagggattcaaaaggacacaagccttggcatcactgtgtatcagccaccagagcaagtgatcctggagctgcagcctgcctgggtggccgtggacgaagccttcacagtgaagtgtcatgtacccagtgtagcacccttggagagtctcacccttgcccttctccagggtaaccaagaactgcatagaaagaactttacgagcttggctgtggcctcccaaagagctgaagtcatcatcagtgtcagagcccaaaaggagaatgacagatgcaattcttcctgccatgcagaactggacttgagtttgcaaggtgggaggctctttcaaggcagctcacccatcagaatagtccggatctttgaattctctcagagtccccacatctgggtctcttcccttttggaggctgggatggcggagactgtgagctgcgaggtggctagggtgtttccagccaaagaagttatgttccacatgttcctggaagaccaagagctgagctccttcctttcctgggagggggacacagcatgggccaatgctaccattcggaccatggaggctggtgatcaggaactgtcttgctttgcatctctgggtgcaatggaacagaagacaagaaagctagtgcatagctacaataagtggcctggctcttcctttttcatacgggttctctgctgctgaaaacacagagtaacgggttggtgattcggctgtagacatccctgctgccctttgctgggtatgctctcaagtgaacatgagtcttcatctttctctggcttccctccaccaatcctggagctaaaagaatcatacccattggcagggactgacattaatgtgacctgctcagggcatgtattaacatcacccagccctactcttcggcttcagggagccccagacctccctgctggggagcctgcctggcttctacttactgccagggaggaagatgatggctgaaatttctcctgcgaggcctctttggtggtgcagggtcagcggttgatgaaaaccactgtgatccagctccatatcctatgcaaccacngttagaggaatccagttgcnctgncaaacagacctggctggaagggatggaacacangctcncctgcgtcccaaagggaaacccagctccagccttggtgtgtacctggaatggggtggtctttgaccttgaagtgccacagaaggcaacctagaaccacactggaacctaccgctacacagccactaaccagctgggctctgtcagcaaagacattgctgtcattgttcaaggactggatgaaggaatcagctctaccctctttgtcattattaccgttgcccttggagtgggtgtcatcaccatagcactgtatttgagctatcggccctgcaaagtggacaggaggaaattgctctataggcagaaagaggaggacaaagaggaggaaagccagtttgctgttcaggaagagaaaagtacaactcatataattgacagctatttgattgaatgagacttctgctactgtggtttcccagggagggaagaagggatagaggagaaaggaagaaacacaatggcaggctgcattcccctttgtgtacgtctgtcctgtaaaacggtgtttcaggcccccatgccccatgtcctgtgtgtccaatatgtccacaagctcacctttctctctctgtctctttttttttttttgagatggagtctcgctgttgtcgcctaggctggagtgcaatgatgcgatctcggctcactgcaacttcagcttcccgggttcaggtgattctcctgcctcagcctccctggcagctgggattacaggtgcacaccacaactcctgtctaatttttgtatttttcgtagagatggggtttcaccatgttgaccaggctggtctcaaactcctgacctcaagtgatccgcccaccttggcctcccaaaatgctgggattacaggtgtgagccactgcacccagccacctttctctttagagctcactctagtcattaagaatctcagtctcaatgtttgatttgtaagaaggcctcttgctccttgccaggtgcttcatcagtccactcttagatacaaaaaaaagatcctgctgtttctttatggtttccactgcccttttctcttaaacatcatactaaagtcaggcacatcttagaaatgcaactcatatttcatggttttctgattactaactgggaactaaatttgtagtccagggacaggactttgaagggagtaagtatcaaatatggggctaggaatcagagctctgttcccatctccactttcccttgctcccctgacctgggcttntggagtgccagctcccagagctgagcttgttgacatcattaaggatcagtggcaagcttcaactcagtaaccatctgttgtgggtcttgggggagtatacagatggtaagaaattccactttgggccagacaagcatcctatctagcccagtgttctgtctctgaagtagaaggtagagttcttccatgaaattggcctcataggttaagagctccaaacatctctgaattccttttcatagagtgatcaactgtgagttcgcatttgtcagttttttttttttacccatgtgggtgtctaggttagagttgcaatgtttactctcccttttcatcaataaggacatattttcttctgtctgtaagcaatttccttgaagcttcaagaagaatcctcttgtgaaaatgttcatatgattttatgattctgcttccttccctgtccttgggaaagagtatattcaccctcagagaaggcgtgaggaatcaccaaaccagatcttttctcccaaatcagtcaagaaatgttcactggaatgttgctatggtaaaaataaaagtggttttatgatgtcca

SEQ ID NO: 160133 - DNA, 369 bp, Homo sapiens
gctgggggcggtgagcagtgggtgagtgggtggcattagattttcattgcagcgtgaaccctgttgtgaactgcacatgggagggatctaggttgagactctaactaatgcctgatgatctggggtggaacagtttcatcccaaaaccatctcccaccccctccccacctgtggaaaaatagtcttccaggaaactcgttccctggtgccaaaaaggttggggaccactggcttaaagcacacacattcaaaaaatataaatatatcttgatagaatcagggaagtcatgaacactggatttgaaaggaactgaaaagggagaatgctatcaaacaagaaagttaaagccttgaaaggggtctgaccag

SEQ ID NO: 160134 - DNA, 281 bp, Homo sapiens
ccggggaagcagagtgcaacttgtcctgctgtgaaccccttgcaaagtcaccattgatgcctaacaaataaggctttccgtttttctggatggcaaaaaacaggagattgatggtgatcaggagatgtaacatttgctttacaagatttcatgtcagcgaggtgggaagccaactctatctgaagcagttagatgaaggcaaagtgttcttaaacctttaaatttcaggcccttttgcattcttaaatattattaaagagcccaaagagcttttcttgatg

SEQ ID NO: 160135 - DNA, 801 bp, Homo sapiens
agatgggatctcactatgttgcccaggctggtctcaaaactcctggctcaagcaatctccagcttcagcctcacaaaatgctagggttacaggtgtaagccaccatgcccagcctaagtttgttttctgtgctgtttaggctgtttctactgttttatcttccagtttactgattcttctgtacccccattcccactccacttggttgttgggtacaactacatagccttttatttcagttattacatttttcactctaaaactttcatttggttgttctttacattttctatttctttgctgagactatttttcatttgtttcaattgtgttaccaattacttactgaagcatttctatcaaggttgttttaaatatttgtaatcttggtgtgggcatctgctgtctttttttaaaattcattttgagattttcctggttctggatatgatgtgtaattttttattgaaatgtacacattttcataagactctggatcttatttaaaattcctgttttagctggttgtttgaagactctgctgtatgcgggaaaagagcagagaatcaggtgaaagtgctgacttgtttctgtcaggtggaggtaaaattatatgttccctactcaatctctgttgacacctgggaaacagggaagatcctcattactgatatgtggaagcaggagttctggcttcctatgtgatgttcactgacacagtcgtaagggtgacctcactactgctgggtgatggtaaaagtcccaattctccatgaggcctcctctgaaatgactccagtg

SEQ ID NO: 160136 - DNA, 220 bp, Homo sapiens
acacccgagcaccacaacaccgtagcccgcagccgtggctcactggactcatcggggaggaacgcggtggtggtgcagcctctctccaggcatactgcgtgaaaaagcccctccttgagaatgattgctttacagtctccaccatgaccaaccaggatttgctgtaggaatgcaggaaagtcctattaataaaatgcaatcacattagtgggtcaaataa

SEQ ID NO: 160137 - DNA, 568 bp, Homo sapiens
agttacaacagctagccatttatgagaaatcacagaaattcttccagtagtatgaaaatagtttaaagtcagacagcctcacggtgaaagaagagaaattaacttttacattttcttgggaacattgatctcacaggcagcatttttagatgcattgctgctaagctattttttaaatactcagatggcgtggcagacatgatggcggcgcccatcagccgtccaactctctttcctttgttacgttcttgattttcatttggtgagccacatcacccccacacagcttgtgttttggggaacgctagctccatctctgcataggactagagcacttggtgccagccttaaacaagaaagcaatggctctggacgtcaccggcagccatcttgtgaccccaagaaggaagtgattatgtcacggaagctgtggagagcaggcaaacggcagggctgagacccagctcttcatctcgttgttttactgaatcaattctaacataagcccaccctatctctgggagaccagatacgtcaaccagtgaatcccacatgtcacttaagccga

SEQ ID NO: 160138 - DNA, 164 bp, Homo sapiens
atttctcccaccggcaggtagaattatttttattcccagatgaggaaatgcaggcagaagaaatggagtaagtttaatctcgatttcaccatgactactggctttcttccttccccctccttctttccctccattctttccttcctcctcttgcttcattccca

SEQ ID NO: 160139 - DNA, 398 bp, Homo sapiens
gcttacgtacttttctttatgaattttatgtctgtaacattggctgatatctacgaaaaggaatatatcaatcactgccttttcataacactttgccacataaagaaaacagtaaaatctatcatcattggcttactgaacttcagggaagtggcaaatattaatagtatggtacatatgtttttgaactatatttttcccaggggtagaaaaaatatgtaagacacaggattctgaattacaattttagcttttaaggaagaatatgaaatttccatccccaagtcaaagacaatagtagtaaaattaacaacttatacatagtagtcaataaatatttaaatgaatgaatatgttaatacactccataaaaataccccagtttttccaacataact

SEQ ID NO: 160140 - DNA, 541 bp, Homo sapiens
aattcctggttcatcgtgtaattcacaaggaaaaaaaaggacctgagtggtgatatcttttaaattacatattcagataactcatgagtatttggagctgtgaagtattcaggtctttattttacaatattgtaggataaaaacaaacagtctttagcttttactaggagaaaatgtatgtggatttaaactgtatgcctattaccacttaaaaggaaaacccatccaataacaaaaattactccgtatgtgtaatcaatttctttcacactattttcccacacaatcatatgcttttatttcttaaagtccatactctaggggttaaactcatcaagcatatattgtgtgaacatatcccctcccttctatgcctttaattgtcttaatcttctaacgcaacatttatccaaatacaagacccttttctaaaaagcacagaggagtttttgttcagctcggctctcatgttgtagtaatatgatcactttccaaagccaatacatagtaacatgctattcctgaagctctgcaatgaaaa

SEQ ID NO: 160141 - DNA, 295 bp, Homo sapiens
agtaaatttgaacccaaaagcatgaataaaaatctcaaaatacaacctagtgtgaaaatttgacatgttggcagatgctgacccaaattgactcggcaacacattatctccaatgggatcactcatatgtttcttgtgttaagtctaaggctgtgtgcactgtgaggccattaaagcagaccacgggcatgtgtggtatcttgcaggaaagtaggcagaataaagaggcagcctatgacatcagtgatcctactaagaaggaacccccaggctcacagataataacattaaatgg

SEQ ID NO: 160142 - DNA, 424 bp, Homo sapiens
cctcactacaagcgtcccccagcaaagctgcaccgccatttcctgtgcttgggaactgaaggcaaggtgagcccctcccggctgccccggcccgacctcccctgactcccaagcttgggctactcacggcctgcgggctgggcagggtcccccaagggagctcccctccccgagggcgcgctcaccctagccgctgggatcggcgacctggtcctcggcccggcgggagtgaacgcctcccagggaagaggccgggcctccaagcaggtctgcacccccggagttatgtttctgggatccgaggactagcgagcttggggcccgggagagcggccaccctcccggaagctccgcctggcgcagggcgtgaaccgcagtctccaggccggccgggccgcggccattctcggagggcagcggccgc

SEQ ID NO: 160143 - DNA, 321 bp, Homo sapiens
attgtctttttccagtctctttctctaatggcttggctaagtccaaccctcctattccttgtttggctagcagctcaagttttttagagaaaagcacacagccaagtgattggtctttaatccagagccatactaaatgactctttcactagttataggatcatttctaatttctactgtgctaaaggcttatatgaaagcacctctggatggtaaacttttgactagagactttcaaatcctaattacccatccctagactgtgtattcttgatgagggtactcaaatattaactgatcattcctagcatgtatattaaa

SEQ ID NO: 160144 - DNA, 423 bp, Homo sapiens
gactgttcaaatgtactgaaggacggttgcttccatttcacccgaagttggagacatagaaacaaactcatatttatgtggttgcccacgatggggcagaaagcacactggactatgctatccccttgggcttttaagcagcagtgcagtcttggataagtcacttctagttccttcttgaccatgaggtcgccctgtgatacctgaaggtacagccatgcttaaagcagtgactcagtttgaaagccacacttcctattttttaggagtgtaacttttttttttgatagaaatgaaacttgtacttaaaaattaaagtagataaaatgaccttcagcatttgaaacagtataaacaagtcaaaggaataaaaatgacgagaaggccgggcgcggtggccacacctgtaatcccagcactttg

SEQ ID NO: 160145 - DNA, 324 bp, Homo sapiens
ctctttctcacgtctcatttactctgcactacacttatgcccttacccccacttggcgctgctccactgaaattgctcttacttggtttcctaaggacgtcgtaaagccaagtccaagggggcagttgtcactcactcctcttcttacagtcttaactgtatctgacacacctgattattttcttacatatttttgaaacctttcatttcctgtggctctggtggcaatacaccctccagatttcttcttgtcttttcattgttttccttaagggctcctttccctcccccatcatgaggatggtccgcacagttgctttccct

SEQ ID NO: 160146 - DNA, 285 bp, Homo sapiens
ggggaagctaattctgagggctaaactgggatgctcttcttcagatattggctttcttttgttgctttcaccaacctggagctgctaccaggctggcactgctctaaccccagtgcaggaatctcaggcttggttctcttaccttctagtgatttcagtgggttttgccattatccccaaggggcaacccctgatttcctattcttttactgctcactgcctctagttctgacttcagggttttttcccttttgttttgatttcttgtccttggagaagaattca

SEQ ID NO: 160147 - DNA, 591 bp, Homo sapiens
atgtcggagcctggatatagtgaggagtaggaagtgtttctacttttagaatggtatatttaatgactgtgttccctggttttaaaagtgcactgtcttcagaatctactgaggcattcctgtgttagagacttacgctttctaaatttttttctgcatttttagtttttcagcctcctgctttattgtcagtatacctcctgctgctgtgtatctcatttttgcttttctagtttgcaacttctaatctgctgtgagtcaggaaaacatatggcagagttaaattgtgcttttggttaggttagatagaatctgtggaaaaacccaaggtgtttctcttataagtaaataatatattttagtggaaaggctttgtgacatattattggctacttgtagtcctttctgttcccatttttttttcagttatgctagagtaggtgatcaggtgaccaaattccagatagctgaggtattactgtatttgccagaatttttatttgcatgtggttgcagtaaatctggaacgccccactatgacaaatgaattataaagaaatagagactatctttaaagcgtagcagttatat

SEQ ID NO: 160148 - DNA, 244 bp, Homo sapiens
tagcaagaaccaaggatagagcaatttcacagtacctttatgtatgcattacttgggatttgatgacataaggaattgcaaaccaacatagactgttgagtgagaggcaggatggtataatgaaaagaaaaggattttggagtcagtgtcctaggcttagagtgtcatagattcaaattccaactccatatttagtgtgaccctgagcaggttgctgaatctctgaggcttggatttctcattt

SEQ ID NO: 160149 - DNA, 567 bp, Homo sapiens
aagggcacttcacaacacgctgcgtatcgggggtgcctggtggcgccgtgcctcactctcgggacggggcccaagagatcatcgggtagaaaccggcctttggggtctggcagggctctagtcccaaggacactcttcccaccccgctgaggtctgaaggatccgcccagcgagatcttctgtgaatgatcaagggccgctgtctacagccatggtctggagatggttctgatctctccacactccaggaagagacccccaaaacaaccagttccaccaccctctcaccccaatttcctcaccacacttcatagggagaagagcgctgcttgtggcagggtggcgtgtggctgtcattaaagtgcgttcctttaatgagcgctcagggctcccaggggcctgctgctatgccatggggtggggctgccagcagggcagggggttgatcccatcacatctccccagacacatcctcaggaaaccacctcaaaaccacctaagaacaaaggaagttatcacactggggacagggacaggggtcagagttcagcttctcaagtaggatag

SEQ ID NO: 160150 - DNA, 306 bp, Homo sapiens
acgcaggaccttgcagaaaggtggatcctttccatgtgcagtgaaaaatcctgggaggggatgagcaggacttacgaggtcacactttccctgttggaatagagcaacgggggcggcagtagaggcaggaagaccaactgggagtccctgtggccgtccaggtagacaccgtggccttgtcacagtgcagccctggagagacacgagggagacagaggctggggcagcactgacagcacctgctgttgaattgaatatggggagaggatgtggagagaaggggaatcaaaatgatctcatcacatt

SEQ ID NO: 160151 - DNA, 325 bp, Homo sapiens
tgtttcagtcacttcaagctgaattcatgccctcaatgtaagtgctgtgtccagacacatccaaatgagcaccaagctggaagtttgtgaacactctggaggatgccccagctgttgtaatgcaacagcataccttgaaaaaaaacagtagctcccaagggactcagcatggcttggtcttcgaagtggagttttgtttgtgtattcctagtccagcagtaaattctgctttaacataactgtcaggtttgctactcgaaatttgcacataactggaagtgaaacgatatctttctcatattttttggcctaacaaacacctata

SEQ ID NO: 160152 - DNA, 174 bp, Homo sapiens
tgcccttgtggaactggggagactggccgttagctaatggcacagagaagtacaccatcacgggtgcctgtaatcccagctactcaggaggctaaggcaaggagaatctcttgaatccaggaggcagaggttgcagtgagctgagatcacaccactgcactccaacctgggtgg

SEQ ID NO: 160153 - DNA, 490 bp, Homo sapiens
tcccttttataagagaacccttaatccttaggggtaaacagggatgaagatccatctttagtaatttcttcaggttgaatagcggtgatgatattcctgcctattagggtctcttgtatccaaggtagagaagagatcagtcagaaagtgtcagtatggtaagggccattcatagttctgacaaaaggtgatatcacgggtcaggaaccctatacagggactttgtggaaaaggtatgaggccagttttcccaaggggcttttattggctctctaagccaagtttggttccttaatagaaagcactccattccaatcaaagccttggtaaaataaccagtttctccaattgtatcatctggtttccagattttggagaaatgaggtagagggaaacaaacatcctttaaattttgttcacaggagttttactcaattgttaagaactgtcaatatgccaggcatggtggctcatgcctgtaatcccagca

SEQ ID NO: 160154 - DNA, 242 bp, Homo sapiens
agaagaagaagggacaaaaaaggatgatgcacacacaaaggcaggagcagcaacatgagaaaactacgcagatacaacgacctgattaaaggtgcaatctggaaaacactcagttggccatgactgtggctcaaaatgctgactctaactaaaggtatcaatcaattagcaggtactgttaaggctgaccatacacccaggagactgagctagggttttttttttttttttttgagacagag

SEQ ID NO: 160155 - DNA, 443 bp, Homo sapiens
attcgtattgttacttgtctgatttgatgtatcttatgctcaagcaacctcttactttcttgatgagagaagtgcctttgataaattctatttgtaacatctctaacaaggcccttaaagttttattgatcaattaaagaatgccttatttctagtagtaagaaaatattttgttaaaattatgccataaaataaaagtgctcttacatgtaaaagcattataagagtgaatcaaaatgaatttcctatctttcattgcaaataacagtttaccacttcaattagaactaccaatttaacttatggtgcacaaaattatgtaataaatttaatgactgaaacagttcacatgcacagaaaagaaaaagttgtcttgaaccttggcttaaatgaaaaaggccatataacaagataataattttaggattggataagtcacaata

SEQ ID NO: 160156 - DNA, 327 bp, Homo sapiens
ggaatcttccctccactcccaggaggtggggcaggcagagccagcccagcagaggcccccggaagcgtcaggaacaacaggaaaggcagccggggcacagggacttcccacactcgtaagcagggtgaccctgcacccaccccagctggctctccttagccctccagctccgggagctcagggtaggagcaggtaggaggggctgcaggcatcagcctcaggcctaggggaagtgagatgacagtcgacagtcggatgcttctccagctaagtggtccctagaacagacgggtacactgaggcaaagtgtcctgggaggggcgagag

SEQ ID NO: 160157 - DNA, 328 bp, Homo sapiens
aagtgcccatttcttcagctcatggatggaaacgacagctgaatggtttgagtttttaaaagtatactttttcaggaatggcagcaccctgtattcaaatagagagaaggagaaagatttctctgaactcctatagcaaaagatctaagaccgtggggtcctattcagtgtaaaaccacacagcacataaagaatgagattgggcagagcatggtggctcacaactgtaatcccagcactttgggaggccgaggtggaaggatcgtttgagcctaggagtttgagaccatcctgggcaacacaacaagatcccatctctacaaaaatt

SEQ ID NO: 160158 - DNA, 447 bp, Homo sapiens
gacggaacactgagggttatttgtatttttaacctttggaaagcaaattgtttaaattatttaaagaaatagtgcaagattatggctggcatactaaaaacttgcaggatgttatttaaggacgatcactgtttgaaagagtctgtggcagtaattcttagctgtgcttgcaaattagaattgtcacctggggagcttccagaaaaattaaatattaaataaaagaaccaggcatcagtattgtgtttaaatccactgtgtgaccaggattaagagtcaaagatctatggctaactcataaatataagtttgccagcaaatggaaaggatatagaggtaggctttatttcagatccttttgccagcttttatagtaacagtcttgtattgaggtctctgtttttcttcagttcttatctagtcaggtctggaggcaaccaaggaaca

SEQ ID NO: 160159 - DNA, 408 bp, Homo sapiens
tgaacgtcttcactctctctcctacccttctcaaagacaaacagaaactgctgataactccaataccatcatgactagccaatgtcagacaggtcccatgagcaattccagcatcagccttccttacattctcccacgatcaccaccaccaccaccaccacgctataataaccaaccaccatctagtcatcggccaggcacagtggctcacacctgtaatctcacactttgggaggccaaagcgggtggatcacttgaggttaggagttggagaccagcctggccaacatggcgaaaccccgtctccactaaaagcacaaaaattagctgggtgtggtggcaggtgcttgtaatctcagctacttgggaggctgaggcacgagaattgcttgaagccaggaggtggag

SEQ ID NO: 160160 - DNA, 327 bp, Homo sapiens
cttagatttgtgctgctgatcccctaatattaaaatactttgttagatttgggaataataaaaagaaaacaaaaaagtaaaataaaaatgtttaaattttaaatgaatgaaaggttgagtagcatttggaatcgctttcaaatgtacattcagaaggaaaagtggtcagtggtggctgtggctggtgggggaaagggctcagatgtggcttctgggattcccttacgacatttgcagaagtgtgggaaggatgacaagttctgctgcactctggagctgctgaacctgagtagccacatctaacatcacatcactcgtggggagcag

SEQ ID NO: 160161 - DNA, 248 bp, Homo sapiens
ccattttgggtcaaataatagttggaactggggtaaatgaaattttaaaaatagacctatattgtagaaattatcccataattctaacacaaacatttttccattctctcgaaaacatttcaaagtaagaaggaaatgaattaaatgactgattagatataaggaaaagagaagatgtgaagaaactgtggttttccggcttgaagacattggttcaatttaagaaacacataatgactcaagtacag

SEQ ID NO: 160162 - DNA, 988 bp, Homo sapiens
cagttttaagtgtatacttttgtcctactggtcaaaattttatgacttattttcaatcagtaaccaagtcttactcctttaatgtgcccagcatcctagaacagctaaaataaaatgaaaaaagatactcgaggaaagtaaagataagccaaaataattttcaagtataaaagcagcaaagtgttaccaaaatgcaaagactcaggaaatacagttaccataagctattcctaaggaatctactagtgaacaagtttcaaacagtcacaatgactgcagagacattgacgtaaagacagatggcaaatattaagtgggtgggtaggtagatacagctgtagatatggccagctgtttgctggaggcaatttggacaagcttatgagagccaatgaacttttcaagaattttatgagttggttattaaacatagacattatgaacagttaaagtatatacatgtacgtacatttaaataaattaaaaacagtaaacactaaaaacacatcgcttcataattatgttactacattttacaattatctatgcttttgaggttatttacattgattgtatcaaatggtggagatagggtcagcttctgcacatcttttcccgaactccacatttaatgatgtcaccttgatagctcaccaatggtgaaagtatttactccatggaaagctgcaaaatgctatgaatcagggctttttccccctttttctggagagtctcttgttaaacatttcctagcacatcaatggattcaaaaaagagaagctagtatgcaacagatccatgacttgacaatgtagatacaccaccactctgaagacatatgaggagggcactgggagagcgtatgaaaaatgtctttttagcctttcagtaatcattttgggtgatagtgatgtcatcgttattctgagaatggagtgtgtgcaatgtcaattaaagcaaataaataatcatatgatatatttaattg

SEQ ID NO: 160163 - DNA, 375 bp, Homo sapiens
gacccctgaggaggcttaccacctacctgctcatggtaattctgaggggtaaagtaacgacagttctagaagtttcgaagtagttgaaggctggaatttgctgccgttattacaaagctgataggactagccatcagagatgaactagatcttttttcatcttcctgccaacttccctgtagtacttcctactggcagaacctaataagcagcagtcagaggggtcagagaagtgtagtttgcagagtcccggcctcagcacacagagcagaggacagaagggtggaattggagctgagaaacaatagatgaagaaccagcacactggtttccttcaaagactcatttttatctaaaggtattagtccctaaaac

SEQ ID NO: 160164 - DNA, 332 bp, Homo sapiens
ggggaactgatcagaagacacaaaggaagcaaagaacagcagaatggaaagagacagggcatgagcgatctgtccagaaaggggcagtcggggagccctctgaggaggcagcctcaaatggtggtgcttcaaggagagcgagggtgtgtttccaatttttaaaatagctgtgctatgttttctcgtaataacagtatcatccccaatatttaaagaaagtcagaaaatggaaggaaaaaaattgttttcctctggttctacccccaatcacaatttactctaaatgtgaaggattattgctttccattccctgtgtatttggatgatttttc

SEQ ID NO: 160165 - DNA, 441 bp, Homo sapiens
tgctgatgacatgcctgggcctgagacctgaagggacgaggaaggaagcctggagctctcaggaaggatgaagagagcaggcattgccaaggcccctgggttcagggaatgcctggggagtctgagaaatagaagggcagtgtgagctggcaaagcgagccagggggaggtggcaggagacaggtaggatgtgatgccggggtggctactggggtggccttcgattcctcattgtcagaagagctagggtagatggggtgatttgggaggtgcattatggatctaaaattctatgatccttggatgtgtgtgggacacccacagcgcccataaggagaagataatcacaggacccagtgacagggccaggctttccagaggaggggccatctgggcagaagggtgtgccgtgggcagcaggacagggatggtgcttgttca

SEQ ID NO: 160166 - DNA, 781 bp, Homo sapiens
aaaacttgcgtggactgaatccaacatgtcatcgaaatctccagcagcatctatgccaacagtcatcacggaaatagaaaggttctaaatatcacatttttgaaatgcccagtgcctgaaactatggtagcatgtatggatacacaaaattttgagttccatgaaaaggcaaattgagtgtctatgagacactggtcagccaaagttgttttgaagagagagaaaaagcaagtttgagtgaattcaagcaaatcctctgctttatcacaagtaaaaatcaaaactacacactcctgcccagaacaattcttatcatcacttcttctcagtcttctgaatgctttgggaattatttctatgggaacatggtctttaacatcatcatcaataacatatgagctcatcagaccacctgtccactcgccagctgagggaactgttccagctgttgggtgtgggcaggattccaggatccctgaaaccttgtcccactagattcctggtaggtgtctcctgctggggcctgggcacataaggcccttcccccactgtccagggttggcagtgctttctgcacaggtcaaggacagccagggtgacattagccccagtcactgagttctcagggcaagggtgactggggcaagtcccgactacattctcaaagagccagtagctggagcttgatgctgcctatgttcctccatcccttttctcaggaaaatggagccttccctcatttcctgcacgttttcttggcaagtcggcagtggggtctctg

SEQ ID NO: 160167 - DNA, 276 bp, Homo sapiens
taaaacttagaaatgcaatgtaaaggattttttaagcacacaaaaccttgtttctaactttaaaatgaagataaataagcaggccctaactctcaaagcaaaggtgtctcttacaatcagggtctgcaaaacctttctagaggaggagctaaggcaagcttgtccaacccgcagcccaggacggctctgaatacggcctgtttacgaacacaaatttgtaaactttcttagtgtgacggtagtaaagtccagcccacagaagttggttttggggtt

SEQ ID NO: 160168 - DNA, 543 bp, Homo sapiens
accatttccaaccgctgtgaagaactcatttattttaaatgaatgtggtagatattgaattgcttttatatttatgtttcattgtgaatttttaaaaatgatataacagttatagtttagaatgtcaacatttaaaatgtgccaaaagttacatgctttacaactgatctgtcagttgaaatggctgaagttctttcaaaattattttacacaaggtgtcaacagaaaaacttgaagcacactgctctttactagagtgtttcattcatctttgcacttcccgcactataaggaatacacttaaaatacgtttatcaataaatatgcatacttttttcttatcatgaaaatatagtgagttataatgccatgcttttcattgtacaatgcatttgtgactagaacaactaaccttatttcataaacttcacttacagaaggaaaaattggatctagaataatgcaacctaatattacatgtatcagatggaaatgtactactaataagcaaataaatataagactttcaagctatgggtggaa

SEQ ID NO: 160169 - DNA, 601 bp, Homo sapiens
tccctagcagcatgtttgctttacctgccttcatctaggtttctacatcatcaggggtggaaatattagttggcttaattaagcttgggagttgtaccttacttgctctgttgagtgtcagttctaccttcttttgaagcaggcaaaagcagttcatggcacaaatgccagaaatagcatgcaaaccactttgtagtggtatgcaaactaatttctgctgtgtccttttcttaatgcttgtgagggttactgtttacttaagagttaatatttggcttatgaaactagtatcagatgagaaattccagcatccctccccaccccagagaaagatgtggtcattggggactgctctgaagtctgccagccctctatcctaaaagttggtagatcagttattatatcttgatatgtacccctaattcatatgaggggccaagagagattagttactcctgatttcatctgttagaagataaagggagtgtggtttgtatctatattagagtaatgggaatgaagggtagggatggatgacagagatattttactcctaggaaaaatcagcaggacttggacagtgactagatacagagaatta

SEQ ID NO: 160170 - DNA, 220 bp, Homo sapiens
agcccaaagtgaaaacacttttaaaactataatgtggtatacatatatttaattaaataatcactttcctaaaaacaaaactctaatcttgattgctgcaccagccaaacagaaggaaacactatcgcagaagttctcacatggactaagaaaataagtatacatactcccaattcttactgcaggttctccaactttggtaagaggatagactacaaca

SEQ ID NO: 160171 - DNA, 429 bp, Homo sapiens
gggattacaggcacccgccatcatgcctggctaagaaatcagattttaaaagaagataggaatttgtttttatgagtcagggtgctacctgttttgttctggtttaagatcacattaccttatttctacttagtattgccttttttttggatttgtattacttgttggttagaattcagtagtactgaaggaagggcccttttgtgatccttgctgaatgcccagtgcgtagtgggcactccatagatgttagttgaaagacagaaaataatgagctggaggatggtagtgtaggcatgccctagtcattaacttttctggtcatctttgatctgagtgtgctgttgtgtatgtgaaagaaaataacacaaacgtctttaaaacttttgagagtctgttctaaatagctgtctcgaatgccttatcttt

SEQ ID NO: 160172 - DNA, 611 bp, Homo sapiens
  misc_feature (555)..(555): n is a, c, g, or t
ctggcatgctaaaccatattgttcttactcatcttggtatacctcacaatgctccccttagagtgagtgttgcagcctattcttaaatttcttgtagagacagagtatctctatattgctcaggctgctttcaaactcctgggctcaagcaatcctcctgtcttagcctccctaagtgctgggattataggcattagccactgtgtctggccacaaaatgatttttaaaaggagttcagatgatcagaaatggggttgaaagacaaacgtaggacccttgttatgtgtggtctaggcttattcagttgtttattctatttctcctgccccttttagagagatacgttgtaagggttttgggcactgttattaatatgaaatatttctgcaaatagaagataaatgtacatcctacagcagttgcttgagtggtttacacacatgaattagataagttatttatagattttcttttcttctgtattctccattctgttttctcctcttcagtccccttaaacctgccctagagcagaccctcctcatctgttctgngacttttccaatagcctgtactttatgaaggactatcattagtcatattgttcttg

SEQ ID NO: 160173 - DNA, 534 bp, Homo sapiens
aagaggatcccctccataatgtgtgcccaggcgtgggaatgcacgtacgctcccagctactcagtaggctgaggtgagaagattgcttgagcctgggaggtggaagatgcagtgaaccacggtcactccagcctgggggcaagaccctgtctcaaccaaataaaccaaaacaaaaaaggcaatttatatacccgtgttcatagcatcgttcacaatagcccagaggtaggagcaacctagtgcccatcatcgaatgaatggaaaatcaacatgtggcccatccatgcggtgggacatgattcagtcttcatcccagcacttagggaggccgaggcgggcggatcacctgaggtcgggagtttgaggccaacctgaccaacatggagaaactctgtctctactaaaaatacaaaattagccaggggtggtggcacatccctgtaacctcagctgctcaggaggctgaggcgggagaatcactcgaacctgggaggtggaggttgtggtgagccaagatcgtgccactgcactcta

SEQ ID NO: 160174 - DNA, 610 bp, Homo sapiens
tcccatgccttccagcttcgtttatacagaggtaattcccaagtctctcactctggcctgatcccctatcacttccagactcatgtatctttctgttgggcatctccacatggacatgccataggcacttaaactcattctctttctcccaaatcctactctcccaaatctgagagaatggaacccccagctatctagtgatcaatcaagaaatcttagtgtcttcattgattcctccatctccctccaaaattctatcaatctcaataactgaattttgaaaatttctctcaaagtcaaccattccttcaagttccttccactgatccagcttacaaaaactatcttttgtctggattattccaatgcccttctgatacgtctatctgcttcagtcttgccccagtctaatctaatctccacactacagccagagtgttatttctgttatgccaatctgctcacatcatttcccagcctaaaacacctgaagggggtccccattgtcctcaatttacatggccttggtgttctggctcgcatatttaaccacacccttttctgcagcctacatggcagctacagaatttcttttagttcctttaagcta

SEQ ID NO: 160175 - DNA, 159 bp, Homo sapiens
cccctcatatcctctccacaagcacggccacctctcggaccctcaacatctcttgccaagtttccaatgcaccccctccaatatgctcccattcagtggtcagggatatctgtgtaacgcatatgccaatgtcactcccccactcaaaaccgatgtgca

SEQ ID NO: 160176 - DNA, 336 bp, Homo sapiens
actagaaaataaacccccggtttatttctaaatgtctgttcatctctttttctctagttcacaccaaggatttgaactgtcttaaaaatttgtcttaaaaacagatatgtagaaaatatattgaaagcattggccctctcttttgtgggactgcattcagtcagcctcaataagtgctggatgtgccagcggctggtgaggctcttcggcccattaggatcagggttggtgtggctctggttcagtgtgactgccccaactttaaactctattattgtggcagatattcataagctcttttttttttttttcttttgagctggggtccaatttctg

SEQ ID NO: 160177 - DNA, 249 bp, Homo sapiens
tgagttttcagttgccatggacccaacactcaaggtcacataatctgagcatgcccagatgaaccaaatgtgtaaccatgggtggaacctatatgcttggactgaggtgtggagattaaagtaaaaagtagatgctgggcacggtgactcatgcctgtaatcccagcactttgggaggctgaggtgggtggattgcctgagctcaagagttcaagaccacccagagcaacatggtaaaaccctgtctct

SEQ ID NO: 160178 - DNA, 447 bp, Homo sapiens
acattttgttggtttgtgagaagattctgtctgctcagtcactatcagggctcactgacactagatgccactctgatatcagagcggtctcttatttgggggtgaagacactacagtgggaatctgagtatgcaaaacttctagctgggccagatgtcacctgacacttcttcatcacactggcctggcctgaggactgctgagtatactggtaggggatgctggaaggctggcagcagtgagcacagaagctgaggcaacccaagggaaatcaaagcacatcatattattagcaggtccctgcccaaaatttatagattttatcatcaagttagttatatgctatttattaagtctgataaagcagaacaagaaaatgtgccagaaactcttaaaattgcatataaatataaccatgtgcatatattacatatgtcaatgagctta

SEQ ID NO: 160179 - DNA, 259 bp, Homo sapiens
cacctggcccagcctgataactagtttcctacaatggcttcctgcgtggtctctttgcattcactcttcccccatacagcccattatcaaacagtactcaaaatatttttaaaacataaaccttatctcccaccactgctaaaagctttctaattgcttcctattgcattaaccataacatccaaactcatcactacagatgaattataatgcctaacaattcctttcatccttgggaggggatcctcagaccacccat

SEQ ID NO: 160180 - DNA, 150 bp, Homo sapiens
gggtctagtcctccaaggatgaggaactgctaaaagctttctaattgcttcctattgcattaaccataacatccaaactcatcactacagatgaattataatgcctaacaattcctttcatccttgggaggggatcctcagaccacccat

SEQ ID NO: 160181 - DNA, 721 bp, Homo sapiens
cctagtttggttctgagggagactcatctgtaagactttggctggagaagtgggcagggcgcaaaccatttggatgccacgtatatacctgctgagttcttctggtgaatctgctgccttaagtagagttgcagagggagatgcctgacttgatgaggttgaaaagtaaatggcgtgtgggaaagctgcactgaagaaagaagtttggaaggtaatgtaagaaaaggaaagaggtagaaactcaaggggagaagggcttgggacttttttgggttagagagaatggtgggcacatttatagactaaaaagaatgagcaggtggaaaaaaaaagagtttaatgatatgggaaggagggggaaattgttgcagcaagaacctacagatatacacaaattaagatggttaaaaaaaaccaaaacagcaaaggaacacggtaggcagaatataggcagcctatggtttcaagatggtgtctagaacagcatagtgccatgtaagactatgcttctaagaaaaatagcaccaggtgccattccccgcatgactccaggggagcagggattcccctccctgccatggccgtgaggtgcagaatatccctgaagtccacagggtcttcatgggcagacatgcaaatgtacaggcaggcagcaatgaggagaaaggaagaaggaacagtggcgtggtgagtacccaggatttcccttcagttccctttg

SEQ ID NO: 160182 - DNA, 750 bp, Homo sapiens
gttttggaaagggagtctcgcgggttcgccccggcggggttgccgggttaagaggcctcttggactttggctggagaagtgggcagggcgcaaaccatttggatgccacgtatatacctgctgagttcttctggtgaatctgctgccttaagtagagttgcagagggagatgcctgacttgatgaggttgaaaagtaaatggcgtgtgggaaagctgcactgaagaaagaagtttggaaggtaatgtaagaaaaggaaagaggtagaaactcaaggggagaagggcttgggacttttttgggttagagagaatggtgggcacatttatagactaaaaagaatgagcaggtggaaaaaaaaagagtttaatgatatgggaaggagggggaaattgttgcagcaagaacctacagatatacacaaattaagatggttaaaaaaaaccaaaacagcaaaggaacacggtaggcagaatataggcagcctatggtttcaagatggtgtctagaacagcatagtgccatgtaagactatgcttctaagaaaaatagcaccaggtgccattccccgcatgactccaggggagcagggattcccctccctgccatggccgtgaggtgcagaatatccctgaagtccacagggtcttcatgggcagacatgcaaatgtacaggcaggcagcaatgaggagaaaggaagaaggaacagtggcgtggtgagtacccaggatttcccttcagttccctttg

SEQ ID NO: 160183 - DNA, 165 bp, Homo sapiens
taaatcaataactgttgatgtaactcagcactactacactgctctaggcacataatttgtgtaaaagacaatgaaatacctattcttatgccagatttctttttacgaacatagaatctaagttattcagagaatatgtcattttattacttttttttttttttt

SEQ ID NO: 160184 - DNA, 468 bp, Homo sapiens
atttatgtccgaaataactgcacagggccctaaatacaattctgcaattacaagcaggatcaattattaaaggctgattatacacatttttggtattatattttccctgcctccttcattgcctctccagtaggtttgactgtcttttacttatcgattcattcaatacacatttatgaaggacctatttaggaggcagatggtaggatacaaaaataacacttccttcaagaaggtcattctctcaaggaagaaaaaacaagcaacaagtagtatgacaaaagaaagctaagtctaaggctggaaggccttgtcctctcatatccttttgtcccattagaatgcagtagctaaaggcaagagtttatcttattcaactttccaccctggcatttatgtctggtacatagtaagagctggtaagagctcaattaatactgtcaccttcaaaccaatggccatgctggc

SEQ ID NO: 160185 - DNA, 202 bp, Homo sapiens
acccttcccagattcccctcagtaattataacaaacttcgatgagtattgaagtcatgtctttaaatttttctgtatgacttgtcatactgccaaactctgatcaagggtttttggaaacccaagaacatagggccaaagtggaggtaagccacaacagccacctctggtcatttagtcaacatcatcactgtcgtcttaaa

SEQ ID NO: 160186 - DNA, 509 bp, Homo sapiens
ctgtttcaaaaatctttaggggcctagactaagctacaaaaatggacaatcctccttatgtcttgcccaagaaaatgtttctgtgtaatctacaataatcatgttttcacttacgagaagccacaattcctacagcaaccttaaaatgaaaccaagaggcgacaataaaaacattgctttaaaacaactgttcttgaaaaatccctttggatctggaatccattaccactgtatggcttgccttgtatctcaataacagtcatcacaggtgtttgaaacaagcaggccttggctttggtgttccccccacccaaaatgggacaactctctgatcataatcactcaggctgagtgtaatcacctacagttttctgaagtgagggtcaataatgtctccttttagtttctatgaatagcatttttcatagttgctcagatgccttccctcatgtaggcttgggtaggccatgatataaataaaacactgcctagattattttataagcagg

SEQ ID NO: 160187 - DNA, 243 bp, Homo sapiens
tccctggctcatgtgcacactcctcctcccaccatgcaatgcaaatgcgcaacccttatctctctttctgcattcatggcagacatcactaatcgatccccacattcttcctgaagccaggacctcagccctggagtggcatcacacacaccaagctgttgaagacctggcccagctgaaaatgatttaactcaaccttggacaaggactggcctgaaccaggcactggaagacagcatgagg

SEQ ID NO: 160188 - DNA, 589 bp, Homo sapiens
tatagaatgcttataattgcacagcattccagtaactgatagaagaaaagacaatgatagatgctgatccttattccacgtcaaatggccttgtatagacttgcctaaccagagtctcagatcccactgagtgcttttcaaaaggggcatttttccctgttataacacaggtactatttttggcctcacaaagccttcagcctagacagtgaaatcccagctatagacacatgcaaataatcctagaatttgcaaatatgctacagaaaatatcattctctcttttatgtcaaccctcacatcaccactagtactcccataggcaaggggagactggcaaagattctttacactggaaacaagtgattctgatacactgcagatacttacctcaatacaggttgatagctcattaacacagcttagatttcatgaaaaagtctgcttcctggccggcgcggtggctcatgcctgtaatctcagcactttgggaggccgaggtggatagatcacgaggtcaagagatcgagaccatcctggccaacatggtaaaacaccatctctactaaaaatacaaaaaaaaattagc

SEQ ID NO: 160189 - DNA, 740 bp, Homo sapiens
tgctttttttttttttcatttcaggttctagttcaaattgaatccaagtgaagtgaccccataatacatgttaattgtggaaaaaaatttaaatttagcaaagtaaagaatagagcatgtcactctaccatccactcaacatttttgtggttttttttcatttaattaattccatttattcattctcttaacacaatgcctacaatatgccaggtatattatattggtgttaggttgggctataatattaaaaaggacagtcatggttcttgcccttgaggtctgttagatcaggaattcagaagtgggttagctgagtggttctagcttgtggtctctcatgagattgtagacaagatttcagctgggacttcagagtcatttgaaggcttaactggggctggcaggcctgcctccaagatggctcactcacagggctggcgagcagtgctggcagttgacaggaggccacagttccttgccacacggacctctccacatgcttcttgcgtgtcctcacaacatgtcagcagctttccccagagcaagtaatccaagagatcacaaggcagaagtgacatgtctttataatcacagatgctaccctgctgttctgcagtatcctgttggttccccagtctaccctattcagtgagggagggcactcaccccaaatgtgccgggaatcagtgggggcattttggaggcttgccactcgctgcctgtaaaatgagcatcat

SEQ ID NO: 160190 - DNA, 742 bp, Homo sapiens
catatcaagtcagcaagcccccttttttgtagcagggtctcactctgttgccaaggctggaacaagccctcttcaacaaagctaagatggtccatattactcatgtggatgagggtgttgaaggacatttactgccttccttcatggtctcacttcatgatcaaaccaagatgcacaggaaataggtttgacaatttacctttaccaagaaagacgattcagcaacagtggtagagctgcctgtttgaacttaaccttggtcatctcagtttgaaatacaaatggcagcatggagagcaggctgcccgctttttggttggacatttctttcactctgagtttgaggtacagcaaatttcccaaatcattcagatgtaaatattccaatactcagaccaggggcccattcaggaggctgagtgcaggaagatggcctgagctcaggagttcgataccagcttgggcaacacagcaagactgtcttgagaaaaagaattctaaacaaaataaatacaagaattcaaaacaaaattcatgaaagatataggaagggtgagggaagaagtccaacattttatcacccaccagctaccaagtatctaacagcacaatgtcctagctctgcggtgctcttgaaagaaaaagtgaaaaccctgacaagggagccatctggatttgtattcctcaccatttaccatgactagaatgcttaggagtgtgcccttcagaaactgagcttttc

SEQ ID NO: 160191 - DNA, 378 bp, Homo sapiens
ggcctcaagctacttccactcatggtggaaggggaaggggagctggtatgtgcagagatcacatggagagaggaggcaagggagaagggaaggtgccaggctctttttaacaactagatgttgggagaactcttgctggaactaacagagcgagaacacactcattacctcatggatggcaccaagacattctcgagggatccattcccatgacccagtcacctcccattaggccccgcctcccacatgggggatcagatttcaacatgaggtttggaggtcaaatatctaaactacaacaactgcccttgcttaaacccctcctaacttctcatcttgcttagagtaaaacccaagcccctcacttggttgtttcaa

SEQ ID NO: 160192 - DNA, 393 bp, Homo sapiens
cacatgtgtagcctcggtggttttgtgttgtagatgataaggactaccaaccaccagaggaagaatctttgccaagggtggcatggcaaggtatccatccatctgcaaacagggttttgactattcagtatttgactaggcagtgttattcagtgtaatacttctttctcttttttcaaatgtcctcagtcttccctgtaataaacatcggtttctgaaaagtgtaattgtgaaacctcagatatctgaccaccaggaaatgctgttgagaggctccttggcatttataataatagcaataaactcagactcagtaaagatggttactgtgatttcaggttttgggtaaacagacgggaagccacaagatcaatgtcgcttgagcaggtgcgc

SEQ ID NO: 160193 - DNA, 468 bp, Homo sapiens
ggcttcacaggtgcccttcctgctgtctgggaccctttgccagactcctccccacctggccacccttctttccaaccaacaacgtggctcctcggttcctccaggttccttcctgccctgtaaaacccctggcctcctgccaggctcaagaaatgccctcggatctcttccgtgctttcgccccgcaggagacacagcctaggtcccgcctccgtcacgcgacagagactcagaaagcgcccacgcgggcagggcccgggcaagactacctcaccgccgcccacccatccccggagccttcagcagcgcggagctcaggcttccctgtctcccctctgcccccgcgccggccgtgcgtgcagtgcttcggcccctaggctgcgcccgcgccccgtcctccctcccggggttggtgcgggtctcccaggccgggccggggcactggaccgacgcccaggaagcggccgc

SEQ ID NO: 160194 - DNA, 495 bp, Homo sapiens
aaacttagcatcctccaaggttggcctaagggaagaacttccttgtgaagaggacactggctgaactttgtaactctaatttcaggtcaaccaaattcaaactccttttgtgctgctctcactattagctgttccccacactagcctggcctcgggagagcagagatgatgatgccactgtcaacactggccttgtgcagcaagggtgacagcagagtctccccttaattcccagtgggacatccaagacaatggtgtcatcataagcctcattattggacactcatcattatcacaccatcacaacagctgtttgatttttattttcttggtttctttgacttctcattatgtaatgcgcgttatcttattcaacagtgctgtgatcgagggcgtgatagaagcctgaaagtatacgaaaaatcaaaccaaatcaaataatctcccgaatagctgggactacaggcgcccgccacacacccagctaattttttg

SEQ ID NO: 160195 - DNA, 628 bp, Homo sapiens
cccttcctatgcatttttttacccagttagtgcttttaacacctgtatttagtgctctatagttttactatattgtgaatagtttgggactctggtttacttatttattcattcattctgcttgcaaatagttgagctttctaaattgccactctttcaacaattctggaatattttcagtttatctgtttaaaaaacacctcttttgtattagcttattctaaaatgccaattagacatcaatcaaattttctaacttttttcttcatgtcatgcaaactttcttttgtagttaccattgctctttctgagattgcattctagatgctttttctattttaactttatatagccaagctattgttttttcatcagtttcttaatttttgatctttgattttcatttcaataagttgtattagatctcaatttactactgcttttgaatattttcttctggcttacattttgagctttttaaatttttttttttaattcttgatgtatttgactacatagtaggtatacatacgagcttattttttattatcttaatatatggacacttcattatcttttttggaaaggttcataatatataactttattggcctatctctcatactcc

SEQ ID NO: 160196 - DNA, 359 bp, Homo sapiens
ggcagacagaccacgcttttattttcttataggcatttatgttcttacagggatggtttagagaggcttatggatgaattaaatggtttgcaaaattaagactggattctctaccaagtagataggcagggacaataaaggaataaaaagccacatttggagctaatggcattgcaaaaccaattctggatggagaagttggaatcagatgaccctctgaacttgaagacatttggtgaaacagcctggagtctgcccatcatgcactgagtcacgggtggttggtgtgggtagacactctaaacattttggctctaagcgcctctgtttatacaacattctttcccgttgcgtcagga

SEQ ID NO: 160197 - DNA, 486 bp, Homo sapiens
tggttgaagtgatttgttacatgatcttcaatataattaaactacatgattaaaataaaaatatataatttgtattcagcattagttcattatataacacaattttactctgaaatgacattaattattggcctagaattagagaccaggcttttacaaagttgaaaatgattgatagtatactcttaggatcatataatactaaaatcattcaattatttatttctagatatacagtcaccctcaaagcttgtatgtatagattttatgaatcacttaaccattttgcatctctttccatatgttaaatatgtcaataatacacatgtcaaaagcataaccattaataaccttacagaggtataatttaagtaactttaaatcattacagtcaccttccagttgccaggctatcttgaaaatatgtaattgttaagttgatgctatagtaactgtcaatgtttctaatggcaaccaagaaaagca

SEQ ID NO: 160198 - DNA, 296 bp, Homo sapiens
ccactccatcatacagattttccccagcaaatacatgcatatgaaaaaaaaactgtaatttgttcagcagcaatagatataaattaaaaaaaaaaaaaggatgcgatcgctcacacctgtaatctcagcactttgggaggctaaggcaggtggatcacctgaagtcaggagtttgagaccagcctggccaacatggtgaaatcctgtctctactaaaattacaaaaattagctgggcgtggtgatacacaactgttaattccagcttctcaggaggctgaggcaggagaatagctt

SEQ ID NO: 160199 - DNA, 362 bp, Homo sapiens
cactatgcctggccttgaaattatattttgaaaaagagccacagattattttggtggggtttcacattctccaatttttttttaacttttacttttactttttagaccacttaatgtggtctaagattcacatgtgactctaagtgcctatttttcaggtagctttaatttttttaaattctaaaatctctacttagaatccttcctgttaacctcaactggaattaggttaaacttttttttaaaatggaaagtttcaagcatatataaaagtagagaggatggtataataaatccccaagtttccatcgtccaacctcaataatcattaactcctcgtctctgccccaccccccaatccc

SEQ ID NO: 160200 - DNA, 200 bp, Homo sapiens
gcaaagtttacccaatacatacaatttcagatgtatacgatttttaatcaatacccaaattatcttgagtccctttccttataccttaacaactcccatttaaaaagatcagaaagatactcctttaggatgaaaaggtagatgtgatgacttctaaagtgacaataattctagaattctataatactctggattaattt

SEQ ID NO: 160201 - DNA, 547 bp, Homo sapiens
gtttattccgcgtctccaaggggaaaaagaccctcccagccccctgcatctgctgctgtttaatagcggttacaggtattccagtgatacaactatgctgcttagttaccctccacgcattattttttaattgtattaatggtacgccatatcccttactgttaagtacttacatgtgaataatcgtaagaatatgattgcttattgatagcctataaattcatgtcaggaacaatagtgatgtctagcaaccgcagactgtcaacatggatggctgagatggtgacacctttgctttctgatggttcaatgtatacacacttctttcatatatgaaaatattgtataaaattacgttcagactggccgggcatggtggctcatgcctgtaatcccagcactctgggaggctgaggcaggtggatcacgatgtcaggagatggagaccatcctggccaacatggtgaaaccccctctctactgaagacataaaacttaactgggcatggtggcgcatgcctgtagtcccagctactcaggaggctga

SEQ ID NO: 160202 - DNA, 280 bp, Homo sapiens
agcattgtaagtgcccaataaatggcagttttcatcactatttccttatcttggaagacaggagtagctaaattatcatgtgccattgataccaaaggcctaagggagaagaagagaatgcatagtgaaaaaggagaacattttagtggccagaaaattcagaatatcttgcccactgacatatcaccaccttccaataaccaacccacagctgggctgcctccctggcatttctgtcatgtccttgcctaggtttcttcaatttatgcttttctttttg

SEQ ID NO: 160203 - DNA, 291 bp, Homo sapiens
gcaacaagagtgaaactccgtctcaattaaaaaacaaaacaaaacaaaacaaaaactaaagtctggctaccttctccaaacattctgaattaattaagatggaatgtgaccgggcatcagggttaaagtgtcttcaagagactcagtgtatagcaaagtttggggattcctgttttaacatgaagcagagttacttctggtgacacgtacctcaacagagcaagcctagacaccctgaggaatgttttctgacacttgaattaaattatactgtatagataccacgcttgt

SEQ ID NO: 160204 - DNA, 659 bp, Homo sapiens
ggaaatcaggctatgatcaattgagtatcgaagttcgagcgtcggtactccggcagccccctgcaagacgcagagagccaaggggatttgctgagacttaacggggcacttccagttcattaagagctctatggagaagggtctttcggggtgcagggatcccccaaagaaagggggtagggtgtcggatcaaaaggggggcacagaaaatatgtattgggcatctgaaggggaagtggcgctgcttaactctacccatttgttcatggaatactaggaggtaagagttggctgcgtgaatgttgcatgtgtggttctcaacatcattttcaataatactccttgtatttttgttcacaaaacctttaaaaagtctttgaccctgggctctttttgtcatatttatgctaattgttttaccactcgaagatggtgacctccctgtctgcaggtgtgcaagctgggtaggtccctcggggaccctgtgcgctaggaattcctgcactgggtgggttaaagtagatgatgcatctgctctcctaatttaatgtagtaatttctgtgcagtgcaaagaacaactggtcacatgaaaagtctgatttgatgcctcagccgctagctagctctgaatcttgagtaaattaccttctctctctga

SEQ ID NO: 160205 - DNA, 333 bp, Homo sapiens
tgacagctctctgtccagaccatacagccgaaaaaaggagtctctcacagggtgccacctgcatgccagcaggaatgctctctaccagaatttgggtcttggcctgggtcactttcagtgtttgccttcactttcttgtcagccgttatccgcgtatatgcttcggaagtgggcggcaagacgcagagagccaaggggatttgctgagacttaacggggcacttccagttcattaagagctctatggagaagggtctttcggggtgcagggatcccccaaagaaagggggtagggtgtcggatcaaaaggggggcacagaaaatatgtattgg

SEQ ID NO: 160206 - DNA, 237 bp, Homo sapiens
tatctcagctgctcctcacaataatattgtaaggtataatagatatttattatcctcccttgcacttatgctgttttctccagtttcatctccaaaggtcaaatccaaaggcctccaaacagtcctcacctaaactggccaggatgaaacatcaagtcatcaaagcctctccaactctctgctacccacctgctaaatgtggatgctccctatggtttcagcttccactctcttctc

SEQ ID NO: 160207 - DNA, 465 bp, Homo sapiens
aaaaggaatgaaattctgatacatgcgacaacacaagtgaaccttgaaaacatgctaagtgaaataagctagttgcaagaggacaaatattgaatgattccacttaacatgaaatatctagagtagtacacagattcttagagacagaaagtggattggaggttaccagcagctagggggagcgggaaatagggaattactgcttcatggttattaaagagtttccctttggggtgatgaaaaagctttggaagtaggtagtgatattggttgcacaaaattgtgaatgtaattattgccactgatttgtacacttaaaaatggttaaagtgattttatgttatatcttactacaataaaaaaagtctttaaaaatcacagcaagatgtttttgtagatatagacaagcttattctgaaatttatatgaaagggcaaaagttctagaatagctataacaatttag

SEQ ID NO: 160208 - DNA, 297 bp, Homo sapiens
cctataaatgtgtgatcctgctttatcatgccctccctcttaatatcaaccacttaagcgaaaacagaactacctctgcctcctacagtgtcctggccctagtcaagttaggcacactgctgggagtggctcccatggctaaatgctgtggtgccatgggatggtgatagagctgatatggaattttgctatacaagccagccctcactattgtaccctcatgttgagggagaaaaaaacatggctttagcacctatcacgtaccaggcattgtgctaggggctttacatacattaa

SEQ ID NO: 160209 - DNA, 257 bp, Homo sapiens
ctcatctcccaggaaccaagggcaaagcccagacctctctttgggcaaggttaatttctttactatagtcataaaagtgggacttcaccttgtcagagagaaagcctctctgagtaagtgacagttcagctgaaatctaaaggttaagtaggtattaactaggggagagaggttcaggatcattccagattaattacagctttatagcaaaagtgagtaagactagtaaaaggtacaggaagaagaccaatgtagct

SEQ ID NO: 160210 - DNA, 370 bp, Homo sapiens
gcggacggtggacaggcggtgtggacggtggacactgtgatgcggacggtggacaggcggtgtggacggtggacactgtgatgcggacggtggacaggcggtgtggatggtggacaggcggtgtggacggtggacaggctgggtggatggtggacactgcgatgaggacggtggacactgcgatgaggacagtggacaggtggtgtggacggtggacactgcagtgtgaatggtggacaggtggtgtggacagtggacactgcagtgtggatggtggacaggtggtgtggacggtggacaggcagtgtggacggtggacactgtgatgcggacggtggacaggcagtgtggatggtggacaggcggtgtg

SEQ ID NO: 160211 - DNA, 517 bp, Homo sapiens
ccgaggcaggaggatcccttgagcccaggaatttaaaaccagccagcgccacagagggagaccctgtcttaaaaacaaaatttatatgtacaagccctaaaccccaacacggtcatatttggacacgacgaaccttttaggatatcacataacatttataaaagagggccctcataatgggattagtgagagagagagagaactctgtctctccaacatgtgaggacaaagcaagaaggcatctagctgcaagccaggaagatagccttcactaggaacaaaattgctggcagcaagattttggattccccaagctccagaactgtgagaaacaaatttctgctgtttaagaaactgagtccatggtgttttgttatactagcctgagctaagtcaccccaagagtcctcacattaaccatatactgtcatacaagtgctgcatttggatctacctggaatgtctccaaattttctgcttttcctcttggacccattgtgagaataggtttgcttca

SEQ ID NO: 160212 - DNA, 204 bp, Homo sapiens
acttttagaacatttctgtcacccaaaatattccttgaaccaatttgtaaacaatcccctttcctaccacccattatgggtaaccagtaacctatagatttgccctttcttgacatttcatataaatggaataataacaaaaatgaccttaaaatgttattgaggtacattcatgttgcactacctgtcattagcttaatcttt

SEQ ID NO: 160213 - DNA, 145 bp, Homo sapiens
taaccatgcccatggtagcatgctccatttaccaggtatgccttgtccttctttagatgttccttgaggccaacctggtttcccattgtcctcagagaaaaggtgagatgtggttttcagccctactctacagcagcccacccca

SEQ ID NO: 160214 - DNA, 610 bp, Homo sapiens
aagcacttgctgagtgcatgagtactaggctacacttgctgagtctttgagggctgctatcttgccccctctctgtttctaggcagggaaaatgacaccttaaccattctcagttcaccacctcagaggccctcctgagtgctgatgtgattctttagccgccctgccacaaaataaggctctctctgccctcttgcctccaagacaatcagaagcagctggtagtgcttttgtactgttatgacaccaacttgacatttccctggatctgtgggcaacaagtactagatgctttctttacaattcttggaaagaatcaactgagaagccaaattctactggacattgtctagctggttatcctctagcttctgagatgatgctcaaaacttttaacaaggacattctagagaaatgacagataaatgctttgggacgccaccgcgacctgttgccccataaatgcacaagagattcttaattctttagtcagccaccatgccagcaataattaaacaagcccaaagggagcaattcatagctgctattggaccatcaatctggaactcatgacagatgccatcagaaaataatctgcagacgtgagcac

SEQ ID NO: 160215 - DNA, 360 bp, Homo sapiens
gacactcatactcacaggcacgtgcttgtcagctcagtgcatacacaagagcacacctacacacgtacacatatacacacacagatgcagggcctgcacatacgtgcacgcacacatgcatgtgcacttgtgtgctcggccctcagttgcattctgctcctaacagaaggggcacccgaggcttccccagtccctcaggagtcccactttctgctttcttttcccagccgagccacttcccaccagcgctgggcaggcttagcctggtgcttgacctgcttcccccatctacatgatgcggatgatcagtgctcacacgggaggtccccagccatgtgcctggcacacactgggccacaa

SEQ ID NO: 160216 - DNA, 373 bp, Homo sapiens
gcatcactgttcattccccaacacataccagacgcttgttactatcatcctcatctcgcagatgaatagacaggtcatttaagttatctaatcaggagaggggctgagtgcaggagctctgccatctttacatcctgccctgtcgtgagcagatttgcctgctggctactttgtccccattccgtgagagaacagagcagaccctcctcttggccagaagagaaaacagcgtcaatgaaagagcaatcaggctgagtggcctccaattcaacctggcgctcttttgcgtccttgcctgagcacaaagcccttcactccctgttggaatagcagggagcaatgaggatggagtcccctgacctcatgaccaagg

SEQ ID NO: 160217 - DNA, 641 bp, Homo sapiens
caggaggtggtaaagcagacaaccattgagatatctggtagaggagcaagtgaagtggacaggaatatccaaggaagagcctgatcagtgttggaattatcagggaccatatgttattctgtaaactttacagtcaaatgaagctttgaagagtggaatgtctctaaattaagggattttttcagatgttagaatttttggcaattttaaatgaggcttagtgggataagactggagaactatatgaggtcagcattgattaaatcaagcacctgaattcaaaacttggagatatgaacttaatgggataatttttatgcaacaacaagccctgggcatctacttaaatctgtttgtgtgaatttccccaggtcacacatattgtagaatatctaatactagaaactggtttctgaacttcctgtccaatgcatttatttgccactggaaaaatctcacccaatgcatttcccactaacttgcctcttttgtgtttgaagaccttgcagaaatattgactaaactgaaaattattttctactcttttctgagaactgtaggggagagtgatgtggtggtgatggtgtcagtgagagcatatgtcctgagctcccaactgctacatcactgaatttcaccag

SEQ ID NO: 160218 - DNA, 380 bp, Homo sapiens
gtaactctcattaaccaagtgcactgtgttttcagaattatgaaaacagctcagaaacagttaaagtgacattagtaaaaagtatgtgtatttgtattactatgatatttatattcaagaagcttatatcaggaaatagtctagatactcagtggtatgtttgaagcataggtctgtttcatgtcttaaccctgctgagctgatgttcctggatgaaaccaactgcacttaaactcctgtatttatttttctgtctctgggccctgtctgaggcttcttaagatgttgttacaataatctactatgtggagtgtctggaggtgtctcttacttctctggcattaagagacagtgattcgttggaaagcagaatttcaaat

SEQ ID NO: 160219 - DNA, 492 bp, Homo sapiens
  misc_feature (299)..(299): n is a, c, g, or t
  misc_feature (371)..(371): n is a, c, g, or t
  misc_feature (375)..(375): n is a, c, g, or t
ctcaactgctttattacttcacacattccaaatgttaatggagagtatcttgaagagggaatgtgtgagggatggaagcggaagagaaagtagagacttttaattttctgtcatgtatttctatttgaattttttttgaaaataagtgagagtacctgagaagtctgtgtaagtggccaagagcactccgttggaggaataggcagcagaagagtaacctgacaaagagcccgagcaggagctgccagaagagggggattgtggagccagcaggaggaagagtgaggagtagtggaganggacttgctgatgataccttcgagtctgctgtgaatggaaaggagatagggcagggttggtccgggtctgtntctngtatgatggtaactgtgagaatatttgaaggccaataggcaggtgctagtatacatgttagagatttaaggtattttaggagggcaggagttgtgaaccaagggaagtataaagcgt

SEQ ID NO: 160220 - DNA, 613 bp, Homo sapiens
ttgccattttacttattcaatggggagttttattgccatggcagtgcagctttcatagctacaggatttcagcattatgctcacccaaatgattcttaaaacttaagagtcactgagaaaggcctaagggcacttcagaaagcaatggctttcccattcaccacagcttctggtatagatggcaaaggaaatagtgcccggagcaaaactgagatgtttcccagttacctcttggagctgactctctgaaagatggttatattatcaatgccaatcagaaactaggcatggagattacagtcctaccttcctctatgaacacaaatacgcctgcccccaccatcatccctctctccattagcaataacatttacgaatgatatgtggagtggctcctggacccctctctgatgttccctttttgcacagcaaaatgatgacagccagggactgatgatgcagttatttgtacattaggcatcaatctggaaaactccttctatagaaacagtagttaggccgggaaaggtggctcacgcctgtaatgccagcactttgggaggccgaggcgggtggatcacatgaggtcaggagtttgaaaccggcctgacca

SEQ ID NO: 160221 - DNA, 273 bp, Homo sapiens
gactgtggatctcaagccctcagtgccagcctggcactgggaaagcgtgtcaattgcagcagaggtgtcaatccatcagacccaagctccattcagtgcattccccttacctgttccgctgcaaaacccagagtccctcattcctagttcaggaagaatctcattttaagtggggagaaaggaagcatccctccacttgtgctgttgatgacaaaggaattagtgatgctctggggagtgtgctggaaatcctctacagagaattagaaaact

SEQ ID NO: 160222 - DNA, 435 bp, Homo sapiens
ctgtgagggcaattatttaataatcttaatgctttcttgaggattactgttccaattatgatttccatttctccttgagtcagctttaagttttattgctagaaaagaaaaatgccaacttgccgtcatctctgctgtcactattttgtgttcaacaattgccttctctatctgctgtatctttttcagcacagaagctgtaatgttattaaacaaagcaatgtatccagatcactcagaatctatgcctgtcacggggagcaggagaagagggtgaatgaagagccacagcatggcaggggagccactgcaaggatgctgaaactcgtgtgaacagagttgctgtaggcaggctgctatggaaccttttggggaagcactgcctcttagggatggcagtgaaaatgggagaagagggtggcattgcctccagat

SEQ ID NO: 160223 - DNA, 406 bp, Homo sapiens
ttaaaaaccttaattcccagccatgatgagatgcgaggtcagagacacctcgttacaccccctccttccctagccaccataagtctttctttcctcagtgtcgaacaaaaatcaaccctctcaaaagacttgttcactgctgatttcaaccaatggcctcacgctgccttcccttttgtggtttccacacagcaactgaccggcattcctttctgataagaggccactgactatggtgtggttctggccaggccacggaggctgtgcactcagtatctttctgtcctctgcttcaccttctgatggacagggtctaacagtaatacatttaaatattaagtgtccatctcaaagggcaacaagggacacatgtaacaaacgtgttagtttatgacacatgcatgtg

SEQ ID NO: 160224 - DNA, 587 bp, Homo sapiens
taaggaaaagataagcaacacatctggggaaaagggcaggtggccagcaatcgatgtggtagctctttgcccctctcggacagcaggaattagcttccccaggcattttctgtatgtgagttgtattgtgggatgtacaaatatcatctgttcctttgggtttccaggccagtagctctctattttgggttcaaacatgggttctcaggccgggcgcggtggctcacacgtgtaatcccagcactttgggaggccaaggcgggcggatcacgaggtcaggagatggagaccatcctggctaacatggtgaaaccccaactctactaaaaatacaaaaaattaggcaggcatggtggcgggtgcctgtagtcccagctactcaggaggctgaggcaggagaatggtgtgaacccgggaggttggaggttgcagtaagccgagattgcaccactgcactccagcctgggcaacagagcgagactccatctcaaaaaacaaacaaacaaacaaacaaaaacatgggttctcaaaaggcatgcccactgtctcccatggagcttgacagcccatgccattagctctcactg

SEQ ID NO: 160225 - DNA, 367 bp, Homo sapiens
tatgaggagcaggaatatttagagcagagggaaaggctggagccggacactgggggaccccgctgggatggggctctgccttcaagtggactccttcctgtgtgcagtgtctgccagctctgtttgctcaagccaggggggacgtttgctgagcttgcaaggggactctgacccttaaccattttgcagcctatggggaagtctcaggtatttgcacccattggaaatcaaagtaaagctaggagtctactgttggcttgcctcctgtatttctggttttctttcttgaggagtttgtggggggtttggaggcaccaacccctacccctcttgcctagtccttgcctgtccaaatcactaggtgaga

SEQ ID NO: 160226 - DNA, 439 bp, Homo sapiens
gttcacacaaaaacatgtatgctaatgttcatggtagtattattcataatagtgaaaaagtagaaataacctaaatgtccatgaactcatgaacggggaagtaaaatgtgaaatatccttattaataagagcttaattagctcttaataagctaacgcaggctgatgcagtggctcacgcctgtaatctcagccctttgggaagctgaggtgggtggatcgcttgagcacaggagttcaagaccagcctggccaacatggtgaaaccctgtctctactaaaaaatacaaaaaattagctggtgtggtggtgggcacctgtaatcccagctacttgggaggttgaggcaggagaattgcttgaacctgggaggtggaggttgcagtgagccgagatggtgccactgcactccagcctgggtgacatcgagattccatctc

SEQ ID NO: 160227 - DNA, 151 bp, Homo sapiens
aacttatttgacaaaataatacctgaatattttctactctataaagagatttagactcctacatacaagaagattagagattccaaaataaagtagaaaagatcttctccagggaatatggaaattatactgtcaagtgtcaacaacaatg

SEQ ID NO: 160228 - DNA, 253 bp, Homo sapiens
ttctcctttgcctgctgattccatctctatgcttgggtgagaagaccatggctacatgctgcgaaggcttgggctctccagctacccagtgttctctacaggtttccatcttatcagtctacttcttgggatctggctccctgctgccatgttttccaaagtcttaagtggctgctgatcccagttagtttgttccatcaaattctaccttttctagggctactggtgcctgctatgctgttactctctctga

SEQ ID NO: 160229 - DNA, 388 bp, Homo sapiens
ttacagtgaaatcaagcaaactccaccttcaccaagtaactaaacagaacatcaccagcaatggggcacagccaagccctggaccacctgctaggaggcaagaaggatgcagcgtggaggcggagctagacccctacagttgcgtgacctgacgctgctgatgggggagcattctgtaaccaaaggaggctgtaaccttccaaagagtcaaggtcatgaacatcaaagaaaggctgaggagcagccccaggttgacagagggggacacagccacaggcagcccagggtcctgaggctgctctatgctatgaagggcatttgctgggacaattgtggagaagtggacgggtcacggattgctgctgttggctggatggagacggattga

SEQ ID NO: 160230 - DNA, 265 bp, Homo sapiens
ggtttaacatacacatatcaataaatgtgattcaccatatacacagaacaaaaaagccacaagatcatctcagtagacacaggaaatgcctctgataaattcagcacacattcatgttaaaaaccctcaacaaattaggcattgaaggaatatatctcaaaaaaatgatcatctatgaacaccatactgagagtgaggggtcaccgagctcgcaattcgctagtccatggctcatagcgtgttgtccgtggagctgtaacaaggc

SEQ ID NO: 160231 - DNA, 175 bp, Homo sapiens
agcgagactctagagagcagccccgctgaagtgcagtggcacaatcatagctcactgcagcctcaaactcgtgggataaagcaatcctcctgcctgagtctctcaaggagctggggctacagatacatgccaccacacctggctaatctgtaaacattttgtagagatagggtct

SEQ ID NO: 160232 - DNA, 228 bp, Homo sapiens
gcctatactgtcccatctgcagataaatccacagaggctcagagaggttaagtaattggctgatgatgacatggcaggtggtgaagccaaaactagatcccaggttttctaagtctaagttcaagacactctctactcacataacatactgcatcatccattgatgatgcatcagtttcctcatcttcaaaatagagtgttatgtgagtagagagtctccgtcgaact

SEQ ID NO: 160233 - DNA, 207 bp, Homo sapiens
cgggagtgatcccaggaaacaatggacaggagtgaggaaataagacaggaaaggaggaaaattactaaaggagtgtgctaatgtgcagaattgctgctgtgggtaactggggctcaggccctttgggactctagggagactttgcaggacattcctcaatgttgtcctacccaagaggtgagaagttgggatatttatccagcattt

SEQ ID NO: 160234 - DNA, 913 bp, Homo sapiens
tgcctcggcctcccaaagtgctgggattacaggcgtgagccaccatgcccagccgaaaatggctttcttgagagatcagctttgaagctctactccttcattttaaagtgccccaggagaagtggacgattacaaagttgagattccacttaagtgtccccttagtttaactgtgggattcatctcctggggaggttgccaggttctggaaagtgggtgttaatgaccagggagggtgcccctaggctagcatcctgtaaccctcaggaattgagatttttatggaggttttctcttcctctctgtgagttttctctctgagaaacctgtctagggagggaggctctaggctagcatcctgtaaccctcaagtagtaattgagatttttatggagcttttatcttcctctctgtgagttttctctctgaggaacctcagtgtaccttttactggcctcctaggtaatacttgtttggagaatatgtgtgatgtctaagtcttcccagtacaagaaatttgtgtggtgtttgactgattgatggatggagtcttgttctgtcgccctagctgattgtaccactgcactgcagtctcgacctcccaggccaagtgaccctcccaactcaccctcccaagtagctgggactacaggcatgcaccagcacacccggctaatttttgtatttttttttgtagagatggggtttcactatgttgcccagtttggtcttgaactcttgagctcaagcagtctcccagagtgctgggattacaggtgtgagccaccacgcccagcctcgtgtggtctttgatacccctgggttcattgtattgttcttcccacactgcttttcattcattcatttattcagtcattattaattgagcagctactatgtgctgctgctgctc

SEQ ID NO: 160235 - DNA, 289 bp, Homo sapiens
agccctcaggtcactgggacatgcactgatggagagctgtggaactctccctggccaagaaaggtgtttgctttccagggaccctgggaccatctaggaagtggatgcattacctgcatgtgtggctacaaagagccttcctctctccaggaggccaccgtcctattactaggtcctcccttccctctactttgccctattcaaagctaccttccctctactttgccctattcaaagctaccatcaccaagtatcaaaacaaaggtcccaactccgcaaccattgtgtg

SEQ ID NO: 160236 - DNA, 442 bp, Homo sapiens
accagctcagccccgagctgccgcagcctcaggcagaacggaggtcaccttctctccttatcttgggaaccaggccttcctcccggggactgttctgggattgaaattgtgcatactccaaactttcgcagccatcttcccgctcagccccagacacccagcaatcaagccagatgagtaccacaaaacagtgtgtccccagcagctccccaccccagagccaaatgacagtagtgcacttaaaaaggaaaatcaggcctgttgtccttctccggttgcattcagatgggtcattagggccggaccctgcctgccccttggcttctcagggctttgctctgacaccatgacagctgcccggggctgagggcagctggctccactcaaatgaggaagaagggatcactcccattagggcctgctttgcttatgcatgtgtgtg

SEQ ID NO: 160237 - DNA, 1464 bp, Homo sapiens
caccatagaggtgggccgttggcgacgttagaggcgcgggtgttcggctacatcactggggcgccatggtgcctggagctgggcagttttctcatcagagtggggactggtaagagtgacctccccgccaggttctgtgtgttgccggctgaagaagggtagctgaaaaattcagacccagcacagtgtttatgttggtcaaaaatagaaaactatgtctggcgcggccgaggcgggaggacccttcaggccaagagcagcctagcaacatggcgcaaccccatctctgtagtcctacctcagccccccagctacttgaacccaaaggttcaaggctccagtgagctatgatcccaccacagcattccagcctgcgagattgagatgatgattattccccaccttctaagagacaaagaccaacgagccaccacagccaccagtcccagaacccgccaatgctggggaacggaaaatgagggagttcaactctggccctcacaatccagtggaggagacgaaactcatctgcctctgtccctctgggcacgcctcatgccaggtgcatctgtggacaggggccatgctcctgggcttccaaagttggagaaagctgccaggctcaggtctgaaggccagaattctacagtaagtcctactgagtcaaggtgggagcagggtcggtagcttccgaggctctgcgggagaatctgtttcctggccgtagaggtggcctgcactcctcagcctgtgctgcccgtctcgaatgactggagtttcctgcttctgtcactacacctcccaccctctccatcacctgctctgctcttacaaggatccgaagaaatggaatcatcgtatcgctgatctacgtaaacaaactgaagaattgtctgaaagaaaatatgacatgaacttatgaattcaacaggtgaagatttacaacttgataaatcaactttgtcagctcgagctgtaaaagccaaaggtccggtgatgatcccatacccttttttccagtctcatgttgaagatttttatgtagaaggccttcccaaaggaattttttttttttttttttgagatggagttttcactcttatcgcccaggctggggtgcaatggcgcaaccttgctggtcactgcaacctctgcctcctgggttcaagaaattctcctgccttagcctcccaagtcactgggattacaggtgcccaccaccacaccaggctaatttttgtatttttagtggagatgcggtttcaccatgttggccgggccagtctcgaactcctgacgtcaagtgatcttcccgcctcgactcctgatatcaagtgatcttcccgcctcggcctcccagagtgctgagattacagacgtgaacccatgcctggccaggaattttgttttttaggaaggctttctactaatggaattcctggccttgagaggatgttactttag

SEQ ID NO: 160238 - DNA, 708 bp, Homo sapiens
caccatagaggtgggccgttggcgacgttagaggcgcgggtgttcggctacatcactggggcgccatggtgcctggagctgggcagttttctcatcagagtggggactggtaagagtgacctccccgccaggttctgtgtgttgccggctgaagaagggtagctgaaaaattcagacccagcacagtgtttatgttggtcaaaaatagaaaactatgtctggcgcggccgaggcgggaggacccttcaggccaagagcagcctagcaacatggcgcaaccccatctctgtagtcctacctcagccccccagctacttgaacccaaaggttcaaggctccagtgagctatgatcccaccacagcattccagcctgcgagattgaggtaaaccctgtctaaaaaaatttaaaaaactatccaggtgtgcaacagggagggactgctaaataaaacatgaggctggctgggccctactgtaatcccagcactttgggaggccgaggcgggaggatggatggcttgggctcaggagttcgagaccagcctgggcaacatgacgaaaccccgtctctacaaaagatacaaaaattagccgggcgcggtggacacctggcctaatttttgtatttttttctagagatggggtcgggcaatcttctcaccttggccatcagagttgtcgggattacaggcgtgagggacagcgac

SEQ ID NO: 160239 - DNA, 256 bp, Homo sapiens
ttgactgctctcaggttactcaggaaaagaaaactttgagagggaggtagaccctaaaagcaattttaccactgtcaagtctcagccctttcactcctacaaactaggaggtcttgctttttccttcccactcatcccccccccatggaaagtggctcctgctgtttgtagcaaaattaatatgagcctcatttcttcatcttttgtatgaaggaatatgaatttatcttttgtatctaaattgtgcaacttagta

SEQ ID NO: 160240 - DNA, 396 bp, Homo sapiens
cacccaagagaaaagattcaaaaatatgtatctatcctataaacaaccctagcagttcttatgtcaacagtaaaaaaaagaatcctttgttccaaaaaaagtgttcttaaaaatgcgttgtaggccgggcgcagtggctcacgcctgtaatcccagcactttgggaggccgagatgggtggatcacgaggtcaggagatagagaccatcctggctaacacagtgaaaccccgtctctaccaaaaaaaatacaaaaaattagccaggcatggtgcgggcacctgtagtcccagctactcgggaggctgaggcaggagaatggcatgaacctgggaggcggagcttgcagtgagcagagatcgcgccagtgcactccagcctgggcaaaagagtgaga

SEQ ID NO: 160241 - DNA, 488 bp, Homo sapiens
aaccttccccactgaccctcactccccttcatcctaccctgagggtcacctccacccctcctcccaggaatgcctggagaggtttgaagatgctcgcatgagccccctgaggttctgcttctccaggcctcatccccagttcccccagtctgtcttcattacagcctaagcctcagccctgcccctcccaatcctggccgcttcccctggccataccgtcatctgcccacatccctcccatagggcagggcccagaagtggacaggatgggtgttttgtttcattttgttttgagacggagtctcgctctgtcgcccaggctggagtgcagtggcgcaatctcggctcactgcaagctctgcctcccaggagcctttgatgaagtgacctcatgcctggtgaaggtgccagagaagacagaaggtggcaacaacatggctctggttgagaatgtcaccacccttcagaagagccaggatctgcgggag

SEQ ID NO: 160242 - DNA, 220 bp, Homo sapiens
atgtattttttacagttctaaagaccgggaagtcaaacatcaggcagctacatctggtcagctgctgtggagggcctcatgctgtaccctaacatggacaaaagcatcacaggacaagagggaaagggtgacagcctaaactggctgtttatgacagaccgactctcagacccactctcatgataactaacccacacccatgataaattgttaattgatt

SEQ ID NO: 160243 - DNA, 263 bp, Homo sapiens
gtcagcagtatcatggcaaggttaggctgcaggatgccaaaaccggaatcctcatacctacccccgaaccatccttccccaccaagtcccaagctgcatcagtgcaggtgccatgaaggatggggaaggctggccccagggagctcgtcacgtggcaaatagctgcgagaggagaaggggctgcattgtggtagttcatctcaaggacctcgaacaccttaaccccacccatggggaaactggactcacgggggctggctctc

SEQ ID NO: 160244 - DNA, 277 bp, Homo sapiens
cttgcttgaatataggaggcagacgttgcagtgagccgaggtcacaccattcactccagcctgggcaacaagagcgaaactccgtttcaaaaaaaaaaaaatgacttggacttgtggtgaggggaggtcatctgtagactcctggacctgtttttgccttacttattctctaaagactgaaatatttcctaaaatgtatgggcactgtttaccagaaagtaccttagttaaaacataaaatcatttatgccttataaagctatattttttcaattgc

SEQ ID NO: 160245 - DNA, 623 bp, Homo sapiens
ataaattaaaaattaaaaattgatggtggaagaaagagctgatgcctactgtacaacagtaaagaggtagtagcattgttgaacatcccaaacaccgtatcttacattaagacaatataataaatgtgaaaatactttgcagaattgcccaaattaaaaactttttttatatttttatcattactttttaaagaattctgtaatttcagtcgtatttcaccttctacccaagggttgtttaatggaaaagctttttagggggaaaggcttttttttttctattttaattgttgttaataatttatagttttattacattccaatcagcgttgttcttgtaatatttcagcttatggaacttactgatgatgtcttatgacccaatattgattttttatgaattttccatgtgtacttgagaagaatgtatatgttttattattggctgtaaagttagagatatatatatatatttcccacaatagactaagagctctatgggatcagcaagatggatttcatcaatcttggtatttctagaaccatgcttagtacttagcttataagaaatgctcaaaaatttatagatggtatattagcatttaatcttggactttctagag

SEQ ID NO: 160246 - DNA, 313 bp, Homo sapiens
gcctccctgcaggggctacttcattaccaataaatgtttactaaatgcccaccatatgcaccaaatggtagacgattggaatacaaaagcagaagggagcaggattctcgtcctcaacaggcaaggatctgctatagactcacaccatccttcaagtctggccaccctccccatgacactcccttctatgttgcctctgggttatcttgtctctaattaaacactttggcaaagtgggatctcgttacctggggaagcagcccttttcccctgaatcagttcctttccttcagttagctgaggtacttactgg

SEQ ID NO: 160247 - DNA, 396 bp, Homo sapiens
attatagatctttaagctttcaattataagaactttaattttatatatgtttagagatacagctttcattttcttaaggtgttctggcatcaaaatgtattattttattctaataaatttctggcttgaacattctgacacttaaattatagcatgagttttttctacaaattgatatataaaatttttcatttgtgaagttttaaaaactttcatttcagtatcactttaagttttctctattctctctattatgctcctagcatcccacttacagcgccttcccaatgttctgcttctaacctttcacccctcaccacgaagttctgaatatgcatctctactgaggaagagatagcactcccgcaatgtgtcagaccctgtgctaaaaaagag

SEQ ID NO: 160248 - DNA, 199 bp, Homo sapiens
aatacatgttacctgggttacttcaatagtttaactggtctctgcttccattttccccacatctttactttctacacaggagccgggatgattcttccaaaacttatgatagactgtgtcccttcctaacacagacattcctactactaacactttttgcttcaatacatcacagtcatcaccaaggaatgacccaagt

SEQ ID NO: 160249 - DNA, 373 bp, Homo sapiens
gcacatttctaaaacattgccagaatctttaaagcgaggaaggagaccttttcttcaactccaagaaaaatgcgtctcatttatccccttcacgtctttctcctgagccatttctgccaatcctccaaatatgtatttacatacatgtcttcaaacacgatccacttgcccaatgtactttaatggctacaataaagaattaacactgtggatagagctaaggcattttcagtgcagttaaaaaaagaacactgtggtttggttctgctgaggcgatattgctcaacagttaatgtaatcatattacaagtgcttgtattaaaatcatatgcaagacaaaaatcggtctgaatggcagcaattaacgaaagac

SEQ ID NO: 160250 - DNA, 230 bp, Homo sapiens
ctttttcatttaaccatttatcttggagatcttttaattcaatacatagaaagtttccattcaaagtggcccccattcaaagtgggtcaggaaagtctgaagtccaacaaatgagagcagtttatcagcactgattataggggagtagtgggctcatgccagctgtgagaatagctgcctgtttccacaatgacatggcttttactcctcagaaactctgtctcaacccc

SEQ ID NO: 160251 - DNA, 163 bp, Homo sapiens
ccctgcactccctggctcctccccaggctcagcccagcaccggaaggatcacaggacagggcctgggggctgcaaaccctccaccgacgggagtggacacctacagtgtgcctgacagacgtgagctgtgcctcactggtccgtacctgtccctctccctgcc

SEQ ID NO: 160252 - DNA, 328 bp, Homo sapiens
aactagagaaggtaagagtaggaaaaaaggaatacagttcattccacataaatgcaacaccactggggtcccccccaacccatcagtatcagggaagccttactttgagagttttatgtatttctgtatttttgccagttgccaagagttgaataaaagttttcctggttcttaagcactgagttacaatggaattccaacagaattacacacgacatcccacttgaatgcccagcagggactttaaggtcattgtaataatgaatggccaagaatcaataggagttgagccttagcagccttcctgtgctgcagctgggcagaacag

SEQ ID NO: 160253 - DNA, 193 bp, Homo sapiens
accttccttcttttctcccacttttatctgcgttttccaccctaattgtgactcctgcaattctcccatagaatattcatttgctctttcccctttgtctaaactctgtgtggcagagtcatctctggaaaagtctgtacgtcacggggcataattgggtcacccaggccacctcccttgatcggggcccctg

SEQ ID NO: 160254 - DNA, 208 bp, Homo sapiens
tcctacatgtatgaaaaaaataataggcttacctacactaaaggctttaatagatatatacatgctgtttgctcaagtaaattaacgtagctataatcctcttactagcatgaatgactctctaaaataagtaactcacccccatccaactaaaaattcaccttcataagaattaagacatcccactgggtacctctgggaaaatgtt

SEQ ID NO: 160255 - DNA, 569 bp, Homo sapiens
ggcatgcacagtttttctctcctgatgtatcatgtgctgtgagtgatcttcctggaactgagggatggccatggagggagtgctctgtagctttgaaacctaccagtgggccttagttacagacatggccccaaaggaatcatagcaagcttggctcacagacaagcacaaggaaagcaggtaaagaggaaccccaggagacactgcagagctgactccagagaactgtggggtctgctgggcacctccctcccctcttcttcacaacagagcattgaagttatgtttttaacacatttttgcaacgtcaatagaaacaaactgtcttcttgctcctagaatatagagaagtggtagtgggatattagagttccactctttaagtgtgtattcccaactgatggaaaataacacccaaaccaaaacaaacaaacaagtaaacaaaaacccagtccaaccactgggggcctgcagaatatctcaggctagccgaagagaatgtgataaaagtaggttcataccttaggttccaagtattaatctcaaccagcctctctctctctctctct

SEQ ID NO: 160256 - DNA, 117 bp, Homo sapiens
ccatccatcatctggccttcatccagattcaatggtctataattaaagaatcacaaagatcagaattgttatcaaatgttgggcaaaacagctgtcaaaggagggaccgcccagaca

SEQ ID NO: 160257 - DNA, 617 bp, Homo sapiens
atgtcctaaccccagggactgtgaatgtgactttatctggaaatagggtctttacaaatgatcaacttaagatgaggtcattcgaaaaggctctaacccaatataactagtgttataaaaaggggacatttgaacacagacagacatatacagatgtgaaggcggtgagagaacatcatttacaagccaaggaacatctgaggcaaccagaaactagaagagatgcatggaacaggttctccctcacagccttcacaaggaatcaactctgctgacaacttgatttcagacttctcgcctccagaactgtaagacaataaatatctgttgtttaagccacccagtttgtggtacttcgttattgttattactatgagacagggtctcactatgttgcccagctggtcaaaaaaaatggcatttatcctgtcataaattatatgtttttgctgtcgtttgctttgttttgtttgagacagagtcttgcgctgtcgcccaggatggagtgcagtggcgcaatctcagctcactggaacctccgcctcccgggttaaagcgattctcctgcctcagccttccaagtagctgggattacaggcgcatgccaccacgcccag

SEQ ID NO: 160258 - DNA, 449 bp, Homo sapiens
ttcattaaaaaaatgggggtgggggcaagggtcctgagaactcagagatgagcctgtttacacaccagtcccagaaaagcctacagaaaacctggggaacaccacactgaccactgagaccataaaagccccagtaaagtccacagaaaacccagaaaaaacagcagcagtcacaaagactataaaaccttcagtcaaggtcacaggagacaaatctctcactactacctcttctcatctaaataaaactgaagttactcatcaggtgcccactggttctttcaccctcattacatctagaacgaagctgagttctatcacatcagaagccacaggaaacgagagccatccatacctcaataaagatggctcacagaaaggtatccacgctggacagatgggagagaatgattcattccctgcatgggccatagttattgtggtcctgg

SEQ ID NO: 160259 - DNA, 663 bp, Homo sapiens
ggaccacatcacccaatgacaagatcacctcatctgcagcagagtctacagaacatagagatagggctacatcagccaatgtgatcacaccagccccagcagagcctataaaacatgcaaaaaggaccacattggcccatgagaagatgacacaagtcacagaaaagtccacagaacacccagaaaagaccacgtcaaccacagagaaaaccacaagaaccccagaaaagcctacgctatactcagagaagaccatatgcaccaaagggaaaaacacaccagtcccagaaaagcctacagaaaacctggggaacaccacactgaccactgagaccataaaagccccagtaaagtccacagaaaacccagaaaaaacagcagcagtcacaaagactataaaaccttcagtcaaggtcacaggagacaaatctctcactactacctcttctcatctaaataaaactgaagttactcatcaggtgcccactggttctttcaccctcattacatctagaacgaagctgagttctatcacatcagaagccacaggaaacgagagccatccatacctcaataaagatggctcacagaaaggtatccacgctggacagatgggagagaatgattcattccctgcatgggccatagttattgtggtcctgg

SEQ ID NO: 160260 - DNA, 237 bp, Homo sapiens
acagcaggccccaccccggggtcactgccaataggggccacggggcagactgctgctcagaaacatgatggaaatcagcagggcctgggtggaagccacagccagccccgccatgccccacgtggccaggcccacatcggacagggtgcctcccagctgccacccaggggctctgtcccacgagccccaaacgccatcccctctaagggaagaccctggcaggcctctgggtcacag

SEQ ID NO: 160261 - DNA, 228 bp, Homo sapiens
atgagtaaaggatgagcaccttccaactgtctcccagtaaagacttaagggggcaggaaacaaaactgcaacatagttgctctcaacctccccttcaggacttctcatacttaacacacaggcctctctgcttagtcatcaggcttcccagagataatctctggccatccaagttcatcacctcaaccagaacacactcctcttttgaatattccttctccctccagg

SEQ ID NO: 160262 - DNA, 228 bp, Homo sapiens
tggccctgtctatgcaaaccattcccaacatcacacaagccagaaactagggagttatcccagactccaactctttctgccccaccaaccaagtcactccatccattacctgattacatcaaagagttcacagcaatctttgacccaatcacctcgttctcaatatctactgtcagaaaatcattcaaaatatagaaaaggttataggtacaaaaaggctcatcacag

SEQ ID NO: 160263 - DNA, 254 bp, Homo sapiens
gtctggttgtgaggatgacggaaccttgcccgaggaaatgggcaatgaacaggagcctgtttgtttctccttccagctcctgacctgtctagctcctgaccctctcagtgtcattcttgctcacccctggccctgctccctggatatgcagacaggatgggcttcttccctttagaccttcactttgctcttttggactcctcttctggccttgccttcccctggtgtcatctgctggctccctgcctgatact

SEQ ID NO: 160264 - DNA, 279 bp, Homo sapiens
ctccttgacctgacccctgctggtcccttcagtcctacctctacttagtctaccttgcacatacatctagtcacattcaactgcttccagcttctcacacacaccaggccgtttcacatgtttgtgtctttgttcctcttggttgtgctgcctgtaatacattttccatctttattcatttggacacaatttattttctgaactcagtttagatgtctcctcctccaaaaagccttccctagatgcccaggctgggtctagtgatcctcccctctgcac

SEQ ID NO: 160265 - DNA, 379 bp, Homo sapiens
aggctgatgcccatggtctctgctctagggctggacccatggaaaatgtaaccagaacactccagcccacctgggatcattaattagcctgcatgcactacccaaatctgtctactttcactttctaggtccctgctttttccatttcttactgcttatcagggtctccaccagatgtgcattaaagaagtaaaaggaaaataaatcttttctccttgtaagcagttatgagtaacgttttagtcacttgagagtaaaacttttgactaatggggagactgttatgagggaaatgatcccttctgttgttaacctagctggaaccacggaaagtgatcaggaatgccggtgatttacaaggaggatgaaggggtgggga

SEQ ID NO: 160266 - DNA, 367 bp, Homo sapiens
actcccatgcttactgcaacattcttcacaatagccaagatatgaaatcaagttaagtgcccatcggtggatgaatggataaagaaaatgtggtaaacacacacagtggaatattagccagctgttaaaaagtgaaatcctgtcatttgcagcaacatgaataaaccggaggccatcatactaactgaaataagccaggcacttagagacaaatatcacatgttctcactcctatgtaggagctaaaaaaagtagatgacaagaagatagagagtagataggtgattaggggagtagggaggaagatgttgattggaaggataaaaatccagttagatagaaggaataagctctagtgtttggtagt

SEQ ID NO: 160267 - DNA, 367 bp, Homo sapiens
caataagcatctcccctctagccttgagagacatccttgagggcatctttttatcctactgcctaatagattaccaggcattaaaaaaaaccacttatctgtaaataaatacccagaaacaaaaagatgcagatgcaggagcaattgtcctttcttgccccatggctcccagagctgccagggcttcctaacaatactactccctcagttatcaccctattcctccaggggctcaaaatgtattgggccacccctctccttccctgccagctctgttagaaaccaactaacccaaaccctctgagtcaatcatcaaatcagtagaagccaactttctgtaaagggcctgtgagtttctaatcaggaa

SEQ ID NO: 160268 - DNA, 490 bp, Homo sapiens
tagaaattaataagatccttcctcctttgaatatgcaaaataagattttatggcatttcttatactcttccttataatatataatatcttcctactattgagagggaagggattacattttatttattttgtaatctactgaagtccttagcaaaatttaatcattcattaatttatttattcatcaagtaatattttttgatcacctactaaatgtcagacactacaaggaatgaataaataagtcaatattcctgaagaatttcagagaaaccagatgaatagagttctgaaagatgaacaggatgtgtccaaaataaaaagtgagatgtagattatgaggttgggcagtgtaaacgcaagaaaaaaatatactaaagcctgatagctcatgagggtgtttggggacttccgtcagtctggtatgctgggatcagtggttcatagtcaggaatgctcattaaaatcattcacaaaattttttcaaaat

SEQ ID NO: 160269 - DNA, 1226 bp, Homo sapiens
tccgtgtcacttgttagtgatgggcattaggagcttcatatgttgcacaccttgtatcactcttccgaccctgagtcaggtagagctgtctgctcgaggtcgaatccagtgatgggtgactaagctctgctcggttaatgtaaacagacaagtgttgatttctgtcatgtggaacggtgtttcgacagttaagtctagcacccagtagtctccttattggtagacgattctaatttcattggattcaaaaatctctgactcaagggtctttccttagtgcgttttaatgggtgcatggctgagggaaaatccaagtcattgttaaactctaggtaaaagacaagagtatgggataccctcctaaccataccggtagttgtcagttttatttaaagtgggttccacttggccaggattggtggctcacgcctgtaatcccagccctttgggaggccaaggcaggcagatcacttgaggtcaggagtttgagaccagccgggccaaaaatggtgaaatcaggtctatactaaaaataaaaaaattaggctgaacgtagtggctcatgcctgtaatcccaacactttgaaggccgaggtgggtgaatcacttgaggtcaggagtttgaggccagcctggccaacatggtgaaacccccctctttactaaaaatacaaaaattagctgagtgttttggtggatgcctataatcccagctacttgggagactgaggcaggagaattgcttgaacctgggaggcagaggttgcagtgagccgagattgcgccactgcactccagcctgggcgacagagcaagactccgtctcaaaaaaaaaaaagtaagttccaaatgatcatgttttgtggcactgtcttcgtaaagtggccgctggtgtgatggaaagcattgctaaactcaagtgagacaactgctgttttgctttggattttccctgtgaaaagagaagccactgcctgttcgtcttgttagaaagacaagactttgaatgaagttccagactttgaatgaagttccagactttgaatgaagctggttgttgcccagagtagaagattcaggcacctacagcaactcacagcaactcctaactcttaggagggctccctcctattggccgtgaagctgcaaaccagcctctctcttttccctggatcttccttgcccctagttctgagccccagcccagaggcaggcctcatggctaa

SEQ ID NO: 160270 - DNA, 164 bp, Homo sapiens
atgtttccttttgaatatgagtgggaatcacctttaaaactatataacatttgcatcttctcaaaagccccaggtcctactaagattgacttagggctacatatcaggtctcattttcaaggaggaaacacagggaagcctcaagatgtgcagaagagagggat

SEQ ID NO: 160271 - DNA, 374 bp, Homo sapiens
ggaccactttcattgtgtggactgagaagagggagcaggacttgtgcagggttatacaacctgtagcagtgtcagggcctcaaactccaggccagtttccttcttgctgcactactccaagacagcgcaagagaaacggaccatccaccaaacactgcactgaggggtcctgggcttctcctgaggctctcttgtgcacccctccatccatccatccctccatccttccatctctccctccatttctcgatccctccatctcaccatttctctattcattcatccatccatccatccatctatccattcacctctccatccgtccatccttccttctcatttctccattcacctatccatctctccatctgtca

SEQ ID NO: 160272 - DNA, 601 bp, Homo sapiens
tggctatatagtagaggagttcaacaaatacttgtgagaaagaaggaaaagaggaaggaaggaaaatcccaaagaaagaaaggcatattaaacagcacagaaaaaagggaaagaagtgacaggttccaacttaagtgcctacagcaggccaaacaccaggctaagaacttacatccttttcatcttttaatcctcacaacaaggctctatgggaggtattatgatcaccattttatagaagaggaaactaagactcaaaggggttaagtaattagtaatgtcatacctagtaaatgttaaacaactgctcatgcaaccttctactctctttttccttctgaggttggttcccttcatttgggcctaattcctggcaaaagatatgtgaaactagttcctgttgctcactgagatcaaaattatttccacaaaaatcagattctatcatgaaaaagtggaaaaagatggaacaaacagtattcaggaaaagatgctctcaaacaattccagtatatttctatataaatattctagatagtgatgacagctggaagaaaatgtaaagaaatacagacatcacaacatacagtgtgtgactctt

SEQ ID NO: 160273 - DNA, 357 bp, Homo sapiens
tctgtggagactgctgaaggacaacacccttacttcttagggcctttggtttgccagaattgttctctgagccattgccttggattttttcctgacttcttaacaaaggattttataggtgggaccttcaacactctggaaattgccttagctacattcagccatctccttaggtacattttccatctcccacattgtagcaggcaatggcgttgctaaactttccatcaggaaataacaaagatctccttttccagtttccagtaacattttcctctctacaccatcatccacagtctcctgaaaggccctccaggttctagcttttccagggctcttcaggggttttcgaactct

SEQ ID NO: 160274 - DNA, 167 bp, Homo sapiens
acttggcatatagtagatgctctgtaaacatgttattgtcattcgttatttgttaactcaactgaaaagtgctgtgggacttccatttaaacatactgcactcaatatataaatttccttcagttccttcctaaaaccccattaaattaacagcaaatagattttca

SEQ ID NO: 160275 - DNA, 186 bp, Homo sapiens
cggagaggaactctagttcttgaagatgagccatattcttgaagagaagtgcgtgccctgtcgtggtcccccaggtgccctgtctctgaggagtgaccagggtcagtgctggcaccggctctgtcactgcacactggtcgcacctttcttctcttctgcttttcgtgtagctcagtggggttccca

SEQ ID NO: 160276 - DNA, 516 bp, Homo sapiens
atctgaagctaatacccatgttcttctggcaattctttatactggcaatttggaaaatgccagtgttttatcgctacctattcttgtattatgacatgaattaatacatatctgcctcactattcctgtgggcaaaaaaagactgtgaattatgtgccagagagagattttacaaaattaaatgaggcaaagtacttttcctctgtatactcattagaaatatgctgagtagttcctttcagttcctttcactttccgataaaatataatcagttcagccatataacagatatcttttaaacttttaatgtcctctgttagaatgaatatgatatttgggaccaattcacattttggaataatgtacatactaagcataagtgaagaatttaaacattaacttgatttaggactggactcttaagaggttttaaaaagttgaaaaacggaattccaacaaatttaaatggcttgtttagggtttccacaggcaatacgggtgggtgcaatggaaag

SEQ ID NO: 160277 - DNA, 429 bp, Homo sapiens
caagaaggtttgcgtcttataattttccccaccatcctgactgaactcccccaatggtaatacataaagttcgtgtacaagtttttgtgtggatgtgttttcagatctctttgatgcacacctaggaatggtggaattgctgggtcatgtggtatctgactgcttagcctgtgggggaactgccagattgttataccactttacatttctactagcagaggatgagtttgtcagtgtttccacgtgcttgcagttattttctgtttttttgttttttgtttttttttttgaggtggagtattgctctgccacccaggctggagtgcagtagcacaatctcgactcactgcaacctccacctcccaggttcaagtgattctcctgtctcagcctccctagtagcgggattacaggtgcatgctacccctc

SEQ ID NO: 160278 - DNA, 373 bp, Homo sapiens
cctgatttagagatcctataaaaagatcagaaaacaaaacatctaaagataaaatgagatttacaccccttataatcaggatagtccagttccccagaattggaaataaatacagaatgcatcccagctgacattctcaactactggcggggaagagacttacagggacgtgaatcctgtttctagatgtcaaaggatatgtttaataattaaataccagaagtgtacaaaaagagaaatgcagcatgtacctgtcactaaatctaaggccagtcattttctcaggaaaaacaaattgagcaaggggaaaggtacaaattactcttaaaatgtctttaaagcctaaaagtcagtcacagaagtagacttccaa

SEQ ID NO: 160279 - DNA, 401 bp, Homo sapiens
tcctcctgcctcagcctccccagaagctgagactataggcacatgccaccattcccagctaatttttttcatttttttttttagtagagatggggtcttgctatgttgcccaggctggtcttaaactcctgagctcaaacgatcctcctgcctcagcctccaaaagtgctgggattctaggcatgagttactcactgtgctgcccagcccaattttttaatacatctcggtatctagattataaggggcagtgtttcttttctttttttttatttgagacggagtttcgctcttgttgcctggactggagtgcagtggcacaatctcggctcaccacaatctctgcctctcgggttcaagcgattcttctgcctcagcctcccaagtagctgggattacag

SEQ ID NO: 160280 - DNA, 469 bp, Homo sapiens
atgtgaaaaaatgaatgggtcagatttaaggcactggtttgccatgaaagctgtaacccaatgttggtgtcgtggcctccctctccgagagtggtaactctgaaggctaagctcttccacatgcaggcctttcccttgggtaagcagggtcgcgctcacactgtgtctgaagtttcctacccatttgtttcgttatcagacactcaagggattgtctctgaggacaagtgactttccccgggcagcgtggaagcacagccctgctgacagttggtcccagtgttagagactcagcgggctttggggcctttcacgttagagtttgaatatcttgaaacgccactttcagagtcactgagctgcacacaaagagattacaaccaggccccaatctcctccaaacccccaaaatggggcacccagagtaatacatggcttctgattttcacaaatttcagggtcccccagt

SEQ ID NO: 160281 - DNA, 556 bp, Homo sapiens
cctattgccatattgtttatctgtatatcataattagttttattttttagagacaagctcttgttctgtcacccaggctggaatgcagtcacatggtcatagttcactgcaccctcaaactcctagactcaagagatcttcctgcctcagcctcccaagtaggtaggactacaggcacgtgccaccacactcagctcactttttaatattttgtagagaagggatcttcaccagtctggcctcaaactccgtaattatccttttgaattgtttgggtatgttatgaatagtgtaactatgaaattacagtacatgtatttgtggaaaatatatgtatgcatttctgttgagtatatacctagttgtggaattgctggatatgaatatgtttactttcatcagatactgccagttttccaaagtggttataccaatttatactcctactagcagcgtataacagaaccagttgctctgtatctccttcatcaacacttagttttggctgtctttttcatgttagccattgtgggtgtgtgtgtgtgtgcgtgtgtgt

SEQ ID NO: 160282 - DNA, 342 bp, Homo sapiens
tttaataagcctgttttttatagatacaaatttgccagtataccaatttattttgtcagtttgctttagttagaacctctgaaacaatgttgaataatgatcccgggctgtttctgatatgcgtggaaatccgcatgtgagagttgagcggtgagagtttcggcaagtggcttttaaaatgttggggtttcctttagtttgtcttgcggctgctgggactcaccggtagttgccagtcctgcctgagttgggcgccagggggcagcagtcacacagaatgaaacgtgggctgtgccccctggaaactggctgaattttgtcaaatgcctttacaccttctat

SEQ ID NO: 160283 - DNA, 195 bp, Homo sapiens
aaggggctgaaagtgctttcacgtgtctctcattcatacttacaaaatgcctgtggtataggtgggtattattatttccctcttacagataagtaaatagatttttttgcaagcataacagcaagggcccacttcaattcaattttgtaagtaaagctttaatttaaatttaccatactgttgaagtaccagtat

SEQ ID NO: 160284 - DNA, 482 bp, Homo sapiens
taggtaatatgttcatgtctatagggtgtaatgttaatgttcaataaaaattaatatcaaagtctgtcatagattttatgttttggggcctccaggtaaatggtttgtatcatcattgggaatttatggaagttgatttaagtatacagtagttagcactctattaaatactgaagtcatgcactgtgtcaccttgatcaatgagcaagtttttttttcttttctgattctggaatttcagcactttcagctttgaaggttgccttgggtttgtttttgaattaaaagtgtcacaggagaaaggctgattgttacattcatgaccaatcagaagggtctgtaggactcaaaatgtttggtacattccttaaattagaagatatgcttctggacttttcccagggaaagcaggtccatgtaataatttaccaaaaggaagttgggaaaatgaaacatcaccttttgtgagaaagaggatgggg

SEQ ID NO: 160285 - DNA, 740 bp, Homo sapiens
gcatatgccaccatgcccagctagtttttgtatttttagtagagacagggtttcaccatgttggccaggcttgtctcgaactcctgacctcaagtgatccactcgccttggcctcccaaagtgctggattataggcatgagccaccgtgcccggcccttcttcacgtttgtatctaactgtcactaagattctgtttctggcatctatcttagacctgttgatttctctccttccatgactcctggcccactctggccccatgtaatccattcttcatgagaggtattttaaaaacacaaatctgatcatgccactctccagcctaaaactcttcagaggtttcctattgcttttcggataaagaccaaaatcttcaacatggcctttgcccacttgtccagcctattctcctgtcactcaaatgtgccagcctccctctgcctgctgctccctctgcttgcatgtcaccccattaccccatgtcctctgcttgcctggctaacttgtgggagatagcatagtatagtgaccagaagcacaaagtcaaatcagactgcttggggtcaggtttgaattcttttttctttcttttttttttttgagatgagatgaggtctcactctgttatccaggctggagtgcaatggtgtgatcttggctcactgcaacctctgcctcccaggctcaagtgatcctcccacctcagctttccaagtagctgggattacagacatgtgcc

SEQ ID NO: 160286 - DNA, 362 bp, Homo sapiens
acactagagaatacccctgcttgtctgactctgcttgtcctgcctctgcttgtcctccctctgcctgctgctccctctgcttgcatgtcaccccattaccccatgtcctctgcttgcctggctaacttgtgggagatagcatagtatagtgaccagaagcacaaagtcaaatcagactgcttggggtcaggtttgaattcttttttctttcttttttttttttgagatgagatgaggtctcactctgttatccaggctggagtgcaatggtgtgatcttggctcactgcaacctctgcctcccaggctcaagtgatcctcccacctcagctttccaagtagctgggattacagacatgtgcc

SEQ ID NO: 160287 - DNA, 551 bp, Homo sapiens
tggcagacatgacactcattttcttcatatttactactaagggtagaaaatgtataatacagaatttgtgcaccacattattacctaattttggtctaaatgtttgtacccactttaaatcaaacctttctaatgttaatgaacttgtaggatatcccataaattcaacctattttacgttttcttcagccagtatctgagaagaaatcagtaactgaaagaaaaaagtacaatgtacaagatacttacaagtacacttgtaagtacaagaggtaagtacttacaagcacaaggtgtaagtacatacttacaatgtacaatattgttaaggatctacaggaggaaaagaaaaacttcttatcttctctacagatgactactgcaacatgtagctacaagctataaatttgtaaaacctccaagctataaatcagttaggtcagaaatgagactgggggaggaagcagttagaggacgacagatgttcaagcaaatataaccaaatctgtacttcacctttaagatacctacaagatgccaaactgaaaaac

SEQ ID NO: 160288 - DNA, 155 bp, Homo sapiens
gctctggctcctcgtttgtcattggtgctcaggttgggtaaacccaccccagtttgctcgggatgataataatagtatttactccccagggaaggatgaattgagctgctagaagaagagtgcttgacagagggtcagcactcagtaaatgttgg

SEQ ID NO: 160289 - DNA, 322 bp, Homo sapiens
cccatgtctcggcttcctcatgtgtacgatgggggtgtcaggaaccctggggaattgctcccaggcttgggtgagatgcactcacagcgctgctgcacagggacgtgaaataactggcagtgtggctggtcaatgttattcatccccagttggatactgtcaaacttgttttcttcattttgttttcacagtattcaatcttggattttatataaaggaaatcctattcttttatgtcaatgtatggcatttgacaatttgactacatttgacaatgcccaggcctgcctttccaacagccgctgaggtctctaattatgtc

SEQ ID NO: 160290 - DNA, 116 bp, Homo sapiens
aatctcctgcatcttttcccccttcaaatttatctgttgaagaaaccaagctgttcacgctgtggagtgccctagtcttgattttgctgatttcatctgcgttgcagtttaacagg

SEQ ID NO: 160291 - DNA, 325 bp, Homo sapiens
cactgagtccattttgctgacaaaatcactagttttctttagcagggaacagtaccatctattaccttaggtgaaaacctggaagaacttcattgacaatgctaaaaggtgtgtataagggagtgacatgaccactttctggcttcatatgcaaggtcaatgaagctccaattccctaacagtgctgccaggtgcaagcacacaattgttcctcagcactaccattatggtttactgcttatggtttccatttcttggtttggcactttctatgtaacctggatttctcaaaacacagaaatctaccttttgctatatttcctca

SEQ ID NO: 160292 - DNA, 586 bp, Homo sapiens
gccacgtgtagtgcagacatccacacatcctcactagtggctattcattaagaaatacctcccactacagacgtcactgtttaaatttacttttcacagggatttatccctaaatgttccaaggagcattactcaggcaatttaggttgaaatacagtgagcttatgtcttggaaatatagattacatctggaacatagagacctaaaaattcgcttcccttcagactgaggctggggcacaataggggaagaggcatcagaaggggcctggaggatagagaaggggagctggtcaatgttttactaactaagccaactcagttaaagttatagtttaatggaaaagccaacatgatcataaaacaaaacaaactgaaaacataaaacaggtcatccggagaacatcagtaaataccataaacatcctgttcctaattggcaatagatgtcttgatctggcccatctgagcactggcaaatcactaagaaacaatctgatacaattagaattataataagcagaactccatgtaaataaaatgaaaaaaacaaaataaaacaaaacttccaaacaaaattaaaacc

SEQ ID NO: 160293 - DNA, 332 bp, Homo sapiens
ataatacatatatagtctaatattctaataatatagtaaaacggatgaggtttagaacaaattaggagacacattctgtgtcagatgccaactgcatctgcaattttgggcaaggtaattaactacctggagtttctgctaaattgaggttggcaggggcactgggttgattaatttgatcttgaaagtgccatgaggtcatggactatcttcttatctttattagggagctatttcttacatttataagactcctttactaagttaaaggtgttttccttcctctaccatatacaatttttaaaaactgttcccagctgggcgaggtggcg

SEQ ID NO: 160294 - DNA, 342 bp, Homo sapiens
agggacatcctgtgacctcccctcagacagacttgccatgtcttccatctgttccattccggcctggggaggttagctgctgtcaggacgtggtgcggcccacagtgacttcgtctctcttgttccttcagaagcacgcaggccgtggctccgcgccaggttggagcctttcattcagggtgtgtgcctgccgagcccggaaacagtgcggtgaggggcagggcatcctggttttctgctgtgtcgcctggcactggtggacgtgggcgcgtcggtgccgccgtcctgtccctgtttggtgtctgcagctggagggcccagttaacggtgggtgtgtgcaga

SEQ ID NO: 160295 - DNA, 523 bp, Homo sapiens
tacaaataggccaggtgcggtggctcatccctgtaatcccagcactttgggaggccgaggcaggcagatcacgtgaggtcaggagtttgagatcagcctgaccaacatgatgaaaccctgtctctacgaaaagtacaaaaattagccaggcgtagtggcaggcgcctgtaatcccagctactctagaggctgaggaaggagtattgctcgaacccgggaggcagaggttgcagtgagccgagatcatgccactggactccagcctgcgacagagtgagactctgtctcaaaaaaaaagtacaaatatacagttagataaaataagttctcatgtttaatagcacaggaaggtgactacagttaccaacaatatattgtatatttcaaaacagctagagagatttgaaatgttcccgtcacaaagaaatgataaatgtttgaggtgatgtatattctaaataccctagtttgtatgtaatgaacacattgtacgcatgtatcaaactatcatatgtaccccaaa

SEQ ID NO: 160296 - DNA, 401 bp, Homo sapiens
tcatgtaaaagctggcaggaggatggtcttgggccttatgttttcacagggcactacttagcctgagtcagtgtgcctcggctagttagccgactgatgtctatgacctgtccccacacttccatcctttcacaattacaagcagcttacagggcctgccagctacacacagcaggcctccgggaacgacgcatcccaaatcaaatccttcctgttgctgcagcaaccccatagatgccaggctcttcctgcccaccctagccagaagggtgcgcccacattcctcctcatcctcctcccgctctcaccttcatgctctagcagtgtgccaccggctagagaatcgactggccaggtgcaaggcaggggcctgagctgggggtagacagcagtacccaaaa

SEQ ID NO: 160297 - DNA, 801 bp, Homo sapiens
ttctattttattggggtctgaagttattgtaacacttaaaatttaactcatgatgcagatggtgaggcaaaagtgtctctaaattcagacaaatgtagacctatttctactttttttcacacagtagtgcgctgtttcagagttaaacaaacaaaaaaatagcatactttaatggtctcttaattcattcacctgcagtgtctgaacaaggcagggcaggtgctgagtggggggcttcctcttacaagaggctgcatctcagtacacagtggtgcaagtcaagctgaccatagaaatatcaagttaggggagaacaggctggaagaaagattgagaaggaaggcaattgagataggacctccaaggattatgggaaactgttgttaaatggaacagaaaacatgaaaaaataatatgagtggaggctctggcaaggaaggctgtgtgactgcaacctcatatcaggattcctgacttttatgctacctgtgtttcttctagactgaagatttgaaaatatatccatgaacatttcaacatgaaacaaagaattatagttccttctctggagatgtccataaagaagtaattatgatatgtttaaaaccagaccgggtgtgggggctcacgcctgtaatcccagcactttgggaggccgaggccggcgcatcatctgaggtcaggagttcaagaccagcctggccaacatggtgaaaccccgtctctactaaaaaatacaaatattagccaggcgtggtggcaagcaccttaatcccagctacttgggaggcagaggcagga

SEQ ID NO: 160298 - DNA, 397 bp, Homo sapiens
ccacaattgcataaaccaattccctaaaataagtgtctttctctgtatgtagactcatcctcttggctgtttctctggagacccctgactaatatgcataggtatgactcctggcacagtgcgtgctacaaagaggagaaggcactacctgtgaatcagaccatctgtgagtatttgcaattgcccaaccatatcaatttctcactttcacttcctggtgagtcatattccgagcagctggctaggatcagaagaaacaaggcattcttttcatgctcagacagagccctgttgaacgtttaccttcctgaagaaggcagaaagaggaagggcctcctagtgacattctccagccttgaggaagaagaaaattctgatttaatgagcttgagtttga

SEQ ID NO: 160299 - DNA, 431 bp, Homo sapiens
tgtgttttctgtgtactatctcatcatgacaagcctgaagcaagtcattattggccccattttgcacaggctcaggcaatggtggaattatgtcaagcaggcaggaggcttggtgatttttgtttggattttctttggcttgggaaagacagatttgccttttgctagaaaagaaactccttcagtgagctatcatttcaaagttgatgtctcagaatgttgtggagatgcagccagttcacctgaaggtagtggtggtggttaaataaacatctctgtaagtctagctcttcctacagttgtgaaatctgagattttttggtttgtttgttttaatgtttattggtagaaatagatcatcaatgcatactttgtatttatataaactgcattctcttaaaggtttttgttttcattggaaatatttagcc

SEQ ID NO: 160300 - DNA, 590 bp, Homo sapiens
gccatccaggtccttttgtctcctctttccccttcatctacttgccttctgccatgtccctacgcattaacttcccctagggactaggaaggggagaaggggaaaggttagaaaatagaggtagtcattgttgcaacctatgcccagctctaagaaactccaaaagcaaagatgcaaaaagcaatttaaactgttggccaaaattaaatggggagttgggggggagtgtgaatagacgtacagttttctttcttgcactattcccaggctctactacaacatcaaccacagaaatgctccaaaaatggtaaacattggctgagaggagaagggacagctcagcaaacgctaaggctgacaactgcaattccatctctgccaggagacacttgtttattaaagtctctctctcagccttgctgtattcacacatggaacaggaggactcactccaactccattttcagagctaaagtgcagggcaatggaaaagactagagaaagctctggaaatggagaaccttaatgaaccaactgctgcaacagtggtcagttcctgcaagttatcactgattaaagggaaagcaagc

SEQ ID NO: 160301 - DNA, 370 bp, Homo sapiens
tgaggtgtcagtgcaggggagaggagaggccaatgctgcagggacaagtaggaaaggaggagaccccgcatgacacgtggggagcagcactggcctcggagccagagccttgggttccagccacgcctctgccaatggcagtgggtgttggagtctaacttctctaagattaggaggctgggctcaatgcctcttgcacagcgggtccctgcctgcccagtgttcttgtgtaggtgatacattcagttagcacttgggggtcttttacatttgctacctgcttcgcccatgtttgatatccaaaaagatttcaggttctttgagggtaaggaaagctgtcatattccttctgtatccttatggtaccaag

SEQ ID NO: 160302 - DNA, 102 bp, Homo sapiens
acaccagacacacacacacacacaccccacactacaacggggcaagcacatctaagcctaagacacagcaacttggaaggtgccgggtggaaaagggagtag

SEQ ID NO: 160303 - DNA, 460 bp, Homo sapiens
ttgacagctgctgcctcccagagccccaccctgaaaggctagggtctgaggttccacggttcaacatagcatctggcttttgacctccatggctaatgtagaaatcaattcctttcctacctgcaatcagaaaagtgttgtaacaacaaaagctaaagttaaaaacaaaacctgccaactgacaacaggcggaactatgtactgtactatcccaagagtctagaactgaaacagctatgtttaaaatttcagctatcaacataaatctcagacatgcagacacaatatgaaccattttggtccttcagttattttcgtatcttttgaaaattctaactgattaattttttagagatggggtcttgctctgtcactgaggctggagtgctgtgacacaatcatagctcaatgcagcctcgacctcctcctcctgcctcagctcccaagcagctgggactac

SEQ ID NO: 160304 - DNA, 352 bp, Homo sapiens
gttttgcattttacaaatgagaaattaagtccgggagatatttaagtgaccacccacagtcacacagctggtggagccaggctgtacacccccagactacccacccagtctcacattgtgccaccctcaccaccgggctgtgctccttcacgtctataaatgggcgtttcagcagcacccgcctcacaaggtcatggtaataactaaaacagacaatgcatgcaaaatacacaaggcagactaagggctcagcaagtgcaactcactgttcctgctgttactgcgattgctgtgtaagctggatatggggtctgatctggatcccacagggggcagaaacatggccttgcgc

SEQ ID NO: 160305 - DNA, 139 bp, Homo sapiens
tttgtggcagtctttcctcaccttcgattccctgcttccaacctgttcaggtgtcagaaagcagttcaccaagctaactagacctaggtgttaagtaaaagtcagtggtctcaagcaagggcccagaagtctcttctgt

SEQ ID NO: 160306 - DNA, 307 bp, Homo sapiens
gcggccgcctactactactaaattcgcggccgcgtccctagggaggaaaaaaaaatcctcctttcgatagtcccatcattcccaagaaggctgctttcttattgcaacatcagctccagttcatccatccctccccgtcctccctatccatcagcccctcgtgtttcccttccctctctccctagcacatgtcttgcagtcaagtatttctgcagcacttgctggtcaccacctattcctctccatccctggatgaatccgtccatctgctctctctcttcctgctcctatttcacagggtccgacc

SEQ ID NO: 160307 - DNA, 659 bp, Homo sapiens
ccgaatgattgtcataaggatcttgaatagtgattgtagcctgtgaagtttcttagtgctcaggggttcagttagaagctccagtttctgagtatcttttgaaatcctgagcacacttaaaataaaattgacattacctgttccttgtactcttatggtgatggaaaataagctgggcttgagtctcttttaagggatctagactttgtttttatctacttactataaggcgttcctaacaactgctcagaagatgaaatttgtccagaaggtcttgatagtttaatggttctcagtgattttccttttcttttttttttccttttttcttttttgtaatcacaaccttgtttgattaaaccctattcttactgagtttttcaaaagcgataataactatgttcagtttcagaagatcaaagacatattttatccaggcttctaaggaaactaagcacttgtaaatttcaatttaacacagattactcatgtcagtttaaagatatttgtttattttatataacacagtggttgccactgttagtagcagtagatgttctaattctggagaggtttttggaaggtttcaaatgatgaaacaaatcaacaaaattcttgttagactagtgtctgtagcatagagggaagtgtggggtgtt

SEQ ID NO: 160308 - DNA, 263 bp, Homo sapiens
ttcaaggagctcacggcctggggtaggcggggagtgaaaagcatcattcagtgttttgggttcagactctcactcagtccctctcttcccagtacatcctcttaccacggtgcccagttctccagtcctctcccaaaaagaaacttccagtcatctcctgggtgggagaggggagagccctaggatctgaggatctgaccactccagtgaccgctaaaccctgttttcagccgcaggctatagctctgcttcaaggagtgggc

SEQ ID NO: 160309 - DNA, 549 bp, Homo sapiens
cttccgagggtcccggggatgatcggcctgtataaagacaagatagccttagtttgatgttgaaaaatttcccaggttttttaattttatattgaagacattagccaacagagttcttttctgtagatatgtatcttcagtggaggaaaacccaaggccctgtgtagcttctgatgaaatataggggaaaaaatctagaaaactataactggaagaagttatgtttatgctacttctatattcctgaataaatggacagcaaggcatcttcaccactcagtgaggcccccatcataagatttgagaacttgtttggcctcacttctaaccttattttagaattgcactgagaaccttggacaatggttattctacaaccaacgtctccttccttctactttccattctgttatgtctgagtcttttttgttggtaattattgattagaatagtgatcaataatctctttagttcttggcgttactagtgattataaattcttgctggtaacattggcataaagaagaatgtggaaaagacaatgagtat

SEQ ID NO: 160310 - DNA, 635 bp, Homo sapiens
gagctggcccccggacgatcgccgaccgacctgcccgcgaccccatagcctgcccgcgcgccatgagatccccagacggctcctccgcgcccagcgatcctcggtcccggcctcgtgctgcatccggcatgcgctcggcagaggggcgcgggacccgacacgcggcggcggcggcatgaaagtgacctgatgtgcttcggacggacccgggtggtcgtgccgtgcggggacggccacatgaaagttttcagcctcatccagacaggcggtgacccgataccggacggccatcgccaaggatccaaactactggatacaggtgcatcgcttggaacatggcagcatggcaggcaatactagacccttgatgacattctttgtgatgtcgcagacgcataacgacagactcaggcgctgcatgtggtgaggagttgacacctcctgtcaacaaccacctgaataagcttggaagcagaatgcccagccctgctccagccttcagatgactgcaacctgagacagacagccgtggagatccaactaacacacacctcaagtcctggcccacagaaactatgagtcagtaaatgtctgttttttaaaccactaagttttgggataatgtgttatactgc

SEQ ID NO: 160311 - DNA, 318 bp, Homo sapiens
ctgaggatcccattacgcaggcgagacaagtcacgtgtccaatttgaggtctggaagaagctgcaccagtatgagaatagtgggtcagttttctccaggatccagaaagtatatcaggcagccttggggtgaggaaaggagcccggcttctccagcagccacacaggcctgcagtaggatggggctggggctggtttggggtggaggataagtgacagccaaggtttgtcagcatgcagaggggtggctgactcatggactaggggctgcggagcccagtggttgcccttagttcttggatcctgggagacttctgga

SEQ ID NO: 160312 - DNA, 117 bp, Homo sapiens
agggagggaaggaaggaagggaagacagaaagagagaaagaagaaagaaagaaagaaacagagggaaggagagagagaaagaaagagaaaggaagaaaaaagaaagaaagagaggga

SEQ ID NO: 160313 - DNA, 130 bp, Homo sapiens
aagtgcttaaactcctatatattatacttctaagtgctgaaaaaaactgcataaaatgacaacaaaagactagctttaggtggggtatttcaagtagcaataaacaactctgttaagtaaaaggatggag

SEQ ID NO: 160314 - DNA, 203 bp, Homo sapiens
gcaattagctgaagttataaaattacttctggatttgggaagattatacctgagcatggcaaaggattagaaataatagctagcagctgggtgcagtggctcacgcctgtaatcccagcaccttgggaggccaaggtgggcagatgagaaggtcaagagacatagaccattttggtcaacatggtgaaaccccatctctactt

SEQ ID NO: 160315 - DNA, 625 bp, Homo sapiens
atatgatgcagaaggaaataatgataaaacaaccaaattatgccctctagaagaagcctacaccttggcagaataatatttataacaaaatacccctaatatagagtggaaaataagacaaaattgtaaatggcaaggctattatattctaggaaaatctgggaagctctcagacaagagccaagtggacaaatagacagaatctggacatatggaaattgggagagaagagagagagcaagtatacttcactcagaatacactttcacccactcacactcatgactccaatcccaataataatttctattattttctaaagttacaaataatagcttctaggggccgggcatggttgctcacacctgtaatcccagcactttgggaagccaaagggagcagatcatctgaggtcaggagttcgagaccagcctagccaacatggcaaaaccccgtctctactaaaaatacaaaaattagccgggtgtggtggcacatgcctataatcccagctactatggaggctgaggcaggagaatcacttgaaccgggagacagaggttgcacgtgatgccaggagtgcgcacctacactccagcttcggctaaaagctgatccgcattca

SEQ ID NO: 160316 - DNA, 423 bp, Homo sapiens
tagatgcaaatagctttgaatgtaaaaacattacaacaataatataaagaaattgaagtgttactggatcctgacaaaaagtctctccttgactatactttagtcaggctcctcttaatactcttctcaactatatatcaacttttgggctgctttgtccacctttgcatcgcccagttttaacaaaaattctgctaaattggtttagccacaatcccccgcttatccctaatgtttcctcttaataatttttcatccaatgacttctactctttattttggctatgaagtctcactttttcttgttgtgttttgagttgagcccaatctctgtcccttactgcaaaaccccatagcagtagtccccatacttattgcaatagtcctgaataaaatctactttacattttaacaagcgtcatg

SEQ ID NO: 160317 - DNA, 444 bp, Homo sapiens
ttttggacatggtatttacctttcgcttccccagagcagacatggccagttcccttgaggtatttccagtgggtaagggaaagagaagtaatatttccgaaacagccactatgtcccaggcaatatatagttattttctttcattcattcagagctagacattagggatacaaatgggatagcttccatttatttattcaactattgagggccgagaactgtattaacaatatgtcatttcattaacaccactttcagcaagttagaaattacagaggaggaaacacacctagacagggtcagagcttggttgtgatcaccaggttagttagcaacaggactggaactagctctgtggattcccattctgctgcttttcagtgaggggaaagtgtagactaaggaaagctgaaatcatcctgggtaggatactgtagacggaga

SEQ ID NO: 160318 - DNA, 348 bp, Homo sapiens
tggtcagaattctcttggcgtcctctggagcccccctagggagctgtgtgggcaccctaggtcctgaggcccttgcctgttcactgccttacggcaagttgcaaggctggccctccttcctcttatggggcttgctgaagaatcagagcctccccaagcaccctggtttcacagctcgtatgtaccccaacagaggtttagttcatttcagcagtgcccagcttcaaggaaacaaaggggctctcctaggtaggtgtttatattagtctgttctcacattgctgtaaaaaataccggaaacccggtagtttataaagaaaacaggtttaattggctcacagttccaca

SEQ ID NO: 160319 - DNA, 223 bp, Homo sapiens
acctcccgggttcacgccattctcctgcctcagcctccggagtagctgagactacacgcattcaccaccacacccggctaatttttcgtatttttagtagagatgggctttcaccttgttagccaggatggtctcgatgtttttaaagaaaaaatatttacatttattatcaaattaatcttaaaatctaaaatacattaagatatgcttttggaaactgttt

SEQ ID NO: 160320 - DNA, 297 bp, Homo sapiens
ctttctacttttaacataggactatattctgatatggatatgaatgatggtatctgaagttatactagtcttctatgtagagagaaacttgactgagattttacaaaaataatgccccaagtttctacttgtggttaacttttattatataattacaccaggatgtaaggagacaggaaccagttccatcttcctctctgttgtatctctatcacctgtgtggtgtttgtcacatagtaagtgctcaaaaaatactgcttaatgaataaattttgaagaaacaagtgattttcctaa

SEQ ID NO: 160321 - DNA, 313 bp, Homo sapiens
agacgtggctgattagaggaccccggaataaccagcgggaaggttgtggtatttctcagtctgaccggtcatgactttggttagttttctatttagataagctaaagattttctaactcaacttcaatgatttattctactaacaaaatagtacagggataacaaagaatgaaatgtttcagaagagaaaatactggaaatcttatttagtccaattcttgtcactgtatagaaggaaaatgagccccagttggaagaaagacagcctggtcacccagacacctagattcctggtacaaccgcggtgtatccg

SEQ ID NO: 160322 - DNA, 1284 bp, Homo sapiens
gttagccctcattccatctttaagagacaggcattatgattattcccattttacatatgcataaaactgacattgtgagaagttaagaaacttttccaataacacaatgacttctaggagggtgaagaacggttcctagaggaacatgggaggactgactgacttcacacttttgagctaggtagccctgtctaacttctctccttctaggagacagtttggatttctctctcccttcagaaaatgggctgtaacagaaaatggagccccagggttgctgcaatatcttaaagcccttggagaagtggcagagattgctttagggttaatcggcttcttttaaaatacgtaaaatgtcctccaggttttctgcctagaaactggtcccttgcctcatagcagagtttccccctgatcattatattgatgatgaagaatgattcccaatggagatagcccttggtgaatgggcacaggaagggctttagacagttggtgagaaggatgtacatctttcaaagaggaagagggtggtccagatgggatggagcctcctctgtggcctcatcttctccatcattgctgaatgcatagattaagtatatcctgaaaaatgcataagaagcttcataaaaggaaatccttgtccatgaagcatgaatttgggaatctgttatttgaatccttggcattgagggcataaagatatgaaggtcactcatggttgtccaatagggaagtgatcatttattagtaatgtaatttattattcctcttgtcatctctttctatctctctactaagacagttatcctgaaattctccctggtggtctgagcacatttactgacttgaacaaggaccatcattggtcttttgtccagaatttgcatttgtaatagatagtttttccaactactggtagtcaagtgaaacaaatgttgattttggtttacataagaaatagttttaatctctttaccgcaataaattttgtacttaaatttctcttttgccattttttttttgcatcagaaaaaaaaatcaataaaagaccataagtcaaagtattattctctggttaaactaacacagtgtcagaatgagttgatctttctgcaaacccaaacattattgaactctaactgctgatttggaaaataacttgggtgtgtctttttgaaaataaaataccagtagttatttgttcatttttttaacatttcatgtaaggcagaaataatatcttggcaatgtgaatcagagcagtttccagcgactgca

SEQ ID NO: 160323 - DNA, 669 bp, Homo sapiens
gttagccctcattccatctttaagagacaggcattatgattattcccattttacatatgcataaaactgacattgtgagaagttaagaaacttttccaataacacaatgacttctaggagggtgaagaacggttcctagaggaacatgggaggactgactgacttcacacttttgagctaggtagccctgtctaacttctctccttctaggagacagtttggatttctctctcccttcagaaaatgggctgtaacagaaaatggagccccagggttgctgcaatatcttaaagcccttggagaagtggcagagattgctttagggttaatcggcttcttttaaaatacgtaaaatgtcctccaggttttctgcctagaaactggtcccttgcctcatagcagagtttccccctgatcattatattgatgatgaagaatgattcccaatggagatagcccttggtgaatgggcacaggaagggctttagacagttggtggtctgagcacatttactgacttgaacaaggaccatcattggtcttttgtccagaatttgcatttgtaatagatagtttttccaactactggtagtcaagtgaaacaaatgttgattttggtttacataagaaatagttttaatctctttaccgcaataaattttgtactta

SEQ ID NO: 160324 - DNA, 951 bp, Homo sapiens
gttagccctcattccatctttaagagacaggcattatgattattcccattttacatatgcataaaactgacattgtgagaagttaagaaacttttccaataacacaatgacttctaggagggtgaagaacggttcctagaggaacatgggaggactgactgacttcacacttttgagctaggtagccctgtctaacttctctccttctaggagacagtttggatttctctctcccttcagaaaatgggctgtaacagaaaatggagccccagggttgctgcaatatcttaaagcccttggagaagtggcagagattgctttagggttaatcggcttcttttaaaatacgtaaaatgtcctccaggttttctgcctagaaactggtcccttgcctcatagcagagtttccccctgatcattatattgatgatgaagaatgattcccaatggagatagcccttggtgaatgggcacaggaagggctttagacagttggtggtctgagcacatttactgacttgaacaaggaccatcattggtcttttgtccagaatttgcatttgtaatagatagtttttccaactactggtagtcaagtgaaacaaatgttgattttggtttacataagaaatagttttaatctctttaccgcaataaattttgtacttaaatttctcttttgccattttttttttgcatcagaaaaaaaaatcaataaaagaccataagtcaaagtattattctctggttaaactaacacagtgtcagaatgagttgatctttctgcaaacccaaacattattgaactctaactgctgatttggaaaataacttgggtgtgtctttttgaaaataaaataccagtagttatttgttcatttttttaacatttcatgtaaggcagaaataatatcttggcaatgtgaatcagagcagtttccagcgactgca

SEQ ID NO: 160325 - DNA, 1002 bp, Homo sapiens
gttagccctcattccatctttaagagacaggcattatgattattcccattttacatatgcataaaactgacattgtgagaagttaagaaacttttccaataacacaatgacttctaggagggtgaagaacggttcctagaggaacatgggaggactgactgacttcacacttttgagctaggtagccctgtctaacttctctccttctaggagacagtttggatttctctctcccttcagaaaatgggctgtaacagaaaatggagccccagggttgctgcaatatcttaaagcccttggagaagtggcagagattgctttagggttaatcggcttcttttaaaatacgtaaaatgtcctccaggttttctgcctagaaactggtcccttgcctcatagcagagtttccccctgatcattatattgatgatgaagaatgattcccaatggagatagcccttggtgaatgggcacaggaagggctttagacagttggtgagaaggatgtacatctttcaaagaggaagagggtggtccagatgggatggagcctcctctgtggcctcatcttctccatcattgctgaatgcatagattaagtatatcctgaaaaatgcataagaagcttcataaaaggaaatccttgtccatgaagcatgaatttgggaatctgttatttgaatccttggcattgagggcataaagatatgaaggtcactcatggttgtccaatagggaagtgatcatttattagtaatgtaatttattattcctcttgtcatctctttctatctctctactaagacagttatcctgaaattctccctggtggtctgagcacatttactgacttgaacaaggaccatcattggtcttttgtccagaatttgcatttgtaatagatagtttttccaactactggtagtcaagtgaaacaaatgttgattttggtttacataagaaatagttttaatctctttaccgcaataaattttgtactta

SEQ ID NO: 160326 - DNA, 490 bp, Homo sapiens
ttaatactttcactatgtttcatgtcttcgggaaagcaaaagaacaacgtactgtgccaaaagcactaacttacgaaaaaccaatttagaccaattctttacagcgttaagtatgggttgaaaaccaactttcctaatacttgtggtcagtgcctcaaggtcgttaggataaaaataaagcttccaagacacttcgcagccttccagcacttccagaaaggccaaataaaccagcattcaccttcccgctccatccaggccccgattctccgaccagagagggcgctgagtgcccgggcacggaggggcagcgccctggggcgcccggctctgcccagggcggggctcggcggggccgaagctccggacgccgcccacggggaccaccggcccttgggccgcccaggggcagctgcagcccaggggaggagctggaggagcccccggcggcaccagggcccgagccctgacggcggccgcccccggccga

SEQ ID NO: 160327 - DNA, 327 bp, Homo sapiens
  misc_feature (1)..(1): n is a, c, g, or t
naacttagtctcagctataagcaatacgctgcgtgttcccctctccttcaaatactctcttcactgtccgtatattgtatgttgttgctgagacaggtctcgccatgatgtttctatcactggaactttgaatgttttcatccgtaacattcttatccttccagatacgatcctttagaatcactgctgagtaaatccacatacatgacataattttctcctaaactcccagtttggagtttctgtcttcagactatatagcacctcctttttatggtgcatctacacacacaggagaccctcccctcacttgtagatttacatttc

SEQ ID NO: 160328 - DNA, 688 bp, Homo sapiens
tgcctctgagtatgagctgacagaatccattcttccaaatccattccggttattacctactgtcctattcactcacatttataggaagtgtttatttgttctaatattttcatttatttcaaagttctagatagagagaactctatgtctttctttgcctacctaatatgcatagaagaaaaaaatattaaaactgaaaatgactatcttcatctgatgctgaggtttggggtgaaaattcatattagtgggaaagcagatctctatactgctccttctcactctgagatacctggggagggagaaaagacaacactgaaatgtcaaagctcctgccagttcctcggtgctgaaacattaatgagcttctgaatgtgcaaaggtgggcccagagccgaaggatgtttgagagttaaattgctctgcataatcaaggaaaggtaattgagtttcccgaggaatcagagaatcaagaggtctaggagaagtgagaagggcagggagctatgaaggtggctgctgtctaaccccacatgacgtctctcatgatttccacattaccagcaacactgttcccaaattcctgacacagagctatagcaagctctcacatgggggacagcggtgagtgaggattctgtgggtgactcctgtgggtaagcattggggaaatactttcagatcacca

SEQ ID NO: 160329 - DNA, 284 bp, Homo sapiens
gttaagtgacttgcccaagttggtggaagctggattttaccaggtgccttggttctagagtctacagccagcactcttaactgcatgctactttgcctcctatgattagtaaacccttaacgccccactcaagacctcttaaaagtacagagcagccagaatgacatctctaaagggtagtagtgaatatcactgctgcactgcagcctgttggtggcttgtgaggacagtctctgtggctcacctgcacacacggcccatccttcctctgcatcctgtgtgtc

SEQ ID NO: 160330 - DNA, 658 bp, Homo sapiens
gatctgaacagcctcccttggttctagcagaaggacttaccaagtgagcagagctcccatccgatactcgccagtgctgaggccaactcttccactcctcccacggggcttgcatgacctccattgaggacgtccatgccccgggacagagtgcgaagtaaaagtgaagctttggagctcttgacccacatggattctcagcagccacctccatcccacctcaaactcagaagacaacctggatgtgaccgacaacttctttgtgatggatctgaacagcctcccttggttctagcagaaggacttaccaagtgagcagagctcccatccgatactcgccagtgctgaggccaactcttccactcctcccacggggcctccgcatgaagtaggcgcttctcaactaccaaatgattctgaaattctctcagtggaggtctatgttagcctggccaatttgaaaggatggagaatacaggaaaacagtaacatttggttttggaatacattgtgtaatccatctgcaacgaacctcaggtcttgcttcagcaaatattaatagcgtcagggcagcctgtggagtgactgggagaggccaccacgcagctgaaaacttgcctctggggaagccacatgcggatcatatggagctgttgac

SEQ ID NO: 160331 - DNA, 569 bp, Homo sapiens
cagcggcgaacttctcttccgtttgcggttttctgcctaattgtgcaactgaggaaataatttatttttcacatgaggaaatgcgtagcttgtagagacggctgattcaagttacatgtacagcctccaaagggctgtctccattctgtccccttcccataaaagaagtgggggtgttcgagaagaccagggaagggacccttgcctcacccctccccctggcctcaccttgctcccagccatcgtgcccagtgttaacctcggctggccttcactaaggggactagacctccctctccccaggagccccagccccagagtggtttgcaataatcaagatatgtgtcgagtcatttttctttcaactccctcatttttcattgaacaaatctctgcttttcaagagttgggggtttctgctattttttgctttctctccctccccctgcaaagatgagaaccaatgagttttagggatgtttgtgcgggtagactccatcatccatatgtaacttgttttgaagagaagtgtttccgttgtgtgtcacgtccatgagagggatccttaa

SEQ ID NO: 160332 - DNA, 679 bp, Homo sapiens
cagcggcgaacttctcttccgtttgcggttttctgcctaattgtgcaactgaggaaataatttatttttcacatgaggaaatgcgtagcttgtagagacggctgattcaagttacatgtacagcctccaaagggctgtctccattctgtccccttcccataaaagaagtgggggtgttcgagaagaccagggaagggacccttgcctcacccctccccctggcctcaccttgctcccagccatcgtgcccagtgttaacctcggctggccttcactaaggggactagacctccctctccccaggagccccagccccagagtggtttgcaataatcaagatatgtgtcgagtcatttttctttcaactccctcatttttcattgaacaaatctctgcttttcaagagttgggggtttctgctattttttgctttctctccctccccctgcaaagatgagaaccaatgagttttagggatgtttgtgcgggtagactccatcatccatatgtaacttgttttgaagagaagtgtttccgttgtgtgtcttgatgtaaatatttgttcatatttttgtgaattcaatactatgtaccattgtattatagtaacttttataaagcaaaccataaatatactgacttttcttacagaaaacatacacaaaacaaaaaaaggggg

SEQ ID NO: 160333 - DNA, 428 bp, Homo sapiens
ttcttttttagttcttttgtctaactttcatttcttttgccaaaccttagcagaaaactctgttgttgatcacatctgatttgagagatgcagattgctggttgctgccaggaataatgtgtcacattatataaataaataaaacaagcgccatgggaatgagcagtaggcacctcacagaaaccaccgggtagcatccaattgacaggctgttctaggaaaagaaatctacagattcagggctgtcaccatcagagacttctaaaacaagatacataatacaaatacacacaaatataatacattggaaagtaaatttttttttttacatgttactttcattgctttagttacgaataatttcatagtagtggtggagccatgtggaatccagttagagtaaacatgcctgtaaattggcactaatg

SEQ ID NO: 160334 - DNA, 246 bp, Homo sapiens
gatggatctctcttcacatgtgctatggaataaccatttctcatgacctacactccagtgaatctctatttcacattttacacatctactgaaaaattattttttagtctgtattcctgaaatatttctcatttcatttcacccgaaggagatacaatactaaataaggaaacacccaacccattttatttagattatcttggtgaatctagtttctgttcctatcactcagaatagtatactata

SEQ ID NO: 160335 - DNA, 293 bp, Homo sapiens
caagcggggacgaatgctggaaccagccagatgctcctctctggtgggagcaggctctgtgcaggccccgtagcagtgtcctagcccctgccctttcagcatgtgggttcttgtccagcgtcttagaaaattgaggttgcacaaaccgatagtgggtagtgtatgtggaggatttattgggtgatggctggcagcggatgggagttggaaaggggatgatgcgggaagaaggtgatctttccctgaagctgcaccatctgaagttagctgcatctgtctgtagtctctgatgc

SEQ ID NO: 160336 - DNA, 475 bp, Homo sapiens
gcggtgactcagaggaccccaagcagttatacagactcatgatttcttcagattaatgttcatagccacactgagtatatccatgatgtttgtaggacagttgttgtagttccaggatgtactcaatagagggagacaagaagttctgtgttacagcaatccctccccccttttaatcgtatttccaagtttgacttctccaagttttggttcctgtgccaagcacttttacccaatatggagtctaataattaatacaatcattgaaagcttgtattaagggtgaagaaaacctaacactccagaattagaggatgttcattcctagaagtgaaaaaccaccagcggactcaatagttaacaaaatgttaactcctttggaattacatacctggcttcagaattctttgtgggactcaacagaacttccaaaaaaagagaacttccatatatctgagtttgtcattgctatttt

SEQ ID NO: 160337 - DNA, 878 bp, Homo sapiens
tccccacttccttactcccagccctaggcaattactgatctactttctgtctataaatttgcctattttggatatgtcatataaatgggtttatacatatgtggtcttttgtgtctggcttctttcacgtcacatgatgttttcagggttcatccatggagtagcatctgtcattacttaatttccttattgctgaataatattcccttgtatacatgtaccatattttatttattcagtcatcagttgatggacatttgggttgtttttactttttaactactttgaatacttgtgtatatttgtgcatgtttttttgtacagacatattgttttcatttatcttagatatttacctaggagtgcaattatggggtaatacagtaatttctatatttaaccttttgaggaaatgctagacggttttctgaagtgactgtactgtgttacatacctgttaggagtgtatgaagattgttgtttctctggatcgtcaccaacacttattattgtcttcttgattataaccattctagtgggtgtgaagcatgaggtggttttgatttgcatctccctgatgtctaatgatgttggccatcactgtgtgtgctaattgaccatgtgtatgtcttctttggagaaatgatttattcagattctttgcacacttgaaaatttggttgtcttttcattattgaatggcaagagttctttttattttctagatacaatgccatcatcagattgatgattttacagtatttcctcacattctgtgggttgtcttttcacttcgttgacggtgtgcttgaagcataaaagattttaatgttgatgatgtccaatttatctatctttttttgtgcttttggtgtcct

SEQ ID NO: 160338 - DNA, 160 bp, Homo sapiens
gaagatcaatgtaaaggaaatcccatcatttatttgcacttctggaagtatattaaaggggatccaacttatccccagcaccccttctcatttcatttctccttcttccggcattccaattttcccacactctctgactgcgtccttctgacctcctttc

SEQ ID NO: 160339 - DNA, 125 bp, Homo sapiens
ctagccctgcccactgccctttccggaaggccttcagttccccattgccttatgtatgcgtcatcagccgtgctgctgggcacggtagacaatcccagcgagacccgcgcactgtcagcaccccg

SEQ ID NO: 160340 - DNA, 424 bp, Homo sapiens
cagctggggtttctcaaactctcctgctgtggtttgattccattactttttgtctttggctgcttggagacatgaatgcagaaattgttgacaaatttgcgttagaaaaatgatgctcatcagggccccgatgaacttcctggctgctccttctcctctgaggcaggtatatttttcaagtgagattgcttaatgctgcctccagactagccagagaggagtctactccctgggagggaaacctgggccacatctcttgtgctaagtgtttaacttatcttaagagcgctaaagaggctgtggcctgaattgtattaatgaccattgggcaggatgctttggagagagttcagtgttaacacagtgacatattattttcctgatggctcctaaagctatcaggataaatcacacgtttagcaac

SEQ ID NO: 160341 - DNA, 317 bp, Homo sapiens
ggcatagctgagtcaaagaataagtgcattaaaaattctggcagatattgccaaatcactctctaaaaaaacgtgctatggcaatttatactaccataaacagggtatggaagtgtttgagaaagctttggggtgcttccaaaaacctcaaagtatttactccaaattaaggaaactgaaaatgttacagtacaattctctttaaactctacctaggaaggagaatgcaatgaaatctgttaaaatatgaactgtgccaatttgaaaattatttacaattgtttccagggtctcatcaaaactcttaaaataacatc

SEQ ID NO: 160342 - DNA, 462 bp, Homo sapiens
agcaattctccttcctcagtctcctgagtagctgggattacaggcacatgccacctcgcccagctaattttggtatttttagtagagacggggtttcaccatgttggccaggctggcctcaaactcctgacctcaggtgatccacccgcctcggcctcccaaagtgctgggattccaggcatgagccattgcgtcccgcccacacttccaatctcatctgcaactgcgcacccgagtatctagggtggtcacacatgaaacaagttttctttcctgtggtttctcggggttaagtgaaaacaaaatagggcaatagggcttctgtttgagactaagatgttagcttcattactttgcaagaagactgattctagcttttgttattcattgaagcaatgttcttaagcactggcttccagagttatctttaaaatgtatgtgtgtgtgtgtgtgtgtgtgtgt

SEQ ID NO: 160343 - DNA, 238 bp, Homo sapiens
caacgcatgcacatcacttcatttgcatggattcaatgcagcattcagtgagcagcaaattcaagttttgctttctggaactctgtggaatgttttcccctgaacactgtcgatccagggtgggtcgaatccatgtggaacctacagatacagagggcccactagttttatgtggttttacataatgaagtaatagacttcaggtcagatggacctaacctgctactgctgtaaaggg

SEQ ID NO: 160344 - DNA, 302 bp, Homo sapiens
tctgactcagcttcttcctcctattctcaggtatacatcaatcttcttgtccaccttccaagtggtccttggcactctaggagttggtaatgtatattccaggttctaaagctaaactaattaagcttctagcaaatcaaagatgacagtaggggctgaaggaaacacagtgcaaggctaccaagccagagcttcctagcatcctcccctgagagctggactataaaagagatttaataaaacccagcacagaagtgcagaagcagtagagaataataatgatgctgagctaagagtaggaa

SEQ ID NO: 160345 - DNA, 389 bp, Homo sapiens
caccctgagaagattctctttcccaggagtcagtattggcttgtgatgcacgtctaagatcctacataaaaatgactatagtaagccagcagccctgcggcggccagcaattccattagatgagtaggaagagagctgtgctttctgctgttgtttttactggctggtgaagctatacctttgctctgatgttatacccagaaagggaatcgtctcctgaaacttgaagtgttcctctgatgccgaggcctggccttccctgagggattgccccaaggtccctacaccagtgctggcccaggcttgccctctccagtcactctggtttgttgtcaggcagagaattttcactttcatctttgctgctgacttcgccctctcacctctta

SEQ ID NO: 160346 - DNA, 504 bp, Homo sapiens
tactttccacagggatgttttgatacagggatgatacggacatctcacatcttatctagaccaagatgtaagatacagacatctcacatattatctagatcaagatgtaagatacagacatctcacatcttatctagaccaaacctcataggcaaagtaacacatttttctatattttctgtacagggttcaaagttagtatcaccaccattgcatccctaatagcttagataactggctgtaaaacagtacctcaaacccatctatcccggtctgcatggagaaaaccaagttttaaagaccaaggaaggcggttactcactgttagagctagcagcttcccataggtgagatgagcagggatgtggtcagtcttggatctcagtgattccatataccaatgctctgcttcggggagtttgcttaaacgcatatatgcttcacccatcatgttgtacaagctctgtggaaaagtacccttggaaaagtaccctgtggaaagta

SEQ ID NO: 160347 - DNA, 989 bp, Homo sapiens
agcagggagtcctcgattgaagtggaagggagtgggcaaataatcataataattagccgcgaattctctctacgaggggaggaagaaatagaaaataaaatgcttctacgttcaaacagcaagacagcctggaacgtctcaatgtctcagtgacagactgagatctctttcctctctgtgtagttgcaaaagaataaatttaagggaaaaaaataatccttataggaaatgttggtaaggagcgagcaaaacgagagctgccggggagcggagggggagggggaaagggagatgtgtcttcaagtttgctttccaagtccttctccttgattgtcttaacagggtaaagaagcaaacggaggctgaaattcagagaggaaaagcaaagaaacaaaagcaaagccgggggctacaggcccggggcaggggccccggcaagggtggaccgtgcagaaagtgaagttgggcgcggggactctgaggcacaaagcgagcagcgtgctggctgcaggctcccgccgcgcttgctgcgaacacgtgcagcagcggccgcggggccttggggcccgggggcccggagacggagggcagccaggggccctgactgctgcctccatgcccgtccagctcggccagctcggccgcggggtgacggttccctgggcctgccagttggtgaaaaaggaagtgaggtttggaaaacccggctggttaacctggtgcagtctcagtatctccgcacacacctcaagcgcgggtcctgagattcattctgtgtccacaagcttacactttttactttgggggatctctgcaaatgcatttcccccgcaattctgggcactgggtgtgcgcggcggcggctgcggttattcattattaatgacgctgcctgcccgcatcattatgatgataactattactattgttgtgattccgagctccgaggcgagagggggggtgtcgggctgcagagccgcccagcaagc

SEQ ID NO: 160348 - DNA, 397 bp, Homo sapiens
gtgcactaaggtcatttggtcttgaggcttataaagtctagcttgaaggagatctaaagattgttctaggagatacccaaagtgtaaaaggtgctaagtaccataaacttcaaggatcttgatttttcactaagcatgattaaaattaattattctaagctggcaaagaaaacctgatcatcaaaactgcccaactcaatttaattcgtggctaagtgccccacgtcagattttaatgctaaggcctttgggattttttcactccgaagggcagttacccacacaaaaacatttaattacaaagtaaactagttttatacctttccacacccatgtcaagccaggagaagtgtcggagatggtgtgtcagaatttgggggtccctctgtcaatgtgg

SEQ ID NO: 160349 - DNA, 321 bp, Homo sapiens
aagaatgtggcaaagcctttaattggtcctcaactctgactaaacataaggtaattcatactggagagaaaccctacaaatgtaaagaatgtggcaaagcttttaaccaatgctcaaaccttactacacacaagaaaattcatgctgtagaaaaatctgacaaataagaaaaatggaccaggcgtggtggctcacacctgtaatcccagcactttgggaggccaaggcgggtggatcacaagatcaagagattgagaccatcctggccaacgaagagaattactggagagaaaccgtacaaacctgaaagatataacagtg

SEQ ID NO: 160350 - DNA, 319 bp, Homo sapiens
aaagattccaggtgtagtggggtggagtggaagctccttagggaagccacttacctgatttgaagggtggtttcctcatctgcaagatatgcagattagtactctttcactcctatttctctttctctctctacttctcttttctttcttctctccttctccctcttcctcccttctctccttccttctctttttttttccctacacatatttataagtacctactttattccttaattgtactgtgccctggggatatagaatgctcctacaagggtcagggcctcacagaggagatgaacaaataaactgctgtaca

SEQ ID NO: 160351 - DNA, 348 bp, Homo sapiens
aggtaaaatactgttgatagcataggtgatgaaaatttaagaaaaatgtaattgaaaaactattgatatgtacattttgtagtctttatttccttaaagagctctattgttatttctctttttcagtcatgttttccaacaagaacacttaatcattttaactagttattaatttacatttcactatgtggtagtaaaagttaaagtaaacttagaatgtttcttgatgtggcagttgtattctcccttgcaaaatgcctaagtaaattatgacaaaccaagctaaatatagcattagttggagtcactttttattgttagaaaataaatacatttattcaaataaag

SEQ ID NO: 160352 - DNA, 630 bp, Homo sapiens
tgctaattgaaataagctagacaaaaaaggacaactatcatatgattccacttacaggaggtacctagagtagtccaattcataaagaaagtagaataatggtttctactttcattgaatgaggccaggagagagggggctggggaagtcatcttttattggctacagtttccctttgggaagataaagaggttttggagatggtggtggtgatgattgtacaacaacgtgaatgtacttaatgccacagaactaatacatttttaaatagttaaaatgataagttttatgttatatttaaatattgaaatttatatttcaccataaaaactatggaggactaaatccctgtacaaaagaaactggtttcgtcttctgggcttcttcaaccaggttgtttaagttctggaagccggctaatcctttgtttattgtactttttcatcaggtctggtgacttcccatttgcacagttaataggtagagtccagggatattgacactgggcttggttttgaattttcaatacttttttatacagtagttatccgtggttcttgacatccattgccacacagaaaagtgccttgctgaacagcacaagaaggaggcagtgattcggtgatatag

SEQ ID NO: 160353 - DNA, 329 bp, Homo sapiens
atcttggactacttcttctccaaccccaaatccagtccgcacaattcttggcccttgtttctcccttcctctctgctcttgttgttgcactacagtctagaccctcatggctccacatttgatgaccacctcagccccctctccttaacccctcatataacccacttctctaacaaaatgctgcagtcccccagtgtagaggacgctgagtctccactccttaactgggttggtagggccctccctgatctactcacactcccgctgcaaccagattccctctacttcccaatgctccggcgccaccacagccaggcctgtcccttatc

SEQ ID NO: 160354 - DNA, 321 bp, Homo sapiens
gaactaggtcccagaaagcaaatggtcatcatgaccactttagtggaaagtgtcccacagaccacaccttctgtggctttgcttccagcttagcaagctcaagttggcagaagctacaattcttcaaatacaggagcccagagtggttcttccaatgttttgcattgagtactctcacctgagttgggttttgtgctttcaggttgttttttgttttctgggtttttgttttgttttgttttgtttttttaatgattaagtgtactagaatgcgaagccgatatggttcaggtttttaaaaactggtacagtattgtattt

SEQ ID NO: 160355 - DNA, 292 bp, Homo sapiens
tagaaaagtatactcttagtgcacaatgtgacaaaaggacattatatttcataaaacatcatatttgaatggagattaaatttggaaataaattaacaggaaagggataggtagagaaaagttatcataatggcaaatgtttagagcaaaacagagaccaggaattaccagtaggtggcaataaaaggaaataatgacgtcataaagcatttccaggaattaaaggtcaagataacatttaacattgcgtgtttctctcatccactaaaatattcgtgaatatctccagtga

SEQ ID NO: 160356 - DNA, 300 bp, Homo sapiens
ttcccatcactgacactgctatcaatgagaggttttatgtaagctaattcaggggggaaatatacaatttcatgcaagcacacaaccacctttgtttattaatggtttactcccccaaagactgtccttttttctcttcaccaagaagaaatagctctctactgagtatttttgatagcaatccagcagaaacaaatgatggggttcatcatcaaagaagttttgaacaaaagccacatgcccttattgagataaattgaatgcccagaacagtgatttttttccttcatggtccctgta

SEQ ID NO: 160357 - DNA, 411 bp, Homo sapiens
tagaaacgttttaaaaatagcttacatttttaaaaatttaggaatgatattgattttcattgaaaacttttcaacatctgaagaaaatcttttcttcctaacctattaatagagctcctgattttcaaccattcttgtattcctaaaataatccatattggtcataatgtattcttcttttactaaactgttaaaataagttgggtgctgtttttttagattttggcacctgtgtgagaggagggtgccatggcagggtggctaagtgtgcccacctgtgtactagcattgaattttgaccctttatcccattggctctaaacactacatctcaggtgaagacgcccaaatgtttatctctactgagttacagattcctataacaattgcttaaattgatactcccacttg

SEQ ID NO: 160358 - DNA, 203 bp, Homo sapiens
tccattcccctcagttattttatgtcactatatctggttatttgaaatttttcagtatccctaaataatcaagattcagataaaaagaactatgattgtgtaatggaacacaactagtatctagatggtcgcaacattaattttgcctctaaacttctctcaaatctgttcttttcttctctttccctctataccactgccca

SEQ ID NO: 160359 - DNA, 175 bp, Homo sapiens
accaacctagtttctgctgtcttcaggagattcacgtaacacataaggactcacataaacttaaggtaaagggatagaaaaatatattccatgcaaatggacaccaaaagtgagcaagagtagctattctcacatcagacaaaacaaactttaaggcaacagcagttaaaaaaga

SEQ ID NO: 160360 - DNA, 564 bp, Homo sapiens
acgattcagctcggacccacaccacctgagtcgaatttaaagccttcaaatagaattctgtgtatggctgacatagcatggagtagggaaggcttctttgtaatttctgaggagaacttgggggcatgtagaggtcatgcttaggttctttccttacccagacctgacctgtgccgggccagagaggtttgccctagaaagctgatgacttaggaccttactggtgtgcagctttgcaggcctgtaaacttagttagttcatccaggtttcagttcctgggggcctgcctcaggcatgtgaaattcataagagaccatcaagtcacagttccagttaactaactccaataaacatgacgactaagttgatttatgtggacatgtaagagcatctctcctctgtaggagagattagctgggaagccagctcccctctggaggaaaccaaggcaaattatggtggcaagcttttgggtcatagcatcagatacacccagatttaaaccatgtaacagctgtgagacttcagaggagctactcaacccccctgctcctgtgtcctca

SEQ ID NO: 160361 - DNA, 272 bp, Homo sapiens
ggaggaccgcagtgcccagggtaagcgagtggggatgcgctggggaggcttggctgaggacaggggggtcgacttttctgtggtctccacttggtctgttctgagcaacgctgctctcggaagatgttgaaccaacttggggactccgggatggagaggagtgggaaaattgtaggcaatgacactttaggactgggaactgagtttggagctcggttatcttgaaaaaggaaagggagcgagctggggtcttagtagttagggttaaatgc

SEQ ID NO: 160362 - DNA, 415 bp, Homo sapiens
gtctgagttcgtcccagctgtgccactcattggctgtgtgaccttgggaaacttacttaatctctctgtgcttgtttctttccttgctggaaaatatagataacaagcataacaagagtacttatttcaaagatttggtgttaaggattaaataaactagtatgtgtaaagagcttagaacagtgccaggcacacagtccccagtaaacacaagctattattattactataaatttgcatgtattgtcaagaatcgatgaggttcttccccgtaggactttagctgattaaccttaatgttgggccaggtgcagtggctcatgcttataatcctagcactttgggaggccaaggtgggcggatcacttgaggtcaggagttcgagaccagcctggtgaacgtggtgaaaccttgt

SEQ ID NO: 160363 - DNA, 488 bp, Homo sapiens
taggagtgtattttcttcccatctgtgtgtatatgtgtgtgtgtgtgtgtgtgtgtgtatctgtgacatgcatttttttcccaaaagtgaggagatgcagtatttctgtgtttaaattattttttatcatttagcgtggtctgaaggtttgtgtacccccaatttcataggttgaaatcctaagccccaaggtaatgatactgatttggtcatgagcgtggtgccctcatgaatggggttggtgcccttatgaaagcggccctagagagctgctttgctctttgcaccaggtgagaacacagctagaaggcagcgtctgagtcagaaagccggcctccaccagacactgaatctgccttatcttgggcatcccagtgtccagaattgtaagaaatacatttattatttataagccacacagattatggtattttgttatagcagcctgagcagactaagatatcacctttttaaaaaaacaaataagc

SEQ ID NO: 160364 - DNA, 155 bp, Homo sapiens
taattctcattcccacggttcctcatgctgtgcataccaggaagcagtgaaaatcctgtacacaagctcactgtactgtgtgtgcttggggtgccctgaacccacttctcgaagggtctgctcacttccaccccatctgacacccttatcagcaa

SEQ ID NO: 160365 - DNA, 161 bp, Homo sapiens
cccaccagctaccagaacctctgtggcactggatcggtgccaccctgctggggtggggtggctgtactccatgcaggaaacatcctccaaggggttctttgctttcctcgtgcttcacttcagctctctttcactcagtacctactgtgtgcttggggtca

SEQ ID NO: 160366 - DNA, 126 bp, Homo sapiens
ataaaacatattggaaccactattttttttaaaatgctgagaaccacaaaaccattcctgtaagagaacagtctaaaaaattaaatctactttcacttctgttttgtttaccttctgctttccata

SEQ ID NO: 160367 - DNA, 834 bp, Homo sapiens
gaccctggtccctagctttgtgggtgaagaagatacctctttagcttgtgccaacccatccctctgggctacaggccattctgtagtcaccttgcagtcacgtctttccttctagataactggctctgggccttggaaaccttctctttggctctagctaattttgctgttttattccgtttacttaaaacctattcacttggtcattgaggtcagaactatcaggaaagctgtgctccttaacccatcatctaagctaagcttgggccaggtttttattacctcttgaatatatataggttgcaaatactatgctgctatgtgtgttgaagacgtgagatgtcagtgcataccctgtgactctgttcgagttgctgcaagtgtatctctctggagcactgtggagcaatagtctagtccagagaacatatgatattgtggtaatattattgctaatgcgggagatgagcagtcattgatagcgctgtgttcagggttaacggcttacgcaggaaatgaccggtccatagcaagggctcagtctttctgtgtctctcagtctttacctctcttccccatctagctttctgtctaagttcctgtttctagtctcagggcatatctagttgtcagctcctgagcagagcagaggtataagtgtcaactcatgcttgtgttaccagttcctacccctgtcagtaacctctgatgcttacaaggatactatcacctatgccatcagtggggaatgaccttccaaaaatatttttaacaatactaaaaatacctgaaacatactgggtgaaaataagacattggagctgctgctcccca

SEQ ID NO: 160368 - DNA, 395 bp, Homo sapiens
taacagtggtgtggacttctcattgagctctctgcaactggtcaaagcccagcgagtaagggcctctcttgctgacaggaaagagaccctgagacgctgctgaatgagcaaagcaactgcaaaacattcataggccatggtcctgtttcttacagtgtgaaaaagtctattcaggcctgtgtcactgtgtatctgcaggtgcatagagaaagatctggaagggtacactgtcaaggactatttccctgaggaatggagaattttgcttttcattttgtacatttttaggttgtttgattttacaaaaaatgagcatgtgctactttttgtatttttcaaaaaggtgatgtattttaaaagtgaatgacagatgaggaaacagcatgtgtaggcaa

SEQ ID NO: 160369 - DNA, 866 bp, Homo sapiens
tgtcaagcagctcacaagaggcagagctgggatttgggctcagatatgtctgaagattccagtaatccctcaggtctttttgaaggaggatcctactcctataaacatgatgcccattaaggaaagcacttcattttcagtgggctgaaatattatccacacatatacccttctaaatgatccatcagagagagagaactttttctgtccagccaaatgtgcacattcttcatatagctactcagaaggaaatgggtgtgtcattcttcagaccataggatagatgccaacatgtcccttggtagaaactacctgccagccagactatggatacaccttctctctagctcagaggctgcttttaacacgacaggttcccatctcaccctaaaggcacttatcagctgtgagtcaggtctctgcaggaggaagcacaagcatgtcagcctggtgtagctagggggctgtaattgcattcactagtcttcatccagaaaatctaccttttattaagtccttatcaaatagtcatatatagaaaagccaaaattattttttgaaaaatcagaaatagcatttctatttgctatgtaattgaatcaaaagcgtttcagctttggctcttctctctggaatccacccttttgttcactagctaagcaagtatgagcaccatataaaaactacaagcaaactttctgaaaaatgtagagaaaattaattctcctttctatgtgtgactgtacacacaatctggaaaggagtgggtctggtaataattttgatttctgtttcactgtaataaaacaatcaatctacataaaaactacagagcaaagggagaacagcaaaattccctaagagaa

SEQ ID NO: 160370 - DNA, 205 bp, Homo sapiens
agtgttcgtgttgtcatgtagcatgattccgatttttatttttaaagattgtataaatccagaaaggatcacaagaagaactaggtcaaaatgtaaacagtgtttatctctgggtaatgggattatgggtgatttttatcttctcatgtgtctgtgtccttgtattttcaaaacgttatataatgagcgaattatttttaaaatc

SEQ ID NO: 160371 - DNA, 192 bp, Homo sapiens
tgctgggattacaggcataagccaacatgcccggcctacatttttcttctttaagtctgcaagttgggccaaagaggacacaaaagtcctatggatttgtataagccaggcactaagacaaagcttcagttatactactgttgccaggccatgggtggcaaagaaatcacacatgtcaactttgcagaagaa

SEQ ID NO: 160372 - DNA, 335 bp, Homo sapiens
ggagtcagctgagaacaaggcaagatctgtcaaaaaggagttggaagaaaatatatttgataactaagaagagcaagaagtggtctgtaagtgagtttttaaagttttaattaagcaggattcagaaaagagaggtgagatgcaattgtgcaaccttttactgttctatgacccttagtaaatgcccttggttagaggcctggatcagaccaatcagaaaaataatttcttctccatgggagattataacaggtaaagaaaaagagagcaagacgtggaagacatcgctagtgttcatcctctaattcctaggcccatggaaaacgagaaactag

SEQ ID NO: 160373 - DNA, 311 bp, Homo sapiens
gtggtaaaagagagctcttttggaaattcaagtaactacagttaaaaggatccatcaatcatttatacagtagtatgaatgcattttaccagatcagtttcctgctatctcaccattgaaaaaacaagatttctgaaaccaggagaggagatgggtaattctagagcctgggatatttgaagagagtgaatgcattattcctatggacctcccctccagtgatttattggctgagaaggtagtgttggagaggggaaagcctgaggtcttggagaagaagataccagaatagaaaagcagcaaggaaagcg

SEQ ID NO: 160374 - DNA, 157 bp, Homo sapiens
aataaggctcacagtgaccttagcaacaagctttgctgcccattggctgtcactgctgccgcctgccaatgcggcctcctgaaggccagcactgatgctgagctgaaacttctgcatgtgccaaggtccagctgcctctgtcagaaatcaccgtcct

SEQ ID NO: 160375 - DNA, 339 bp, Homo sapiens
ttaattacccattatataagtaaggaaactgaggtttgggcagactaagcaactggcccagaacatcacagctagtgttaaaatgttaaatatgtcagtatattttttaaaagaaaaatcttgctctggattgatcagcgatgcgcttttcctagatccataagccatacttgagaacatgattagcatataacgacgtttgtatataacacactgtgtggcaggcaccattttaggcctttttacatgtgtgaactcatgcaaccctcacaaccctatgtttgcaaatccccctttaaagatgggaaaccaagtcacagagaggtaacttaacttgcc

SEQ ID NO: 160376 - DNA, 254 bp, Homo sapiens
gtcagatgaggaagacaaaaaatacaacacccaatgttattaaaaacatgggaaaacaggcaatctcatgtgctaatagaagtttatattcttaagggtagtttggctccgtgaattgacattttaaatatgcataccctttaactcagctggcaaatttcttggaatttatcctgaagagatagtgcacaagcatgcaaagatgtatatatcaagtgtttatcatagaatgctcacaataatcaaaatattgc

SEQ ID NO: 160377 - DNA, 315 bp, Homo sapiens
agattacacggctagtatgtagcaaaggtagaaattcaactctggccaactgaccacgctcttaacttcatgctctggagatctttctctagtctaactcatctgctgagaggttgtccagcttgtgtgttaacacctgatggggaactctcttcttcatcagggtaatgaatttcagctcttgaatttcatgatagaaataaatgaccctgtctctctgcagtcatgcattggttttagccaaactatttgggctcatgaagaaaatgtcttgcctgtgttttccatgacagacctccaaatatttgacaataa

SEQ ID NO: 160378 - DNA, 333 bp, Homo sapiens
agttgagcaaaaaatttagtactgagcggagaaatcactttacaaagaaacacaagagttgattcatattcatgatctaacagaataccagtataatagagagaaaagtccttgtcagtgctgaacacttagatttttttcagctcagattttaaggaacgttgaataacattgagtaatgactgtggtctttactagccgatttttagaagataaggagatgttattcatatggctgtttatttagtaaatcagaactttataagttgtttacatcatagcacaaacagaagaagatattttgttttttgagatggagtcttgctctgtcac

SEQ ID NO: 160379 - DNA, 421 bp, Homo sapiens
cccggtccgggttactagaagataagagaagacgctggcctctgtacatgaaatatgggctcctgatggacctcattcaattctgtactgtgatttccatgccgaacaactcaagccttaaagagagaaatatgaacaaaagaaggacaaataaaaggaagaaaggatatgaagaagaatgaatggatgatggttggatggttcgttggatgggtaaacaaaccaattaattaacaactaactgggctactttaagtgaaatgcgtatggaatgctgagaccacatccagttctaccagttctctcagttcatttaatgtaaacttggaggtgaatgctcaaatatcaagggcatacatgcaaggcgtatctgttcttcagttaatcccaactgttctatccagtgccctgggtcctattc

SEQ ID NO: 160380 - DNA, 650 bp, Homo sapiens
tttatagctataattcgaaaagaaaaaaaagtagcaggtaatgggtatattatacactatttgcgtgatggttacaccagactttaccactacatactgtatttatgtaacaaaattacacttgtactccttacatttatgccaaaaaagcggcaggatcacaaattcacacatagttaatgtgcccctccaacagtcaattatgttctatgactaacctgaggatctttatagaatctgagtaatggaaatgcctgggtttttccatttaacaatatattgggctcttacagttacaacagtcttctttcgggttaaatatttcttctcttgaagggtccactccttattaaagataagattgaactgaatgtttacttaaacgttcagtcttttggagtttctttactcttctcaaaatggtggttggatatataagaacttgctgtgtcctggtagtgttgaggggagaaggtgacaacttactgtggatgtatgttagctggtgtccactgagaatagctgtctggcctcactcctgggaattctgctggcatctgctgtgaagtctgcagttgctttaatctgtagtctgttctctttgatttggcctcattctggctgtccctggtgctgtcttatctcttgag

SEQ ID NO: 160381 - DNA, 472 bp, Homo sapiens
cacccgtgcccagggctgccttccgagcacccgcagacctgggcctgcagtaacaggagagctatctgcaaaccgcagtgtcatcagccgcacggcctctggagaggcctgagaaaggccggctcagcttgcaggcgaggaaccaaacgaaaggcaaactcctggcccctgcagcctcgcaggtcccctatccctcctccctgccttcctttccgccccgctgacaccacggtctgcaaaccatggtcctcctcgccacccctgtcacctcctcctccgccccccgccggcctccgacgcaaagtcgccacccagtcaccccgcctcggccccgcctggtttgatttcctcccgtgtgtgtcacccatgaggtggccgtgcccctggcctgtttacagctgtgcgcaagctcctcgcgacccgaaagcgagacctttgtctgcggcagctccgcgccgggctgggcggccgc

SEQ ID NO: 160382 - DNA, 523 bp, Homo sapiens
aatttgacagaagttacaaaaaagaagataaaatagaaaatgaaatgcaacacctttattcatctcatctgtctctttctcattacccatccaccaagacacgaacagcctcagtacagagagagaaattgcttgttcatttattgtgagaatcttttccagataagtggcaatttgcatccacatgagcaatgtatggcaatgtctcatctggcctaatgcagtatgcaattttgcacacgatgtcatgctgacttgaagtaactaggatatattgcttgtgtaagaaatataatgcgtagggaaatatcacattcatgtcttccagcccacaattttattatgccatgacaatcaagaacacagcagatgccacacctgcaaatattaggaagctaattgacccacgaaatatcatcaggaattttcattcaggcaacaaaaataataaagttcacttagattagagacagcaaaagttttatataactcttaaacatgtacaaagaaaatgatttaataa

SEQ ID NO: 160383 - DNA, 297 bp, Homo sapiens
ctttacacttaaactctctttaaactcgattttgaccttttaaattattttaggttaacaactgtgactttatttcttcacttccttctactgctaaatttctctgattcagagtttcggaatagagaaaaagccacatcaaagctaacattagagtggttatcagtgagaagctggactggcaaaaccagaccatcaccctccctaggacacagtttcacagtttcaattctttcaagtatgaattactttaacaagaaaaataaagccaatacttgcttcctctctcgatatgca

SEQ ID NO: 160384 - DNA, 277 bp, Homo sapiens
agaggagaaaagccagaagagtgtgatgctctggaagccaagcgaagaaagtgagtgaaggcgggtgagggcagagggtggaattgatactaggtttgacagagaggaggtcattggtgacctagacaagaagagtttcacagaacttgatttgggtcagttaaaacaagtggggacagtgcctgtggtcactgccttttctgtgaggaacaggcagagacctgagattcacagggcgtagggaagtctgggggtgaggaggagccagcctgacctg

SEQ ID NO: 160385 - DNA, 298 bp, Homo sapiens
gagtgggaagaaaggaaagggaactagaaattagaaggcccattaggaaattcctgaataatttaaacaagcaccaggatagcagtgagaaagaaaggagacacattatgaaaaagagtccaaattaattggcgcctgattgaatgtagggtgtgacagaaatgaaaaataattctggtttctagcgtagatgtcagttaagagaacaggaatgcagaaaagaacatctgatggtgagtggcctgcagtgagcgcggaaacgtgagatggagatgaaggaacatctggcagtgagtgg

SEQ ID NO: 160386 - DNA, 750 bp, Homo sapiens
caaggggactgattccgcagcacagctttgcagatcatgaaaagcagtttggagtatatgctgagaagactctggaagattttgcatggaaataaagcaatctgatttatttaaaaaatataatctggcttttgtgtagagactatataacgtgggcaagcataaaaatctggagtaaagggtcaatttggaagttattaagtaatttaggaagagaaggtgataacttgtatcagggcagtagtggtcagggtgaatggaattgcttggcacttttcttactgtcagagtaactacgatgtatcctttttcactgtctcatccattctttgtttttcttcttttttgacccaacttcccagcactcctctgcttcctcgatctcttcactggctcatgtggaacaccccccgacccccaacccaacagcatctcatgaagatttaagctgtgttcaccataatcttctgtaaatattgcctctaccttcttgtattaattggctcacttctattgcagttcattctctcacctctctgtaggtaaacttacagtcagagtcataaatgcccaaagatacttcctatcttcctgaaaaccatgagtcttttgaggtctgtgccattttgtcatactagagggcactctgcccttgctcttgatgtcattgtaacacttatcacaccatatgttaattgtatgctactttctaatatttatagtatattaaaacttgtaagctggagctgg

SEQ ID NO: 160387 - DNA, 139 bp, Homo sapiens
acattctctactctccataaactctatccttttccaactctctttaagcaggtatcttttctcttacttcacagaaaaaccaagaccatcagataggtactccctcagcttctggcttccttacccacaaatctatcag

SEQ ID NO: 160388 - DNA, 286 bp, Homo sapiens
cctgtaccccctaaaaatccctgcattctttggagaaatacaaagcagggaaggtgaatggggggacctacaggtattcatctataggtgaatagggcatgttggagggaggtaatcagggaagacttcactgtcagcaaagacttgtagaagataagaaaaccatttatttggaggaagagcttcctaagcacagggaacagcagttgtaaaagtcttgaggtgggttctttttgagacctttcagctaaatatagcaaaatggtttttgcggctggagtagcat

SEQ ID NO: 160389 - DNA, 513 bp, Homo sapiens
ggcctcatacatggaggatgtgtgcgtgggaggaagattgacagtgatctggcctggatagttgtgatggtaggtggtacccacaatgatggcccttcaggggatttgaagattgtgaaggaggaccaagaggagctgtttggaccacctgtgatccaaggcgggaactaggaagacacctaccggaagtctttgtggatcttttgggattggattggattagcagatacagaacgtttgacctatagtaaccagctgactgttcagcaaacgcttcacttcctaaaaggcttcttctttccaaggcaaactggggcatgtgaggaacaggaacttacaagagcttctagtctgaactccaggtgctgacactgttaacagttgctgagtggagtccttctcacttgggtggaaagtaacctgtaaacttggcccaagtctcccttttcctgtcctttggcccatgctgttctggtgctagatgttggctctggcctttgcactgaccatctc

SEQ ID NO: 160390 - DNA, 504 bp, Homo sapiens
ttcacttcctgccccttggatgctaatgagattgactcatctttattgtttgttgtgtctttctccacatgcttgtgaattctttcagtttgcattatttgattaatgatgaataatttcaggtattcgtgttttttttttaggaaattgctcacctatgtcctaagcccacttttccatcaggatcttcttctttatgtcatatatatattgcaaatctactagtttttggtccatttgtgttttgttttgttttgttttgtttacttaggagccaaataggaaataattgtctaaaagcaacagtgaaatgaagcaaatgaatctgtgaattaaattggtgacatgaccacacacaggaactattccaaatatctttaaaatgagtaatttagctatacatccttagagggatatattcttttatttttctttttgagacaaggtctttctctgtcacccaggctggagtgcagtggtgcaatcacggctgactgcagcctc

SEQ ID NO: 160391 - DNA, 372 bp, Homo sapiens
tatagcaaaggatatgctttatcaataattaaatgcatggatatttgctaatttaaacagaatagcagtgcaatgaacatttcttaagtgaatgtcttttagaattcttaaataatttcctaaaattatttagaagccattctaatagaaaaatgatttctggagttaaattaaaaaataagcaaaacaaaacaaaacaaacatacacacacaaagaagaaattgggtttggggggagatttaaaagatgctccggatgaggtcaacgggagggaactgaaatcaaaagcaggcaaagtgaggagaaaaactggaaagcatgaagataaaagttcggaaagagttcatctttggatagaaagccttttttaa

SEQ ID NO: 160392 - DNA, 486 bp, Homo sapiens
taacatctgtgactacaaccttctttcatcactgttctaccaatgatgaattttagtccattgtgtcttcacaaactcagctctctaatgggctttgaaagatggtggtttatagattatctatgtgttgtttttgttagtgtactagtgaagttctcttgtgactgcatcctaagtggaagtgaaaaatattttctgcaacaaatacagaaataaaaatcatatggtttttatttataatgtgaccactaggaaacaaaggtacaggattaaattcagcttcatgaaggtaaatacttaagatatgaaataaatatgtttcaaagatatcaattttcagtgttccaaagattaaatttagaataatgagatgaagaaatagactatgtacttttaaggcaatctattgtaaattttacttctcttggactgtttttagcagatggacagcagacagcttgatgctgttcctggagttgtacaaga

SEQ ID NO: 160393 - DNA, 260 bp, Homo sapiens
gtagcagccagagaggtactaggcttagtgggacccaggtactgccacaaaaccagatgcccaaagcaggcccctagggacgtcagccaacccaggacagcacagggggcaacgcggtggcttgaaacccagatctgctcttgactggcttggcaagctggggcaggttacttaacccctctgtgctccagtttccccatttggacataataagagtcatagaatggctgggagcatcaaatgaaatggcaactaccaag

SEQ ID NO: 160394 - DNA, 512 bp, Homo sapiens
attctctgaatcgcccagacctcgtgtgtggttgaatatttgcagatgagtgaagtcctcaccatttcaagtgctgtcttagctgtgactggttttcagtgacactaaccacttgggtgattaatttattaaaatatattgtaattacactgaggtagaaacaaaagtgaagggaatgtttcttgtttctgtgcttttggaaactcccaaaagtttggcacaatgggatgaccaagacaggcaggaatgggcatgtaaaactgactgagctacattccaacagtgcatgctgcctgagtgcactctggtgtcagggaaatggccaagttgtgggaaaactggatgttccgggttacacgataggccatctcttgtcgtcggaggaggcggtggcccctcccagttcgacacggtcactttatgtttctaactgatttctcttagttctgcagctgcctcagaagcagtaggcttgcttgtgtgttcatgaaaacaataaactggttccctca

SEQ ID NO: 160395 - DNA, 141 bp, Homo sapiens
ccatagcagccatgagaaccggaagagacagaagagaagacagaagcaagagtggggctgctttcccgcacggcagaggctaatgggtgagatgtgtccctggaagttgtacctagccctctgctcatttctctctggtcc

SEQ ID NO: 160396 - DNA, 591 bp, Homo sapiens
atagctgactctagagggtacacctccataacgtgagccaagattcatggaaatggctctctcaggcagagaaagaaactacaatgcttagcctctaaggaaaagtggcttactataaatcaggcccttgagaatggtgtcatttagatgctccccacagctgttaggagattcattaaatattcaataactaggccaggtgcagtggctcacacctgtaataccagcactttgggaggctgaagtgggatgattgctctgaaccaaaagtttgagaccagcctgggcaacatatcgagaccccgtttccacatacgcacacagcatggtggcatgcacctgtaatccaggctactcaggaggctgaggcgggaggattgcttgagcctgggagttcaaggctgcagtgagctatgattgcaccgctgtactccagcctgggcaagagagtgagaccctgtctccaaaaaatgttgaataactgaataaatttgctttcttatcgacaaaaattggtcttaaaatagtgtaggaactgggggttaaacctcatttccttctcagttctgtgtgggacactgaattaattat

SEQ ID NO: 160397 - DNA, 851 bp, Homo sapiens
tggttcaaacattttgtaaagtaatctggcaatataaattgagaggcacaaaaaaggttataactttcaatttagcaattccagctgtaggaatgtatcctaaggaaataatctcaaacatggaaacagctacaagcaaaaaataataatcatctaagcattattcataatagaaaaaaatgagggaggagagaaccctgaaaaaattggaatagctaataaaagaacatgtaaattatggtacattcatttgttatattctgcaggtggtaaaaaatgatagttatgaaaaactaggggaaaacatggaagaaatcttatggtgggttaaattttaacagcagaatgtcaatttgaatatatttatgattgcaattcttcaaaaatatgctttttgaaaatacatgaaaaagataatgatagggctgttaggtgatgagcgtatggatacttttattctttttctatacttattacatttttgtgatgtgattatattactctaaaaataaaaatattgttaaatttttggaatggagttttactgacttggaggtgttggtttttttcccgagtgtttttactggcttgggatagttttttcccccaatgtttttccaccttcttcttctcctttattttattttattttattttaattttattttattttatttcattttattcatttattttgagacagggtctcactttgctccgaggctggatggagtacagtggcagaatcacagctcactgaagcctcaatctcaggggctctagccatcctcccattgcagcctcccaagtagctgagactacaggcgtgtgccaccatgccccgctaattt

SEQ ID NO: 160398 - DNA, 992 bp, Homo sapiens
accatggccccgactgtacacaaaagagccatccttgccctaaatgtctgtgtgatgagctgtaagaccctacacggcactttaggaaggggcactgattatctgaggctaccaccacccatctccccagagtacctgaggcctcatggactccaccagttaaagtcccccctgcaccccatgccacactatggacaaaacattcaacaaccagccctacagccactgggatgggtatttagcagggcaagcgttgggcacacacaaaggatgcttgaaatagaaaggcagagaccctccttctcgagcttcagggaagctagtgtccacacaactccacttctacctggtttgaatctctctctctgcacggcacctgctccctcaaagtcatggcgaatcgtgagcccacatttccaaactcatcaccacacagaaaaccctgagattaagcagcagtgggtctgggccccaagggccagctgccagcagccagcaagccatgctgtggtcagctcccaagccagtggtgctgcacgtctgcaccctggccacttttgtcctgtgaggctgagatggaggcagcaccctgatactgcccaggccaggaaggatagtcaggaccacatgacccagcctgagatggaacctccaggggccaaataccacagctgtctcccggggctttcctttcaattgcagaagtaaaataaacattttttgttttattttttaaatataggtcaggttccatggttcacacctgtaatcccagcaatttgggaggccgagacgggaggatggcttgcatgcaggagttcaagaccagcttgggcaacatggcaaaaccttgtctctataaaaaataaaaaattagctgagtgtggtggcgtgcacctgtagtcccagctacttgggaggctgaggtgaggtgggaggatgacttgagcccaggagacggaagctgcagtcagccatgaccacacctctgt

SEQ ID NO: 160399 - DNA, 346 bp, Homo sapiens
actacatacttccgttctattcttagccccaccactcagggtgcctgtagggaatgcaaaaccagagatataatgagcagaagctctcaaaccaataagcatatctggactggtgagaatcaacctcccacttccccataagtttaaaaataattctaatttacagcacatgttattctaatttcggagtcactctctctacatactgcactattactaactagtgtgactacgatctgctcagacaataggaaatggtaccaggttccgtttacattcttaaaatgaatgtacacttgaaggaaaattcattgttgagttttatgcatacacaccggtaagtcgg

SEQ ID NO: 160400 - DNA, 270 bp, Homo sapiens
gccaccactttagtccaaatcactctccattactgctagctcacaaaagtgcaataactttccaactagtatccctgcctctcttctttcccttagctatcattcttcacacagaaacaagaggtcatttaatgatttaaatcaaatcatataattctcttgctttaaaaactcctgataacctcacagtagaaaaccaataataaatgtgaaaagaatgatggaattagaaaatcaccatttggcaaccattgtaataatcaattcaaa

SEQ ID NO: 160401 - DNA, 437 bp, Homo sapiens
ctgcaaagggtctggaggacggcccttctgctaaggtgtccgctcccaaggcagagggcttgggggagctggaggaggctgggttccaggaggggtggccaggtaagtccttgggccagtagggaagaagtccaactgtgtacaaacgttacctctgagccacaccactaccctgccaggaggtttgatgtggtcccattttacagaggggaagactgagtctgatttcttcactcaacaagtgctcactgaatgcctgggatgcagcggtgaacaaaaccaacaaaagaccctgcttttatggagtttataatctggtgaaggatggggagagagcaagagacaatttcgggtgctaagcacatgcagatgaagaaaataaaccaggaggggtggggagaggggcttatctgcacaggctccctcagctgagacct

SEQ ID NO: 160402 - DNA, 566 bp, Homo sapiens
aagtatgtatacaatgctacacccatactgaaaccaagaagaacactatcatgtctgtaactaaaatattaataagaataaaggaattgcttattaatcagggaaatactctttagaatagctttatattttgatactataggtaaagagtacaaagatttcatttcaaattttgttttttgcctggcttttcacagactttaaaaaaattatcacttgtgatacaaaatacctgggtgctacattctctgatgtttaatttgttttatacagtatttaaaataaagtatcccaagttgctgcaatggcagacaccagatctatcactgaggtcccttctctccttattaattagtaattgggagacacattttggcagctttcgtttccccattattttctctagtttgacacaaaaccctgtcagaagcaccactatttgaactgtacccctcttagtgctgggtcactaaattttaataaacggagctcccgccagaaaactactgaaataggcgtaaaagtttattgaagcagtaacagtaaacaaatatatgaagaaagca

SEQ ID NO: 160403 - DNA, 474 bp, Homo sapiens
tgagagaccgtgttgcaatgctttgcaaaatatgtgaaagggctttgcaaaatgtaacccgagattcacatgtgagggtaggtccctaagaatctgtagtagtgatgcaggtggcacttgccaatacaacaacctttattgatcaacaaaacgaaaattaccaggagttagtccctcccctcagcaggactaaaggatgccagtggtgtaggcattctatggcgcaagctcagcggacctacccttcaaggaccagcacctgtctacaaaaagattcctcagatggaaacagctcttcctaaggacgagtgcggcctggccagaagcccattttcctcaaagctctgatatatttggctaggagagaggatgcccagtcatgctggagaaatttcctggaggctggcttctcttcaatggctgtcactcagagcctgacccagccccggggagcccaggtgccatctatgggga

SEQ ID NO: 160404 - DNA, 389 bp, Homo sapiens
ccccgccgctgtgacatgaggctacaggatctaatatttccagtgctcttgagtttagagtacacattaatcagaaagtacctccaccaaggatctttatggacctaccatcataatcagatgtgtgatgtatggagtgactgatagagattgcctaacgagctaccgatctcaggcttagagatggccatggtttgaactatggtggtggcaaaaagatgcagtgatgaagaggctatgtaaagatattcagaagatttgaaggacagagttggtaatgtgtgctatatctgcaaggaataaaaagaagtcaaagacaactcctaggtttttaggctgcacagctgtttagatagttagacagtggaatcaaaacacacattcatgtg

SEQ ID NO: 160405 - DNA, 171 bp, Homo sapiens
tgtgagctgtgcctgccttttgttacaagggcatattaccctttgttgtgaaaaaaacttttttgatcggacacagaggctcagtcctgtaatcccagcagtttggaaggctaaggtgggacatcatttaaggccaggagctagagactaatctgagcaacacagcaaatg

SEQ ID NO: 160406 - DNA, 112 bp, Homo sapiens
tatgagagaagcggcaattttgttccagctgccaagaaaacacaaaagatgatgattttccaggcccagagaagggcatgaacagcactgaggcaggaaatcatcattttca

SEQ ID NO: 160407 - DNA, 569 bp, Homo sapiens
tagtccccctacctttccagcttatcctcttccatcaccctctcttcccagtctcaccacactattcaacatgccttgaacaagtattgcacctttatattcacatcactgggtatcaggtgtgcaataagcttagtgatgctgccacattcattcatacacccaagtgcacatgcatacacacacacacacacacacacaccaaagtgctactcaacacccaaaggcagaaccaatctcccctcccctacacctctggtgtactcttcaacttacataacacagacttgcatgacagcatttgccataaggatcactgcagccacatcatcaccatatctcattcatccctccactcataacagcaatcgcattgcttagcacaaaacatgtaagagcatgttgcagaaacaaaggaatgaatataggtaatcaggaagtaaagtttctgatagtgattgtgtgaggattacctattcaaaaaactgtcatatttctcagcattaaattactggatgatatgatttggctgtgtccccacccaaatctcatcttgaattcccacatgt

SEQ ID NO: 160408 - DNA, 500 bp, Homo sapiens
aaaaaaaggaaatggatgtagaaataaaaataaaccattggattcatcagtcaatccagttttcaatcatctaagaataaaaatgttttccacttatacaggaaggaaaatggctgaagactcctcaacaaagttatgatacatcaaatatttcaaaatgatgcaaataacggattttgtcaaggcaagtgtaagaagaaggaaaagagataatgataggctagaacttattagggacatatttgaatctcagaatcagtatttacaaggtggatatgttccaggttcatatacaccacatgtctccacatgcagctggttgcattcacagaatgttgcccaattggaatatatatgccttcaaaaccagaaaaatataaggaaaaaattaggtgtgctgtgcttaagtttctattataacttctaattatgttgtttttctactatacctttatttttacttttgcaaattagtcattttattaaaaagtcatttatta

SEQ ID NO: 160409 - DNA, 198 bp, Homo sapiens
  misc_feature (157)..(157): n is a, c, g, or t
  misc_feature (171)..(171): n is a, c, g, or t
aggattcaccaggataagcagaaatctgttagagagtaaaggaggtaggggacagtcctaaagaaagatacaggctggacacagtggctcacacctgtaatctcagcactttgggaggccaaggcgggcagattgcttgaactccgtgacctcaagntgatcctgtctgcnctcatgcttcccaagagtgctgggagt

SEQ ID NO: 160410 - DNA, 446 bp, Homo sapiens
ttgcaatgcttagaagaaacacagatgaaagggcaggcccgaggcctgggaacctgagtctttccagagaaaaacgtgagttgctttcctagtatctctgcaaagagtttcaggatgacctggaggacagagatgggaacagctactcttgggccagctctcccagagcaatctggaccttctagagcattggcccctgcctcttgcagccctgctctccctccctatctcaggtgcccgtgtaggctcttggtagccttacacctgaggtagcgtaagttctcagcaaacatgtggcttaggataataagatgcaatatttactctagcttctgaagagcagcaagtttagaaccgtaactctaaatacaaaaacaggcaggttcaatctaatttaaaaatgggcaaagggctgggcacggttgctcacgcctgtaatcccagca

SEQ ID NO: 160411 - DNA, 453 bp, Homo sapiens
gcaccattcacacaggccaaaaggtggaaacaactcaggcatgggtcaacaggtgagtggataagcaacacgcgctccatccgcacaatggaatattactcagccttcaaaaggaggggaagtctgacagttgctgcggcgcaggtgaacctagcggacattaggctcggtgaaataagccaatcacaaaaggacaaatatcgtgtgactcctcttacaggaggtccctagaggagtcaaattcaaagacagaaagaacggtaggcaccaggggctggggaggagagttagtgtttcgtgggctagagtttcagatctgcaggctggaaagagttctggagatggactgtttaaacatgaatgtatctgatgcagtttggatgtgtggcccctccaaatctcatgttgaaatgtgatcagggttgaaaatcggcctggtcggaggtgtctggg

SEQ ID NO: 160412 - DNA, 375 bp, Homo sapiens
taatactgactcatttatctgcagtgcaggctgtggagggagccagagaaagaagagcatcttcaccttcgagaactttttggatttttacatttatttattcatttatttattttagaaacagggtctcactgtgttgctggggccagagtgcattggcatgatcatagcccactgcaatctcaagctcctggcctacatggtgaaaccccatctctactaaaaatacaaaaaattagcagggtgtggtggcacgctcctgtagtcccagttacttgggaagctgagacaggagaattgcttgaacctgggagacggaggttgcagtgagccgacattgtgtcgttgcactccagcctgggcgaactctgtctc

SEQ ID NO: 160413 - DNA, 247 bp, Homo sapiens
caagttcattcaactcatatacacatgaatattccacgacttgttttatttttagttaagaagtaataattgtacatatttatgggatgtagagtgatattacacatgtatacaatgtgtaatgatcaaatcagggcaattagcatatctagcaccttgaatatttatcacttctttgtgttgtgaacattcaaaatccccgccaaaataagatgttttatttggtaatctctaagcctcttctagt

SEQ ID NO: 160414 - DNA, 409 bp, Homo sapiens
ctgggatcagaaaccccctttcctgtaacacatcttgaactagctattactggttgaatcactgagtgatcactccttcccagaggttggggatggggctgaaagtactaaccctctaatcatggctcagtctttccagtgaccagccccaatcctgaagctaaccagaggtgaccaggcatcagcaaattcattagcacacaaaaagacacagatcactttggagattccaaagattttaggagttatattccaggagacatgaggaagaccaaatatatattttacaatatctcacctaccacccattacaactgggactctagcaggagatgccactctttcatcttagaacagctaagatccctactttcccactccccatacccagcagtttaagaaaaacacg

SEQ ID NO: 160415 - DNA, 332 bp, Homo sapiens
tcaaaataggccgttatttgaagttgacaaagaatactgtcaaataacatgaaaggtaagaatagtcaattcccctaataaaaacacatctagcgcatttatattacaacctcaaccttacacagaaagctaatgctttgaagacaagtgacattccactgttacacaccatttctccagaaactaaactagacaacattataggtcaaaatacatgaaatacaccttcaactgatcacataacgtcacataacgataaaaaataaggaactaaattggtaccttaaaaattaaagacactggctgggcgcagtggctcaagcctgtaatcc

SEQ ID NO: 160416 - DNA, 394 bp, Homo sapiens
tatcttaagaaaagggaaaggggtttttttaaaactgtttacccacattccacaaaaagaaaatgaaattgaggaaacagtgttactaatgataggaaagaagaagaaattttaggattgcagacataaacaatctgttcaaaatcaaccaatgaacaaacagtatgctttagaagcttctgcaacggaaaaaactaatcaggaacttcaagaaaacaaaaagctgtctaataggaagctatttaacatgtggaataattctgagcacttgtaagaaaatctaatctgtttcatcagaacagtacaattcttccaagaggggaacaagtttactgacatatttccctaactctagatccaaccaattactagatctgtcatgaacaatgtttat

SEQ ID NO: 160417 - DNA, 620 bp, Homo sapiens
atgggcacaagcagcaaaggaaagaaggaagtatacaacataatttcatcttccacacagcttataatcttgtttgaaaagcaaaatcagtgtgttcattattactacagaaaatggtttaaggattgaactatgtgatgaaaatcaagctgatgtaaattcagagtacaaagtgattagtatggactagagagagtattaatggctttatgaaggatatactgcaactactgcaggaagggtaggtatgcatactgggggaagtgagatgaactgaagtcacagaggcaagaatgtgcctttgtattaataatctcttgcgtttcctagctcagtgaagcaagttcaccactgtccacctagtttctccagccagaaacttacgagttacttttcagttacctttctctcttcatatgtgctctatcaccaagtcctattgactctacctccaaaaatctcttgaatttctccttttttgtctcccccattgctgtttccttagtctaaatcatgtacatgtctagcctggattctgccatagcttcctagctagtctctggcctcagtgccttttacatatactgttgcctctgccaggaaagttctgtgctatcttc

SEQ ID NO: 160418 - DNA, 314 bp, Homo sapiens
tgaatgactgcatccctaacatgaggcaatgatcattcccctgcctgttagacataattcactgcctgggaaggcactgtgctgtgtagatgcagcaagctggctaaaatcaactgtagcatggcctatgtcccaagcaggttgtcctgcccatacgctcaataatgaggcccactgaactctcctggtttccagaagcctcataagcaagcacgctcagtgaaggaacaggaagtcctttctggagcagggggagagaaaggcatccagttagccatagaggggaatggctccttactctttaagagtcattt

SEQ ID NO: 160419 - DNA, 511 bp, Homo sapiens
gcctgaaatactcatcccacatcccttttaaactaaagttcactcactcttcagatcacaagacaggtgaacaggggaaagacttcttggactctttacatcacatcttcccattggcagctctcaaaactctgtgcccctctcctgtctggtacctgttgaggctgaaactgtgcatgcatttctgtgattatttaattaacatgtgtcttccctgttagcagtgagttccacaagggcacatgaaaatctgtttttcactgtatcctaaaacgaagaacatgccttatatattgttggcactcaataaatatatttgttttgtatatcaactcccattcaacatctttgtaagaatcagtacagaataataatgactagcacaagctgtgactcaggtagacttgactttgtgattttattaattcattcattcatttgtaggttaattcaataaatgttaatttatgagggcttactatatgttagacacaatgcaaaatgcccagga

SEQ ID NO: 160420 - DNA, 153 bp, Homo sapiens
aagcatatccagctgttgcaattatgaactaaagtacacttttaggaaaaattaaagacccaccaaaggaatatcagatccttttacaacactcacactttgcttctaatcttggtccatgtttatgtgttgcctagctgtgcgaataccact

SEQ ID NO: 160421 - DNA, 276 bp, Homo sapiens
gtagagacgggggtctcgctatgttgcctaggctagtctcgaactcctgtgttccagcgatgctccgccttggcctactaaagtgctgggatcacaggaatgagcccccgcgcccagcccagggcgttatctgataaagctgtcccctctcccgaagtcacgatgcgtcaaaggccccacgcccgttctcaaactcatcaggagaaaagcaggacgctgcatccctaaaacatctgcccctgccccccccgctctgctcaacccttcccacactca

SEQ ID NO: 160422 - DNA, 410 bp, Homo sapiens
catcatcccactcaacacatcatcattaccattgtaactaccaccaccatcatcatcatcacaagaatacaagctcactgagggcacagattttttttaaattgattttctttttcttactgtattcctggggtctggtacacagtaggtggccaaaacaaatttgtcacaagcattcttatacaccaataatagacaaacacagagccaaatcataagtgaactcccattcataattgcttcaaagagaataaaatacctaggaatgcaacttacaagggacgtgaaggacctcttcaaggagaactacaaaccactgctcaatgaaataaaagaggatacaaacaaatggaaaaacattccatgctcatgggtaggaagaatcaatatcgggaaaatggccatactgc

SEQ ID NO: 160423 - DNA, 233 bp, Homo sapiens
atgttgttataccagctttcttttgcaccttcctgatatatttttcactgtctattttcaaactttctgcatcattttggcttagacatgtctcataagcagtgtatagttggattaaaaaattatttttgtgatttttttctttttctattctggcttctcaataagatttttttttaacttagtctcatagactctgtcttttagtagatgaaagaaagtgtgtgtgtgtg

SEQ ID NO: 160424 - DNA, 214 bp, Homo sapiens
aacctgaacagaaactgttttatgactttgtgtatttcatgttttctttacatatactgtgatcctaaattttattattatctttgtaggtacttacaatataaatcatgtaacataaagatcatatataattgatcatataatacatagaaaatattagaaaatatacacacatacaccaagatcaaataatacaaattcagaacctttcttt

SEQ ID NO: 160425 - DNA, 215 bp, Homo sapiens
tacttatctctctatccttagtctctcatccttaatctctctatccttaatcctctatccttaatcccctatccttaatctctctatccttatccctctatccttaatctcaagaaagtgtcctaaaaggaaatggtacttaaggattattaatctggcagcacttctaggggtatctaggcattttctgtcataatttaggtgtggggtgatag

SEQ ID NO: 160426 - DNA, 456 bp, Homo sapiens
ctgaggagacttgcttagattattataaaaattagacgttatttcctgagtgtaaattgacagtggagacaaatgaccagaaccattctggatgaaaggaaaactacatcggagctgtggaatcagtgaatatctcacttcacatcacttggtagtagagatgtgttctgataaagttatacataaattgaaatttgatatatcaattataccatactaagcaaacactgcatttaaattaataaatgaattacgaaaagaattctttttcaaagcaaataatcatgtctctcacttacctctttataaggcaagcagttaaaatattaattttgcttaaatgatacccatgtattcaagcagaaaataaaatcctgactccatgtacaccaaaggttttattgccacattcctctatcattgtcttcagcctgtatgatctaattaacacagtag

SEQ ID NO: 160427 - DNA, 339 bp, Homo sapiens
aagatccgatcatttcaaattgaatttccaattagaatattcacaccatagaaacacttctgagataactcagcactataatggagatccttcaaggttatttaggttacaatcatccaagccatttttaccttggttttccctcttagaagtctccgctgcacctgtcagttctcaaatgcacaagtccttgccagaccacccagcctctatgactcctgaagcaagcaacacaggaccaaggaaaattcacacaagcgctaacaagtctggtttgattattttctgcaagctcatccaatagttcctcagcgactgagtctagacttgaggaaagag

SEQ ID NO: 160428 - DNA, 425 bp, Homo sapiens
atgcgaggtgttctagaggatcccgtatattggtgagcctgacacatacagatcaagacaaagaactgtgataacactttcttaacattatagaagagcactgtttagaagtgcagtctaataccaacagtagtgatttaaaaaatagagatgcctaattacgaaggagggtaagctactggctgtatttgattttctgggcaagagggagcaaatgcagtttcttgagcaaaggagatgatgaaaggattatactaagactattaatctagtagtaatgtgtatgacagactggaaggctaaggagaatggtgagagggaaataagaggtttcctaagtaatacacagaggaataacttgagtagctcagagtaggaagagagaaacgtgaaatacataagacagccaatcacagaactgcaga

SEQ ID NO: 160429 - DNA, 336 bp, Homo sapiens
gagaaaataagagcacagcaataaaacaagagtggctagaggaatgagcctgacacatacagatcaagacaaagaactgtgataacactttcttaacattatagaagagcactgtttagaagtgcagtctaataccaacagtagtgatttaaaaaatagagatgcctaattacgaaggagggtaagctactggcgctgtttacaaattaattgctatttttgtacaaattgctaaataatgaaaatgtgagtagactacatatacttaccaggtaccgagaataagcctgacaaaatatgtcacgactttcgagattcggtaccggctcgattcga

SEQ ID NO: 160430 - DNA, 260 bp, Homo sapiens
ctagccccgttgaatagtccatcctcaccaagtgtgaatctagcattcagagcaagtccaggattctaagttgatcctggtgtcacatctctctgtgcccaggttgtgccctcttacatcctccactttctcccctacctgaaaggacaggcaagcaggtatcccatttatgtccggcaggtgggaggggtggggagtcacggagtcctgtagagacctatcctccttccccatctattctctctgatgtcccctgtctc

SEQ ID NO: 160431 - DNA, 307 bp, Homo sapiens
cagatgagtaagacatactacttatcctcaaagagctcaatatggtagaagagagtgagatgtatatatatacatacacatatatatacacacacatatatacatatatatacacatacatatatatacatacatacattatatatatatatatatacacacacacatacacatacatatatacatgattgcaaattagagtgatggaaatcacttactgctggaggactgtggttagtaataataatagctatcttttttattgcttaatattgccttggcattatcctaaccatttaatacatgt

SEQ ID NO: 160432 - DNA, 258 bp, Homo sapiens
cacagacagcctgggcaatggtccttatcttgtccacaattggaagctgcagaaacacaaattataacaaaattgtgtaagtttaatctggttaaagattttttaaaaagtttagtgacacttactgtaattgcttaaaattcccttatcagggtaccccctcagcaactgcaggattccttgcaaaccctcttttttccttttagcaccctaaagcactgaaattttcagtgtcagaatagatcagatgtcaaatag

SEQ ID NO: 160433 - DNA, 471 bp, Homo sapiens
caggagacagctatgcatcatcaacttacctgtcaccgccaaagctggtggaatggaagtgccaggattggccagggcctgctctgaaccctctatacacaaacacacaacttccccctccctctttctcatacccagagttttctggaacccacttttggggtttaggccaaaacaggtgaaaccactggctttacaatccctccctcagcctgagtagcctatggcttcaggccccgaggcaatcctccaatctgtggttaaccagagaaccctcctccccagccttcagagtttaggttctctgtctcattgttggccaagatctcttggcctgacccacatgtcccttaagcaggaggctggtagccctgaagaccacaggcatacctggtacagccctagaccctgtccctgaacaagccagcagcagccaagaaggctgacagtaggtcttcagagtgcaaagct

SEQ ID NO: 160434 - DNA, 702 bp, Homo sapiens
catggtggttcttgcctgccgtgtcagttacttggggatctgaggtgggaggatcacctgagcccgggaggcaaaggttgcagtaggacgaggtcatgccactgcactctagcctgggcaacagaacaagagaccctgtctcaaaaaagaaaagaaagaaaaaatcataaggaagagaaaatatatttactatttgtcttagtctatttttgctgctaaagaaggaatatctaagcctgggtaatttattaatataaagaaaagagatgtatgtggctcatggttttgcaggctgtacaacaagcatggcaccagcacctaatttcagtgagggtctcaggctgcttccacccatgctggaagaaaggggtgctaagaacacagagagagagagagagagagaaagcaagagtggaggtggaggtgcctcttttcaacaaccagttctctggaaactaagagtgagaagcaagaatgacacctcaagccattcaagagggatccaccccctacaatccaaacaccaggccccaccaccaacactggggtatcaaatttcaacatgaggcttggagaggtcaaacaaaccatatccaaaccatagcttttttttttttttttgggtgggttggtgggttaaggattatctctcgaacctcgtgagcctcaattgccccccccacggggttccccaaggtgcgg

SEQ ID NO: 160435 - DNA, 504 bp, Homo sapiens
ataattaaccaatactcactgaccaacctgtcaggggcaaagaggaccagcccaggaagggggcacatttccacatatcacccaagagcctctcacgctggctcagacccacagacaagactgggaagatccgcccacagaatgttcctccttgccctccatgaccagattctcactttaaaaagagcccttagtccggtgcatcccgcggagaacagacaagaggggcctaagtccccaggaaaccagcaccatccatccggtgagattgctggccactcagcccaggggtgatggctgctaacgggtcacttaaaaaaaatgaccatgcattaaaaacattattaaatcatcactcacaagagaaccaaggaggtgtcacaatcccttcagaggggaagtcaaagaatcacaaaaagacatggagttggctgggggaatggggatggattgggccatgatggattgataattagggggcttccttttggggtgctggaaatg

SEQ ID NO: 160436 - DNA, 277 bp, Homo sapiens
agacatggatgggttacagagaaatgtaggaagtagaggtggcaagacggtaacaggtaagacacaaagtgtgagggagaggtaaacgtccaatgtgatagaagactgttaaaggaattaaagaacaatgaacatgtcaagggtaggccaagggactggagggagagactgagtggtgagatactggggttggtactggacaggagggatgtgaggtgtctttaaaacatctggtagagatggccgggcacagtagctcacacctgtaatcccagca

SEQ ID NO: 160437 - DNA, 297 bp, Homo sapiens
agtaagtatagacaatcttgaggaatttcactgttaaaaggaacagaaatggagaggaagctggaagaggaaagagtccacagtagatttttcttaaagatgggagatagttgcgaatgattcaatagagagaaagattttgatgaagagggtgaaaattattgaagagttatgttcacacaggttagaaagaatgggatctggtgaagtgtggccataggatcatgggccatttattaatatcatgttctgggagaggactcagattatggacccgtgttgatagcaggttaggtg

SEQ ID NO: 160438 - DNA, 815 bp, Homo sapiens
  misc_feature (769)..(769): n is a, c, g, or t
  misc_feature (788)..(788): n is a, c, g, or t
  misc_feature (794)..(794): n is a, c, g, or t
ttttttagatgaagtttcactcttgttgcccaggctagagtgcaatggcacaatctcagctcactgcaacctctgcctcccgggttccagcgattctcttgctttagcttcccaagcagctgagattacaggcatgagccaccatgcccgactaattttgtatttttagcagagacagggtttcaccatgttggccaggctgatcatgaactccttacctcagatgatccacccactcgacttcccaaagtgctgggattacaggcgtaagccactgtgcccagcccatgaaactatttaaacaacatgtgattacttggccacttttctattcaaaaatatggtttattagtcctgattatgtgcccttcttggcagacagaatgatactgtgtacttctgctgaaagaaatagaaactctcttccattttctagataagagagtcctaaaacagaatttccaaaaactccagttagtggaggtaaacttaaaatcctctttaagaaggataattatctttaaaggttgattcccaccctccctccccagttacttaaggaactaagtgagtacatctccagttgcccatgaaagcataagtttgttttcctcagctgaggcaagtggtagagtatacaggataacgaagtaacatgtaaaaggcaggacgcacataaaggtgacatggctattggttcacctggagaaaccacatgattgggacctgaaggttactgactgctacaggggctgattgtgaacacgangaaccccatgtgtgtgganctgtanggtgagagccccccattttta

SEQ ID NO: 160439 - DNA, 816 bp, Homo sapiens
agtgatttcaaatcaaacctcccttaagtgcctatttgactagtaactgcttaaattcagggtgattcacacatttggttaatgaaggacaccatgaaacctaacatagttgagacatattcctggaatttctgaatccacaatgattaccacctttgttttaataaaagtggtcaagaagagactggactgtagatgagacactgaactttcactagaaaaacataaatgcacttatatgccaagccctcacactgctaagcaaagaccccctgagtcaagaacatcacagagtatgcgtctcaaatcttaactatgccaacatttcacggtttgaaaaaagtaaactttatacagtgtcctatatgtcactgttgcataaactaaaagataaaacacacagcaattcaatgatgattgatgaaaacttataggttcgctaaattacactcacctggaaacaatgcattataatgcagattcttcttttttcaaagaagggtatcacattctctagagaaaatactgcctttcaggggtcagtattataaatccgccaagtgatcccagttcaaaattgaaatgttttgtcacctaacatcaaagctttaaaaatgtttttacacttaccttcatttaagaaaaaggataaatgaccctcttacagttaccataaaatattattataaaaaatattttcccaatctgattttaaactcaagggtagagaatatgtcgtttatctcttttgtcgcacatagtacctagcaaacggtattaacaatatgcttgctgagtgtgcttaatatttgctgg

SEQ ID NO: 160440 - DNA, 223 bp, Homo sapiens
tgaccacattacctgattttcaggttttctgttaggtacacgagcacacactccttctatcacagaactgagtgtaataattgtaataatctgcatgtcttaattttttaaataacaaaagtgaaagaatgtgcagtccagcttaaaattaaattcaggttcagtttaaagatcagtttcaaagatgatccaaatgattgccaagaaaattaccttccctatg

SEQ ID NO: 160441 - DNA, 340 bp, Homo sapiens
aggtctgtccacagattattttcagctctctgccaaccagacacttggtaaattgtacctccttcacttgtgattggtgggttttattttattttttactttttttttttgagacagcgtctcactttgtcgcctaggctagagtacagtggcacgatctcagctcactgcaacctctgcctcctgggttcaagcaattcttgtgcctcagcctcccaagtagctggtattatagacgtgtaccagcacacctggctaatttttgcatttttagtagagatggggtttcaccatgttggccaggcttgtctcgaactccttaccgcaggtgatccgccca

SEQ ID NO: 160442 - DNA, 734 bp, Homo sapiens
ctcactgaaaaggcagaatgtttatttccctttaattggttttcagagtagagagttagtgaaaaatattttccaatagtgctggatgagtattaatttgtcttatttacttaattttggcgggggggggggcagagtcttgctctgtcacccatgctagagtgctgtggtacgatcacagctcactgcagcctcaaactcccaggttcaagcgatcctccaacctcagcttcctgagtagctcagactacaggcgcatagcacaatgcctagctcatttctgtatttttgtagagatggggtttcaccatgttgcccaggctggtctcgaactcctgaactcaagtgattcccctgccttggccttcgaaagtgctgggattacaggtgcatgagctacctcacctagcacccagctcttgttttcattcattatgagcttgtggatttttattatatatattcagagtgtgtgtgtgtgtgtgtgtgtgtgtgtgtgtgtgtgtgtgtgtgtgtgttttagagacaggctcttactctgtcagtggctggaatgcagtgatgctagcacagttcactgcagcctcaaactcctgggctcaagcaatcctccaacatcagcccactgagtaactaggactataggtgtgtgccatcatgcctggctaactttttaattttcttagagataagatctagctatgttgcccaggctggtctaaattcctaggctc

SEQ ID NO: 160443 - DNA, 157 bp, Homo sapiens
ccctctccggacacccctaaaaaagaaaggctgagttcagagttttagtcatgggtgaccctataaattgcaatttctttttctccctaaagggttttctttcactattacatgtttgtgttttcctgattccactcatgctactgttaggtgttgg

SEQ ID NO: 160444 - DNA, 246 bp, Homo sapiens
aggtggtggtatctatccggcacgatcgtgaaatggataggataatgtttttaaacttagtgggagagagaaatgaaaaccaaccagaatataaggccatctagagtgctaaatagactcaagcaggttctatggaggaggaagaagtgattaattctgatggggaggctggggaagcaggtgtctaaggaaaggttaccaagaaggtggcaattgaacttggccttgtaggatacagtagggaga

SEQ ID NO: 160445 - DNA, 148 bp, Homo sapiens
tctcctgtccagttgttccagtatctgtatcttcttggggtctggatgatgactgctctgtctcttcggactgtgctttttcttacctttaggtatgcctcataatttttgctgaaagttagacatgttgtataagacagtagacata

SEQ ID NO: 160446 - DNA, 507 bp, Homo sapiens
  misc_feature (507)..(507): n is a, c, g, or t
agatccgttggtttgggatgctctgggacagccaagctggagatgttcttcagggagctggatatttgagcctaaatctcaggaaataaaaaaaaaaaaaaaaaaaaaaaaaaaaaaatgtgtgtgcggcgcgcgccccgggcccccgggaaaagcttttcaaaaccatcgcggtgtggggcgcgcgggggccccagaagggtaaggggaacacgggggccaaagggggttccctagaaggaaaccgggggccgagtgaaccagaggggcggggaatttctctccaccaaattaaaaaagccccggggggaaaacgagagagggttttgtgaaaaaaatcccagagggggagtgtcgggaaggcacaatacgggggagacttattacacaagggggggtcaaaagggagacccaggaattctaaaattaaagccccgggtctgtggggtggaaaaaaccagaggggaaacagaaaagaaaacaacaacaaaaaacaaaagacgaacn

SEQ ID NO: 160447 - DNA, 137 bp, Homo sapiens
ttaaagagaaaatgctgctatccgtgacttccaggcccgggatttctacttttggctacaatagaaacaacaagaagccatatgtgtcattggctcagcagatggcaccacctagcccaagcaacagtacacctaac

SEQ ID NO: 160448 - DNA, 2395 bp, Homo sapiens
ggcaccaggtctcccaggcttcctcagcgtcgacgccggggagcgccctggggttgggagcgcccggggcccgcgaaggaggaggtggctcaggtgtcagggcgcaccgtgggaaccggccccgggggaggcgtggaaacgcggggcctgggactcgaccagcctctcccgtgcggatcgcaaaatctcggagctgaaacagcccgttgttcgcagcctccctctgacccgccaccctgcacattgttttccattcgcccgggtcgcgggtgggaggagaggcacgccggggttctggagcttggccgcgcgccaggcttgtggccttcgtccccctggggccactggggcggccacgcctctccggcgggaggagagaacgcgtgggtccgggtggctgctccggcccttccgcctccagctcggccatggggtcgcgcagctcccacgccgcggtcattcccgacggggacagtattcggcgagagaccggcttctcccaagccagcctgctccgcctgcaccaccggttccgggcactggacaggaataagaagggctacctgagccgcatggatctccagcagataggggcgctcgccgtgaaccccctgggagaccgaattatagaaagcttcttccccgatgggagccagcgagtggatttcccaggctttgtcagggtcttggctcattttcgccctgtagaagatgaggacacagaaacccaagaccccaagaaacctgaacctctcaacagcagaaggaacaaacttcactatgcatttcagctctatgacctggatcgcgatgggaagatctccaggcatgagatgctgcaggttctccgtctgatggttggggtacaggtgacagaagagcagctggagaacatcgctgaccgcacggtgcaggaggctgatgaagatggggatggggctgtgtccttcgtggagttcaccaagtccttagagaagatggacgttgagcaaaaaatgagcatccggatcctgaagtgactccgtttgtgccttgggcttgctcctgcaaccagtatctccttggaattcatccaaagcccccatggacgcatggacgcagggcgacaataaactgtattttcgtttctaactctatttagggccaagagaagaaagctggaaggatgtgtactaaagtctagctcagcagtccccaacctttttggcatcagggacagtttttccacggatgggtgacaggggatggttttgggatgattcaagtgcattacatttattgtgcactttatttctattatgattacattgtaatatataatgaaataattatacaactcaccataatgtagaatcagcaggagccctgagcttgttttcctgcaattagacggtcccatatgggagtgatgggagacagtgacagatcatcaggcattagattctcataaggagtgcacaatctagatcctttggtgtgcagttcacagtaggatttgggctcctatgataatctaatgccactgctgatctgacaggaggcagagctcaggcggtaatgcaagcaatggggagtggctgtaaatatagatgaagcttcagctcgcctgccgctcaccttgtgctgtgcagcccggttcctaacagaccacagaccccacaccaggtctatctcatttggtctcagagctgtgaatcagccagcaatattttagttgcaaatcactgaaaacccaactcaaagtgacttaagtcagaaagaaattttatgaattcaggtaattaaaaagtccagaagtatctgcctttaggcacagctggatccaagggcacaaatgatgtcatcaggctccagttattctccatctcccagctcagctttttctgtctgtaagcctgattttcaggaaggctctttcctagtgatggagatgaccaccatcagctccaggcttctatcctgctaacccagtaacccagtgggaagagatttacttattccaataattccaagtggagagtgtcattgacccgtttggggtctcatctctacttctaggggaatgaaacactctgagtggccaggcctgtgtcatgtgctaattcctagagccagggaaataaggtctgaggattcaggatggggtgaaaggtggttgcttaaaggaaaatgaaatacaattagcagaataaggggaaacgagtggtctgctctgctcgggcaaaacaagagatgcccattactgtgagggacccttgaagtctggactcttaaatgggtttttgctgatttcctgggtgcatgctaggatgatggggcttgatgcagtagggaagagacgatgtaaaaataataaacaatatataccttcctagagtgtgaatgcattcgaaga

SEQ ID NO: 160449 - DNA, 2368 bp, Homo sapiens
ggcaccaggtctcccaggcttcctcagcgtcgacgccggggagcgccctggggttgggagcgcccggggcccgcgaaggaggaggtggctcaggtgtcagggcgcaccgtgggaaccggccccgggggaggcgtggaaacgcggggcctgggactcgaccagcctctcccgtgcggatcgcaaaatctcggagctgaaacagcccgttgttcgcagcctccctctgacccgccaccctgcacattgttttccattcgcccgggtcgcgggtgggaggagaggcacgccggggttctggagcttggccgcgcgccaggcttgtggccttcgtccccctggggccactggggcggccacgcctctccggcgggaggagagaacgcgtgggtccgggtggctgctccggcccttccgcctccagctcggccatggggtcgcgcagctcccacgccgcggtcattcccgacggggacagtattcggcgagagaccggcttctcccaagccagcctgctccgcctgcaccaccggttccgggcactggacaggaataagaagggctacctgagccgcatggatctccagcagataggggcgctcgccgtgaaccccctgggagaccgaattatagaaagcttcttccccgatgggagccagcgagtggatttcccaggctttgtcagggtcttggctcattttcgccctgtagaagatgaggacacagaaacccaagaccccaagaaacctgaacctctcaacagcagaaggaacaaacttcactatgcatttcagctctatgacctggatcgcgatgggaagatctccaggcatgagatgctgcaggttctccgtctgatggttggggtacaggtgacagaagagcagctggagaacatcgctgaccgcacggtgcaggaggctgatgaagatggggatggggctgtgtccttcgtggagttcaccaagtccttagagaagatggacgttgagcaaaaaatgagcatccggatcctgaagtgactccgtttgtgccttgggcttgctcctgcaaccagtatctccttggaattcatccaaagcccccatggacgcatggacgcagggcgacaataaactgtattttcgtttctaactctatttagggccaagagaagaaagctggaaggatgtgtactaaagtctagctcagcagtccccaacctttttggcatcagggacagtttttccacggatgggtgacaggggatggttttgggatgattcaagtgcattacatttattgtgcactttatttctattatgattacattgtaatatataatgaaataattatacaactcaccataatgtagaatcagcaggagccctgagcttgttttcctgcaattagacggtcccatatgggagtgatgggagacagtgacagatcatcaggcattagattctcataaggagtgcacaatctagatcctttggtgtgcagttcacagtaggatttgggctcctatgataatctaatgccactgctgatctgacaggaggcagagctcaggcggtaatgcaagcaatggggagtggctgtaaatatagatgaagcttcagctcgcctgccgctcaccttgtgctgtgcagcccggttcctaacagaccacagaccccacaccaggtctatctcatttggtctcagagctgtgaatcagccagcaatattttagttgcaaatcactgaaaacccaactcaaagtgacttaagtcagaaagaaattttatgaattcaggtaattaaaaagtccagaagtatctgcctttaggcacagctggatccaagggcacaaatgatgtcatcaggctccagttattctccatctcccagctcagctttttctgtctgtaagcctgattttcaggaaggctctttcctagtgatggagatgaccaccatcagctccaggcttctatcctgctaacccagtaacccagtgggaagagatttacttattccaataattccaagtggagagtgtcattgacccgtttggggtctcatctctacttctaggggaatgaaacactctgagtggccaggcctgtgtcatgtgctaattcctagagccagggaaataaggtctgaggattcaggatggggtgaaaggtggttgcttaaaggaaaatgaaatacaattagcagaataaggggaaacgagtggtctgctctgctcgggcaaaacaagagatgcccattactgtgagggacccttgaagtctggactcttaaatgggtttttgctgatttcctgggtgcatgctaggatgatggggcttgatgcagtagggaagagcgaagactggcagagggcacaaacgggagg

SEQ ID NO: 160450 - DNA, 759 bp, Homo sapiens
atcctgatgaatgaattggtaacactttagaaaagtaaaggcaggagacagaaaaccgggctctgattcttaagattcggattctacaggaagagaatttcaagaacatcatggatatagacagactggaaaagaagattgaagacttgtctaaaactgagacagagcaccaaatgcagttacacacatatgagaacactttgcttaataaagatacaagtttgcagaagaaaggcttatatatagaagaacttaaatcaaccatcatagaatatggaagcattatagagaatttacgaggggaaaaaagtaaactggctcatgagttacagcacttgcaacaggcactcatcacaaatgggatccagttgaatgttaatggagagtgtaacagtatcatctctgaaggagaaaagtctttacattacgaactcactcttgctcagtctgcagagaacactgaaacagaaaggcagcacaatgtaatcaacttgtcatctctggacgccatgatggatcaggaaatgctgctattactaagagagcccgcacagaaggcagtggaattcacagccacgcttcagaagctgcacgaagaaatttctaaaattgcaaccctcattgaaaactctcgacggtgggtaactaatccagaaattactgtgaaagaaaagtgggaggagcagcttactgattcacaatatcatggaagagaagtagatcttgcatagtaatgctgtaacattttgggaaacaaag

SEQ ID NO: 160451 - DNA, 477 bp, Homo sapiens
ccagagagaaaatatcaacagcttttttaggatgtaggagaatttcacaagactattgagaaccaaatgacaaggacaatgacattaactcatgagcatcatttttgttaagtgaaagtaatgaatgttctttattcagatgtcaattgtgggcatttcgatccttgtttcagaacactgaaacagaaaggcagcacaatgtaatcaacttgtcatctctggacgccatgatggatcaggaaatgctgctattactaagagagcccgcacagaaggcagtggaattcacagccacgcttcagaagctgcacgaagaaatttctaaaattgcaaccctcattgaaaactctcgacggtgggtaactaatccagaaattactgtgaaagaaaagtgggaggagcagcttactgattcacaatatcatggaagagaagtagatcttgcatagtaatgctgtaacattttgggaaacaaag

SEQ ID NO: 160452 - DNA, 243 bp, Homo sapiens
ccagagaaagtctaggtgcttaggggagaacagagactatgaaaattataccatgagggattccaggtagatctcagaaaggacttccaggtgggagagatgagtttggagaactggtaggggggaagaggagtgtgcagaatgggacgcctccctccaccccctaccccagtgccccatctagagccagagtagctgaaagccaaaggctgccagggcaaatgggagcaggtgtgaggaggg

SEQ ID NO: 160453 - DNA, 269 bp, Homo sapiens
ggggaagggggggctccccaacgcgggccaagtgcacgctgtggggctctgggaagcttacccagccacccctccccaggcatagtgctggggggccgaggcgcggacacagccccgagaggggcctccctcgtccgcttcctactcttttgcgccgctctcggagggacaccgggggcgggaggcgagactgcagcgcaggggccagaacgctgcgactttaagagccgaggatcccggaccatgtgctcggcgtgagacaaaagcaa

SEQ ID NO: 160454 - DNA, 219 bp, Homo sapiens
gaaaaaatgaaatactaagcatttgtcttttgcaatcttcatagaactaatgagatgatagcagaggtcagtacacaacttactgtggagaaagagcagaccagatccagatctctattcactgcttatgctacaaggccagtcctagagtcaccttgcgttggaaatcttaatgatagtgaaggtctcaacagaaaacatattccaagaaaaaagagg

SEQ ID NO: 160455 - DNA, 323 bp, Homo sapiens
tatgggattctaccagtgctcagcccaggcagcaacagaaaaaaaggggcctctctgagagcctattagccaagttagggaggtgctaaggggtgaaaggtgttggggtggagatcaaagaaagacattaaagggagtagtttggaggagaaaccctggagatttgaaaggctttgctggtgtgggaacctgctaggagaggtcagctccaccctactttttgcacttctcagaataaaccgatgggggaaattacagttcggagcagccttttccagagtgcatcttccatctctgtgatgtccaataagatagccatacaa

SEQ ID NO: 160456 - DNA, 215 bp, Homo sapiens
cccaaatgaactgagctgttagaatacgcaaaatgcacatgcgcacgcaaatcaaagatgtaccagctaccttagttcaccatgagtgttattagcgatacccattcacaagtggtgttacaactttctatccaatttcagagaactctcctcctgctaattcacattaactcacaaactacatccctttcgacacccactttccttctggtgcc

SEQ ID NO: 160457 - DNA, 241 bp, Homo sapiens
ctgggattacaggcacgcaccaccacacttggctaattttgtatttttagtagagatggggtttcaccatattggccaggctggtctgggcagacaacagggacaccgtgacccctccccgccactgggcttgacattcattgagtgtgtgtgaaggacacacacagaccagaggaaatgtacatccagattcctcctgaaaggcggtcacaggatgcccaaaggagaggcgttccagaaa

SEQ ID NO: 160458 - DNA, 243 bp, Homo sapiens
ccagaaatctctttacttcctgacccctcttccccagagtgccggaattccactgtcagaaatgcattgtctgggttaaaaaacttaacacctgctatgatttcaacagtgtcaaaacaggatacgtcaaaactgggcgaggaggaaatgtatttgggttctaggatagtgaaagctctattttttctacttttctgtattttccatatttggtacaatgagcacgtacttagaacggtttta

SEQ ID NO: 160459 - DNA, 390 bp, Homo sapiens
tgccaagaaattaagaaactgttattttaatagctcttattcttcctctccacaaaggaggtggctgaaagtcacaaaccaaacatttcaaatacccagaactcaaggatctgtttgaaaggaaattaagttttaaaaactctcccagaatatgagagttttgctccatcaaatgcttgtggctactcattccaatcactctactatacaaactaacacaacacttgaaatgggctaactctagaaagtgtaaattccctgtttctgagagaaggagtggggagtctggatcatcagtatccaaaatgagtaaacaagaggtcccttgagatgtggagaaaatattaaaaacactatatttagttttgccacatccttctgagctatttc

SEQ ID NO: 160460 - DNA, 548 bp, Homo sapiens
ctgtcaagaattagtagtttttgttgctaatggggttaaatgtccaggataggaaagcttactggtttgttgttgctttaattgcattggcttgggagtgaacccatctccctttcttattgacctcacatttttttaagtggataatgttatgacaagtttgataaaaatgatgcttctgactttctggagacaggaatcaattaccaagaagagataacatttctctccattgagccattaaaaataaaattcacaggcttctagaccttacggctttttgaatctttttaggttgacataatttgcctgtgattctttctggattatttatttgtatgtttggttttatctcctgaattttagattacaaataatccttccttagattttgaccatttttaggacagcattcctgaaagcatttaattctcacagcatttgttattgttttttagaaattaattaattaattctcctggctcagaataagacataatttgtgtggttcacaaggtggttgatcccttccccctgagtttctggca

SEQ ID NO: 160461 - DNA, 567 bp, Homo sapiens
tatagttgaagctgcaagtgttaaacccaggggtgtcaagggcccatgtctctgagcacacaggacagggtgtagttgttagtgctgaagccagtccagcatgacgtttgctagctctgtgatacacagcctcacctttagacctcacattcttcctgtggaaaatgggatgacaattcctgctctgtctttcttacaggtttggatgaccataaaattaaatagggtatgacaaagagctttggtgactgtgaactactatataaagcttaggatcgtcatgatgtcatcagcattgtctgcaggggtggtcttggctggctgactatgggttgccaatcccatggacatcttggtgtcctccacgccctcttctcggcgccagggtaaaatgccaatcagtgacgtgtccctgtgggactcaaatgacacaagatgatcaccctctggagctctagctctgcatccttgggtcaggccagcaagtgctgccagatgtgcacctcccagtccagcagccactgcaaaggcaggaaattagcaccagctctgagtaaacatctctgt

SEQ ID NO: 160462 - DNA, 362 bp, Homo sapiens
tcatcattggagttaattaggagaaaatcatattgcttgaagaaattagccataaacactttataatgtgtttaatgtctactaagtcaaggacttagtagtcctctaatatataatatataattaaaataactatatataataattttatatattttatatataaagttattataatatataattgaaataatatataattaaatatatataatatacaattaaaatatataattaaaataactagaatggggagaaaccaaaatgaatacaaacagtaacagtgaatgaacaataacagtaatattgataaaactgcttcactaaagtgagtgccgaagaaaaactaatttgtgtaactg

SEQ ID NO: 160463 - DNA, 213 bp, Homo sapiens
aaactgtggcgtggagccatggctgtcagaaagtgtggtccctgatcagctgcatcagcatcatctgggaacttgttaaaaatgaaaattgtttagctttattccagatctgttgaatcaaagatgatggtggtggagcccaaacaatccatgttttaacaagcccttcaggtgattctggtgcacactcaagtataaaaactactggtttag

SEQ ID NO: 160464 - DNA, 336 bp, Homo sapiens
gggtggcctaaaaataagttcttcttggccaagacaggttaatgaaagccagtttggtatcctgtcatgcagtatagctattttagtgtctcagtgtagctaatttgtcagccttgcctggacattagcacatatttagatcttgatgttctaactaatgaatgacagctaaggaatgtgtagcttcctggtaaagaattgattgcattatcactgattaggttgggggaattggaatttagtatctttgtgtataggagcaggaaaggtaaattatgatttaaaattcactgaaggattgtaggagaagagaaaggaagaggaaattgtggcagg

SEQ ID NO: 160465 - DNA, 562 bp, Homo sapiens
ggtgagggctttgctctgctaccagcgtttgctgttagcatttccacacccgagatttggaagggaatttgtcaggtttctattaaaacctctgaatgtccagttggaggaggtagtggttattaaacctcaatgttcataaatatgctaataaaaatgtaaaatttgcagtgagccattatcaatcacagacaggatgctccacctttgaacgatggcccccatgcctggctgctgaccgggagctggaagccaagtgtgcaccgctggagggcagcgaggagtctgagctacacgcctgccacgtgcggatgtgggcacctggcagggactagggtggccacgctcctggcactgcgtaccacctgcctgttgggctgcggaaatggttcctgttcccacacatatgccagtgcctctgtgagggtgaggcccatccacctctcccagacacccaggaaacaggcagcgacatgtgacatgtgaattcaccctgagtttggacagattggtgagagtcccctgaacaacgaaatgcatggccgtagccattcagcaaacg

SEQ ID NO: 160466 - DNA, 391 bp, Homo sapiens
gctgtgtctgggtatgtggggagctttgtgcatctggttgtgtagggagctttgtatttgctcagtttcaccagccagagtgaaccaggctgtgggggatgagatggctgtgggggcataaatgtcaggcctgctgaggagtgtttttcttgagtgtttctgcaacactggtttaaacggtcacctctgcacagcatatgcaggcatgcatgagtgcctgccacttcctccttaacttagacttgtggtccttcctcagttttctgcagatgtttttgagcccagcagctgcagttgcaggcatccaaccaggacaaggaggggctgtagcccaggaactctcattcataaccctcttcctctctgcctcaatagcaggctccttctctgt

SEQ ID NO: 160467 - DNA, 138 bp, Homo sapiens
ggttgatgtctttaatgcctgggaatcaatgtttcgatctatttaaaactaaaaagagaaaagttttaaacttaggacatttagcaaaataattccaacaagttaatccaaaaacaattacttaactcaaagagtcac

SEQ ID NO: 160468 - DNA, 394 bp, Homo sapiens
tcttcacttgcttccaattgtctttctccccagagctaaaaaggtacatgaggaggctaaataataagtcacagacctattctgcagaatatccacccatttcagacatcacagaacaattaaattaaggagattttttttttccattacaaaaagggaacatcgagatcttggttaaaatacacagagatcaggatgccacacagctgcgacctggggcaggatacagacactctgagtctcagcaggctcttctgcaagccttgtgaggaggtgttgggtggtgacggggcaccaaggaagtactcagtgaagtgctggcttctccatcatcagcagcaggctgagattcaggctggagcctcatcaccagctgggagcatctctgagcttt

SEQ ID NO: 160469 - DNA, 125 bp, Homo sapiens
tccctgagcaggcagccatggcttctttatctcctttcactctcttctgggaagatctacttcaatcccagtgccattatctctctctaccaaacactgctcagagaatagcctctgagacctgt

SEQ ID NO: 160470 - DNA, 559 bp, Homo sapiens
aaactgagtcaatacagctcaaaaatgaagaaatacgtatctccgataagcatattatgtgaatttcaacatcactattgagaaaaggaatataaatttgaatgaaaatgaaactctatctttctatatcacattgcataggtgtaggctagtgagtactttgatgtaaattgctgtatcttttgaggcatctatttggcaatatagatcagaattttaaatcagcatactttgtttgccagaaatctatcaggaccacttgtagtaattttgttaaaaggaatatcaaacacttggatgttcatcacagtattgattgtattagaggaaggaaagggagaaagggaggagaatggaagagagaaagggagggaggaagattggaagcaattgagatatgtgatagcatgggatttgctgaacacactataatataccatggcatggaaaagcatgcacacttaaaaaaggacaatgtggatggatctagctattgacatgagatgaaattaaatgaaaaaaaaaaagaatgtagattgaagaaacagtctgtatttta

SEQ ID NO: 160471 - DNA, 217 bp, Homo sapiens
tgctgggattacaggtgtgagctaccgtgcctggcctatcagtcatctttgaatgaggcaagtctagaccaccagatgtcaggagttgaagggcctgggctatgtatgctctaggagagcagcattcatgtgagtggataaccttcactcctcctgtccgctgagctcatcagatgcaggctcatggtggacagttgctcctctctgtccaacctca

SEQ ID NO: 160472 - DNA, 554 bp, Homo sapiens
tcgatatgaggatccccaagcagttacacagactgtagagagatggcccttttctggactgttctattcttcttcaccactgtgtaaggactgctaagtttgtgctacagaacaaaaaaagagctaaactcaaggaaggggaagagaattaacactgcctgagcaactccagggtcctgaaacttactgccctttctctctgcggttgcctcgtggcctggtggacaggggcgcccagagtgaagcagctgccccaccccatgcttctccgattgcatttccctgcctctgaggagaactaaatgcccatcacgcatgcctgtatgacctggggacacagaacagacacatctaattttagggcagagacaggcctcctgctttcaaaggaagaaagtatagattttatcatttatctttcctgccctgccttcagattccagctcaaaagatgctaaatggtgggacaggtaaggatgggaacaggggtggggacaggaggaaatatctcagatcataaaatgtggccttgattattatcaagaaagagaatg

SEQ ID NO: 160473 - DNA, 321 bp, Homo sapiens
cacgttagcactctgggacattcaaaaaacctgaacacagacaggcaagatcttttctcattctcatttcagagatcacagggaggcccaggaactaaaattagctctcacgtgaaaatcagcagtttattcattttcagtctttgttgtttgtttaacacattcagcttcccaaaatagcctattgtcaacaggctcatggccgatttccccagaatgactcctgctctaccactgatgaatacagtattaccattacagatggattttgaacagacacatttctgtaatccattgttaaaataacaatcattctaatcc

SEQ ID NO: 160474 - DNA, 481 bp, Homo sapiens
cctggaaatgggtatcctagttgctggaggtcagcgtgtggggtctcaagccttggaaagctggtaggaatgtctgatgccgcctgcatccagcagcatccggagggcgacacttgtgagttcttatcttaattcgagctctctggggactctgatacttaatctgcaatccacttatccccctgaccatcaaggccttttccattaatagaaatttctctctcctgacacagtcattaaagcctgtttcttctggctggttttccccagagtgcatagctcagcatatccatcctagaagggaggcagatttgagctcagtatttggataattttccttctgctttttcatcaagatgtagcattcgtagagtgaagcacagagatcttcagtggacattgcttttaaactgcaagaacagcccgactgtgaccccgtaggatggtgatctccctgtcatcagggatgttagcagcgtgg

SEQ ID NO: 160475 - DNA, 548 bp, Homo sapiens
agtgagctgaagtggagctgataaatctgtttttgttgatactgctgctgctgcggtttttaacacatgcttcaggtggttctaagcttaggaaaccttgcccaaaggataccattctgtctcttgggaaactgcctctatgataggcatttgcaaattcaccaagagtgacagatagtgcctcgggcactgccactgtctcttccaatgcaatttgtacattatgccgaatcataatacaggccttgtacttctgcctcagctgacttgtctgtgggatcctgcagctctcaaccatgcggaggaacgcttccattcacacattttgtccccctaaccctgtcttttctgagggtgcatcaatgtctgatgaatgaatgaatgatggaataaacaccaacatgggcaaacaagcaagtcaggcagttgtgaggagtggaagtgtttcataagcttcagtttttagttgcacgtagtagcatacaaacaatggcaaaaagaatattaacatgtcctgtttccattgctttccttctgacttaaagagc

SEQ ID NO: 160476 - DNA, 183 bp, Homo sapiens
gcgtggagaatgactgattagaggacactgtggaggtaaagagatcagctaggaggctgtcactgcaatccaggagagagctcaggtagcagcagaaggtaaggagagtatgttatgccgttcttgcattgctgtaaagaaatacctgaagctaggcgtgttggctcactcctgtaattccag

SEQ ID NO: 160477 - DNA, 440 bp, Homo sapiens
  misc_feature (186)..(186): n is a, c, g, or t
  misc_feature (267)..(267): n is a, c, g, or t
  misc_feature (317)..(317): n is a, c, g, or t
  misc_feature (374)..(374): n is a, c, g, or t
  misc_feature (382)..(382): n is a, c, g, or t
  misc_feature (389)..(390): n is a, c, g, or t
  misc_feature (423)..(423): n is a, c, g, or t
  misc_feature (425)..(425): n is a, c, g, or t
  misc_feature (427)..(427): n is a, c, g, or t
taatgagcagtggtgaaaaaacatagtgctccattcagctcccaacaatgataaataattcaggaaaagaactgccgcaatacagagcacagcagcaggatttaaaaatagaccacaggctagaaagccttggggcgggggtgtggggggaatcaggagtcacagagaaaatggatttctgtcaanaaattcccaagctctttgcaataaagggtgctgctgaaattggcacgcaaaccaaatgccaaattctaatgtacttcctcnaaaatcaaatatttttcaggaatttggcaaatctgataacaagagagctnataaacaatggtactatttggaaagagcagttatgatagagaaagcaaatctaaatnacataggnagatctnntttttaaaaaataagggattaaaactcgatatntntnccccccgaatcgg

SEQ ID NO: 160478 - DNA, 132 bp, Homo sapiens
ttacaacagctccaccgcgcccggccgttgtcagatattactttgtgtgtttatgtcttctttttccctactggattataactctttgacatctctctctctctcttttttttttaatatgttctgcgtctt

SEQ ID NO: 160479 - DNA, 421 bp, Homo sapiens
attttgaggtatacaaaaatacattatagtaattacttggcatggtttatggcacgcagtatgtgctgaataaatgctagctttttttcctgggacttttcaataacgtttgtagagcactataagagtagaagagtgtaggctgggcatggtggctcacacctgtaatcccagcactttgggaggcagaggcgggtagatcacgaggtcaggagttcgagaccagcctgaccaacatggtgaaaccccgtctctactaaaaatacaaaaattagccggatgtggtggcaagcgcccataatcccagctactcaggaggctgaggcaagagaatcgcttgaacccaggaggcagaggttgcagtgagctgagactgccattgcacttcagcctgggcgacagagcaggactccgtctctga

SEQ ID NO: 160480 - DNA, 188 bp, Homo sapiens
taggtactacaggtgaaatttggtagagaatgtatcgggctcagtttcctgacgttaggatagaagaacaaataataagagtttttaaaaatccaatcaaagattctttatgaaaatttatagacagaaatcaattctgtaaccttagtagttgtttgataatataatgctctaggttttcagagcaa

SEQ ID NO: 160481 - DNA, 288 bp, Homo sapiens
ctccaccatggcagccaccaaccagctatccagcccagagactctcactggctctgacctctccctcctcagcaccgcaaaatctgctgcccccagctattgtagtgaatcacctcccctcgctgctttcctgccttcccaagggttgagtatggtattcaacctggcctcctctaccatccaggatcttctctcctcaacctgagttagccacactgaggcccctggaatgaagccctcccacctgctcttccagctaggccccctgtcatatctgcagtatgaaca

SEQ ID NO: 160482 - DNA, 308 bp, Homo sapiens
ccccttggcaccatcttagagtttgaatcaggaagatttacgttgtaacctcagtacttccactaatgtgccctgtgatgttggaaagcttcctcatgttcctgtgggcctctgtttccacacgaacgcaatgagaaagtagaactcagtgatcttcagggtccctcccgggtgatggacagtgagtgcacagtggtctcctaagcccagtgaccaaggaaccaaggtggacacgaagaaggcagagccccagatgcctgtcatggataatgcaattcagaaacttgggtcggttaggtggcttgtgt

SEQ ID NO: 160483 - DNA, 469 bp, Homo sapiens
cagtttggttggatacaggacataaaagaggaagaataaaaaataatctgttagtcccaaagttgaggaaagggagattatagaaaacttgtgattgaaggctaataaacttgatttgggaaatcttcctttatgatacatccaggtaagacgggatggttgtccattaggtagttgaaaatgtaggcctggagctaaggttgaaaatagaggttacagataaagattggcagtaattagtatgtgagtaggtaagatcactcaggaactgtgtgaggatggagaagagagacctggatagaatctgaaggaacctggaagaaaattagctgggcatggtggcacacacctgtagtcccagaaacttgggaagctgaggtaagatctctggagctcaagaggttgaggctgcagtgagccgatgtgccagtacactgcagcctgggtgacagagcaagaccctgtctca

SEQ ID NO: 160484 - DNA, 240 bp, Homo sapiens
gcagtgagccgagattgtaccactgcactccagcctgggcaacagagcgagactccatctcaaaaaaaaaaaagacaaaaataaataaaataaaattaaaataaataagtaatgaatgtcagttgttgacctctctgtgtgactatgcttttcttttagctgggcagatttacttataacacagagctatttagagattttatgtattttccattggttattaaattattatctcttttc

SEQ ID NO: 160485 - DNA, 517 bp, Homo sapiens
agagaagggctctcactgtgtttcccaggctggtctaaaactcctgggttcaagtgattctcctgccttgccctgccaaatagctgggactacgggcatttttaaaaccttctaagtatgtgtagtaaaagtagttagggaattttagctatgcattgtttctaggcaataggaaaaccatctataattcaaataacagtactttgcaacagtgcatctattatatttttaatttcgtgttttaaatatctccacaatcttgcttatatttaatctgcaccacttaaatattttttttttttgtatttttagtagagacagtttccaatccaagtttaatacatctgcattaacaaaatgagtttttcactaggtttacaccactggattctagcaccagtgggcccacctctgctccgcctggctccaggactccactactccctgaatggaggctgaggcttggaggctgggccccctgagggaccccgcccacagccccacaggacctgctctc

SEQ ID NO: 160486 - DNA, 113 bp, Homo sapiens
agaaagaggtagaatattgttgtttcctctaatctctgactggtcttaactctcttagtgctgtttcaggttcgttatagaaacaacaaattgcctctatgcatagaagggat

SEQ ID NO: 160487 - DNA, 297 bp, Homo sapiens
attaattaatatcacatcacgaggaaggtaaaaacagctttgagaagcttaaaacttaccataggagtaagaaaaaggcacaaaattgtaccaaagagaatgtgaggcatgtaatgttttgcatcttcatttccctttgttgccccttaagcaacaactttgtcttaaatttacagtcctctttgtacattcttcatattttttggtgtatttttagtttttactacttaatatacaagtgaaaatatttgtaatgcattacgtgtatcatggaaaatatgcaacattttataagct

SEQ ID NO: 160488 - DNA, 141 bp, Homo sapiens
cgtctttctattctcactttttaacaataggatttcggacagtacgttttcctggtcttctgatgttggccttttctttgtccagagaatgtgaacagaaatgactaggtccctgttgcgaatccagactttaagagacat

SEQ ID NO: 160489 - DNA, 634 bp, Homo sapiens
gattgcgagctcggtaccccacaccacctgggtcaatgcaagtttgaattaaaagattttgttttgaatgtgccatgtttttatgaggttactaaaagatttgcaataaagtacaacttttctacccaagaatatcctaatttctttgaaactatccattatgtattaatatgtagctattccttgcctcatgaactatagatgtacaattattttaaaactccatcttggggactttctggtagttaagataattataaccatctaagctaaatctccccacacatcatttaaaaattgagcagatcaattaaccaaattgagcagatgtaccaatctttgtacagctataatataaagacaaccaccaatggcccatttcttcagcacaattagaaaaggaaggacgtcataagcttaaaatgacctgtaaatagacaaacataaacttccagtagagtcatttctgtagctcccaccacacactttactgaagatgagggaggatccagaaagactccagaaagagaagcaagggtggaggtaaaactacctgcagaaggaaaagtcccagttatgtgggaacatagtaaaaatgcatggtgaaggggaaatcgaagtggagaaaatggaa

SEQ ID NO: 160490 - DNA, 589 bp, Homo sapiens
tttttccattgaattgtttgtcttttgttgatttgtaagggtatatgtgtacatttttacttggtttcatttttaaactttatgagttctttttactatatagatatttaaaatttgcatgtagtcacctcagccttgttcctttttgtctcctagctttttttggtcagatctctcttcccagaagatattattcattttattgagatataattcacatatcataaaatttacgtttttgaagtgtaaaattcagcgattttagtacattaacaaagttgtacaatcatcaccattgtttctgtgcagaacattttcatcttcccaaaaagaaacccgttagtaatcactccctgttcctctcgcctcactcgcagcccttggcaaccagtaatctagttttttgtctatagatttacttaattctaaactagacatttcatacaaatggaatcattcagcatgttatgtttttgtctggcaggtgccaagatttttgaagtatgctttttaatttttttctggtattttctagatttaaaagtttagatttttaaatctttctggattaaaaagaaaagtatttttt

SEQ ID NO: 160491 - DNA, 109 bp, Homo sapiens
agataatctgagttcagacttcagattatcagactaccttctgtggccctggataaattagttgtctcaatgtgcttacttacaaaagtggactaaccatttatcctaa

SEQ ID NO: 160492 - DNA, 699 bp, Homo sapiens
actatttgggcacatttggttggaaaacacctaaaatctcacttggtaacggaattatagattattcatatttgaattgctatgcccatatatcttaaaagtttactttttggaaaattataggccaaaattacaaagaaggttaactataccatacccaggaaactaaattgatgacgataaagtaaagctaattgtaattcataactgaaaagcagtactaaaagcaagtgataaccagcagccaacctagtacagcactaatgatgtacaacaaacagccttctggacagcacagagtggaggcattgcagactgtgcagggatgtccgggaaactccagtgaggaggtgttcattgggtcttgggagcaccaaattttattcactcatcatctcctctaataacctcatgaactttagtcataatcagaatgatttgtatggcattgtataatatttgccaaaacaaactgaataaaatgaatgcattttgggtccattatctaatatttaatgggaccctttcaccctaccagtaactgcattttatatattgagaatctgatgtggatgaagccattattaatctcaggatgacatacatgtcataaatgttttatttagtcaaaaaaactaagacctttggttgtgtggtcttaatacagcacacaagagtgtacgatacaatggaaaatat

SEQ ID NO: 160493 - DNA, 526 bp, Homo sapiens
cgacactcttggttgctgtattaagaccacacaaccaaaggtcttagtttttttgactaaataaaacatttatgacatgtatgtcatcctgagattaataatggcttcatccacatcagattctcaatatataaattgcagactgtgcagggatgtccgggaaactccagtgaggaggtgttcattgggtcttgggagcaccaaattttattcactcatcatctcctctaataacctcatgaactttagtcataatcagaatgatttgtatggcattgtataatatttgccaaaacaaactgaataaaatgaatgcattttgggtccattatctaatatttaatgggaccctttcaccctaccagtaactgcattttatatattgagaatctgatgtggatgaagccattattaatctcaggatgacatacatgtcataaatgttttatttagtcaaaaaaactaagacctttggttgtgtggtcttaatacagcacacaagagtgtacgatacaatggaaaatat

SEQ ID NO: 160494 - DNA, 215 bp, Homo sapiens
tgaataacatgttttggagcagtgtcatccccttttcaaatgccctagttcttgacaccaagggaattaaaagtgactttttctttagaactatgaagcatataagttctgtgagttcacctttttgcagcagcttctgtgcattactcagttctacttcctgcaaacaattctttatttccacacctgtggaagacagtatggtcttgtagtta

SEQ ID NO: 160495 - DNA, 421 bp, Homo sapiens
  misc_feature (388)..(388): n is a, c, g, or t
  misc_feature (391)..(391): n is a, c, g, or t
  misc_feature (397)..(397): n is a, c, g, or t
tggctgagtgcgactctagagtagagcatcgcgagccctgaacttataattggacatagcatctacttgagacataatttctcctttagagttcttgaaggaaaggctggacatgagtggtgacagaacggacggaaaaagaaggtactaaacagccttgaagtatggaagctcctcctcttgtccctgtcagatctgtatgtccaagtgtgggccagagtttcttgcccaaacaagctgagatatttggcagggcacatggtaggctttcagtaagtatctgtggaactgaattaaatccctctagccagaggaataatctcttcccgagttgcagaggaaacgcaagcatatctgtctttgtgcgctccccgagggttaagggctnccngagggntaagggctcccggagggtaagggc

SEQ ID NO: 160496 - DNA, 596 bp, Homo sapiens
tgctgactgtctccagtcaccatctcattgctttctccaggattgtgagtggcttcgccctgaggaaagctgattgccctgggctgctgcctccggaagagtgagccaaaatgtccccggaatctaaaaggcttttcaacatcattattttggatggcctcatatgtgtaagttctcatgagactcaaatggaaattagttgtccctgaggttcttcatgcttggctgattgaactagatggtttgagagggatattttgtagattaaagggtgagattagggctggggagaacaatggtggtagagtggccttaaagaccagcctccaggaaagcctctggcagttggagtccccactccctgccattaatcatctgtcacatctggttcatcttccttttactaaccccagaatcttggcttttctctttgcccaccaccattagcccaggctgtccacatccctcacctggatcactgcagcagctcctggccagtctatccttgcttttctccagactgtttttttctgaaacgcaaggctgattttggtcattttcctcctgactctgattttacctaatgtcttagaatg

SEQ ID NO: 160497 - DNA, 230 bp, Homo sapiens
tgtttctaaggacgtgcaggctacaggaatgcagtgttcttttagtaacctttcccactatgaagtttcatatttactcctacttctctttctctcatttccccagcgtcttccttcctgttttcttcagaaaagtaaccagctgaattctgtagtatcctagagtttctgtgttgaaacagcatttttgatgtaaaattttattgagatatttatggatacacatggaa

SEQ ID NO: 160498 - DNA, 363 bp, Homo sapiens
ccgaagcctccaaaaaaaaaaaaaattccttcataaacagcaaacttttaactaatacacaatgtgcttttaatactgactttaaatcctccctcaaccaggaactcgtgaaaacatgtggtcagtgtggcaaaagggaactgctgggtcctgatttagttgacattctctttttttacaacctggattttatatcattcactgatgcctttctttaagctcatacatttcgtgcttgtggcacaggatactgttttcttaacatcaaatctttatggcactggcaaaaaattttcaatctcctacttaaatttggttcaactacacagtttcactatagccaacagtttgtctggataagct

SEQ ID NO: 160499 - DNA, 216 bp, Homo sapiens
ctctactcagtaaattatctttcacccacgtttttgtactcatagtctatctaacaaaagcactgtagtagagctagtgaaagaaagaaataaatgagctaaaacaaagcaatttacagttccaactttggatgaatttctcttctgctactcctctcactcttctatactgtatacacacacaccattcatttcccccagaaaaaggaaccaact

SEQ ID NO: 160500 - DNA, 286 bp, Homo sapiens
tttattatcactgtgatggagctcaaaactagggtgcagatccccatgctagtgttgattttataatggaagtcccctagacactgttttttaggtcttccaagcatagtggctcacttttacctaaggcataactcaagtactttcccagaatgctacccatttgctaaagaaatatttcacctcttcactcagttaagaattttaccattcttatcgggatagcctgctgaactgtttacacccttgtggactgtttttgtaacattttcattttatttccttt

SEQ ID NO: 160501 - DNA, 516 bp, Homo sapiens
  misc_feature (10)..(10): n is a, c, g, or t
  misc_feature (22)..(22): n is a, c, g, or t
tgatcgagcnggtactactttncacaggggatgtatgcgaggcagagatcttttggttttctggtgaagttcattttggttaagttaatcaatgtcccttctaaatcagagctcatattattccctctctctgatgccagccaggccccagtttgagagacctgaaatgcagaagagctgcacttttttatttttcttacccctcttctctggtcctgattcctccattgttggggcaaaaaggagggattagagaaaagaggcaaaagccatttgcacgattagcactattaattctctctctgtcctctgcaggttagttcctctctctgtcctctgcatgttagttcctctctgtttcctctgcatagttcttccctgtgccccttgcatattagttcctctctgtgccccctgcatattagttcctctctctgtcctctgcatattagttcctctctgtgtcctctgcatagttcttccctgtgccccctgcatattagttcctctctgtgc

SEQ ID NO: 160502 - DNA, 471 bp, Homo sapiens
ttggattcgtggatgaaagtgcatgttggttcagtgattcaaggcctctgtttatctgagtgctcatctgattcccttctcgtcggtgcctatcaagttccagttctgagagagcggaaatgtagaggatctgctatagtcgatctgtctgactgctcttttgtggtcgtgcgtcgtccatcgtggtcggcgacatgggagggattagagaaaagaggcaaaagccatttgcacgattagcactattaattctctctctgtcctctgcaggttagttcctctctctgtcctctgcatgttagttcctctctgtttcctctgcatagttcttccctgtgccccttgcatattagttcctctctgtgccccctgcatattagttcctctctctgtcctctgcatattagttcctctctgtgtcctctgcatagttcttccctgtgccccctgcatattagttcctctctgtgc

SEQ ID NO: 160503 - DNA, 577 bp, Homo sapiens
ttactcgatcaaacagtacatccaaaagaaaattggaacctgtataaaataaaaattaaaaaagcagtttgactcaataggctgcactcatttcagggctaacactggaaggttattcactatgggtccctatgttataaccaaaaaaggtatctgccaggaagtctttgtgtcttcagaggagtcagtttgtctgtatccatatccagtgtcttcctttctgccatggttgttggaaacataagaaacacatgaagctcaacttattgactctaacttggccctgctattgatctgttactttatattttctgggaagttcaatttttatctattactaatttctcatcttaacatattgactcttggccaggcacggtggctcacacttgtaatcccaacactttgggaggccgaggcgggcggattgcctgagctcaggagtttgcgaccagccagggcaacacggtgaacacatctctattaaaatgcaaaaaattagccaggcgtggcggcctgcgcctgtagtcccagctaatcgggaggctgaggcaggtgaattgcttgatcccaggag

SEQ ID NO: 160504 - DNA, 175 bp, Homo sapiens
tgagggaaattagacatgaatggtttgcttgtggaacaggtaacaccagaatttctattgcctgaaaacatactcaagtgaacttgttctcagtttccatcagtagcttttttcttctctattttctccagcagagtaaaaggattcccaggaaccatgagattgggtattaaat

SEQ ID NO: 160505 - DNA, 396 bp, Homo sapiens
ataagtggtgtgatataccatgtccatggatcagaatattttacaaacctctcctgagtggttcaccttgccaccactctctacttcactatacatcctcttaaatttgcattaactccccagctccagacagtttttcaaagcacagatgtggcaaattttcattattaggcccaaaaactcagctgtttgcttatattgatttacttcaagcacctggaatgaaaaaacataggactcctgaaggttaaaatcccaagtaaatgaagggaaagataatagcaataatgattagacaagaggagcacaaaacaaaacccactaagagaataaatgagctatgacttcagggaactctatattctctaactcccaaacctgcctactacttaaaca

SEQ ID NO: 160506 - DNA, 162 bp, Homo sapiens
acagagagaaccttggagtccaaagataggagaggatacccaccactaactttcaatgaaaccacaagctggccacttagcttttcttgtgctgtagagtcaaatgtgaaacaataggctttatttatttaatactttgtataaggcactttgctcagtaca

SEQ ID NO: 160507 - DNA, 113 bp, Homo sapiens
tggtacaggctggctccggcactgtactagacacacttcttggatctgtttttgtttttcccataactaatggggatgtgttagctaaaatgaaaatggataattaaaaaagg

SEQ ID NO: 160508 - DNA, 173 bp, Homo sapiens
tcaaaaaatcagtgaatgacagagagcagcaccttccacaaatttgtgaattactctggaaggatttgtttggcaagaaccctgacatctgaattgataatggcagaacggacacctgtccttcaacaccagtactcagttgaaccgtttgtatttgccccagtccctgcaga

SEQ ID NO: 160509 - DNA, 221 bp, Homo sapiens
tcacacagacgcaaataaaagtgagcaccagcagattgggaatatttcccaaggaatgaagagcagaagctaagcctgaagtatgggagagtgagcataatagaaggaaaaaaaaatgtatctaatacttatgtaaatatagacaataaacacatacagatagtgactcatttattaaatctgttgcctctctgacacttggggcaggctgtttctgtaat

SEQ ID NO: 160510 - DNA, 150 bp, Homo sapiens
ttaattcctgtaagtggcattttttatatcccattatgtttctttttcaccacacactatgttgttaacgtccagccatcagccacatactcattacttccaattgctgtataatagtccacctttgtctatgcaccagaataatgaggg

SEQ ID NO: 160511 - DNA, 220 bp, Homo sapiens
aattagttaaattgcaagacccgtaaacaaaactaacactactcatttcaattcagttcccagcctaagaaaattttcatttcagcaaggcttttcctgtcttttagactactggaaaaaatggttggttcatttcacatgaaagtaatggaccctggctttggtctagtattaataatgtagatgacagtgtgaggcaacactgggtctgggggttatt

SEQ ID NO: 160512 - DNA, 386 bp, Homo sapiens
aagatggcttttatcaactacatatattctccaaactagatgggttgtaatttaagatgtaaaaatgtaagctagtctcaggtagttactgttccatgtttcttaccggttaagaacttcatggtcttggtacctgccttattcccctctctcatcttcattcttgactgttgactgaaagtgatctagatctattgtgtctgtgctaggcatttaccttttatatcttaatctaccaaaatagcatatcctcccagtgagaaggagataacaggcgtggcaactaaaacaaatgccatttttgattttttgtttatagctaagattaataccaaatagaaaactgtacctgaagggttagtcatagtcatttgtgctcaggaatt

SEQ ID NO: 160513 - DNA, 171 bp, Homo sapiens
ctggggataggatcctcctaagtggggggcttgcatctgccacactggctgtcagatttcccgaagccattctccactccaagttcccctggcctgccacccttcttcctgcctccaatgcttctaacatcaggaaacacactttgttttgagcgcccataccctcctcgt

SEQ ID NO: 160514 - DNA, 269 bp, Homo sapiens
caccatgcccacccacaccactagacaatcttaagcacagacgtgataatgatttggcttctatttaggctctatcttttatattaagaagagactgtagaaggggaaaagtagaagcagggtaaccaattaggaggctattgtagaaatccaggtgatagattgtggtgatttagaccatagtagtagtcatgaagatggttagatgtggtcaaattctggatctattttgaatgaagaacctatggaatttgctgacttggattggg

SEQ ID NO: 160515 - DNA, 287 bp, Homo sapiens
acttcaagattataaattatctacctatctttcctttagttctctgttttcatttttatattctaatatcatttaacccatcaggaatttcctttggtgtaaagaatgggtaggggatttggtttttaattttgttctttttagtttcctggttgtttcaacactatttactgagtaattaatgaatagtgaggggcagttgtaaacttgtttttgaagatcagcagaatcagccttcttggttggtggtttcctgggcagttctaccactcgagcaagacctgaag

SEQ ID NO: 160516 - DNA, 104 bp, Homo sapiens
atttacaagaggaagaacaaacaaaattacttgatttcaaaacttgttataaagcaagagtaatcaagacaatgcagtatttaccagtcattggaacaccataa

SEQ ID NO: 160517 - DNA, 312 bp, Homo sapiens
ctcacacctgttctcccagcactttggcaggccggggtaggcagatcacttgagcccaggagtttgacaccagcctgagcaacatggtgaaactccatctctaccaaaaacacaaaaattagccaggtgtggtggcgcacacctgtaataccagctacttgggaggctgaggcaggagaatcacttaaacccgggaggcggaggttgcagtgggctgagattgcgccactgcactctagcctgggccagagtaagaggctatcaaacaaacaaaaacagcacaaaggcaaagggacctgacccgtctgcttc

SEQ ID NO: 160518 - DNA, 441 bp, Homo sapiens
acctcagttgactgagtagctgggactacaggcatgcaacaccatgactggctaatttttgaagttttgtagagacaaaatatagggtttttgtagagacaaaatggggtctccctatgttgcacaggatggtctctaactttttttaagagcatgagtatttcatatagccaaaggttttacccactgttcttaacctttatgaacatgatgtgacatgacagactatattctctgcatgaaacatgctttcttcatgtttatgccattttagggttttaataaatcaaaaaatctcagtttaattaaagatttaaagatttaagttactagtgacattggatgtatttttctaatgtttgtggctattcgtatttcttttgtgaagaaagagaagtgttaaaattagctgtagttctgctctgctgcttctaggtgcat

SEQ ID NO: 160519 - DNA, 521 bp, Homo sapiens
gggaaagccataaatatagacctcaaacaatgaggctaggcctatatgagtttgttcaggtagaaatggagtggttcaattcattgcatttttcctgtccaaccactcagaacagttattatagggacatgtgagtccaatttattagaagaaactatatgaaattgacaatattcaactatttttgcacacaaaaatggcattttcatatggttcaacctaatagatatgtttaattttgttatgttgctttcaaaatggtacttgatatataaggagaaggggaaaaaaggaaacaatagcaatacgaaaccactgtttaagaaaatttaaatttctgtaacttggaacctcctggtaggtaggaattatgaatatcattcttcattacaaaatcattaagaatgttcatttatgtatatcaataaatataactttattagagatggggctataaggaattattttgctgtatatcaagcaccaaaatattaaaggaagattctttcttacctcattta

SEQ ID NO: 160520 - DNA, 486 bp, Homo sapiens
gagctcaagtgatccacctgcctaggcctcccaaagtgctgggattacaggagtgagccaccgtgcccggccaattgatttaatttaaaaacaccgagtgaggccccacatgtacagccactgttctagaggctgggggcccacagggagcagagcagtctctacttgcctggagtgttcttttaggtgggggaggcagacaccaaacacgtgagctttcctggcctgcttaaatcttcacaagtgttgtgcattttcagccagaattttttgtaccttgtaaaatttactttaaaagtgcagaatttaatgcactttttttttgagacagggtcttgctttgtcacctcggctgaagtgcagtggcgagatcttggctcattgcagtatcgagctcccgggctcaagtgattctgttgcctcagcctccatccggagtagctggaactactacaggtgtgcaccaccacacccagctcagttttg

SEQ ID NO: 160521 - DNA, 416 bp, Homo sapiens
cctcagagcatcctcagtctagtgagaatggcatgcaaacaacagcctaacttataagtgctttacttgagacatatgcaagttactatggaatgcaaaggagtgtctgacgtctttcctggggagtaagaggaggcttcacagaaaataaggatgagtcggagctcacctggcagggagggggaagatcattccagtcagagagaacatcatgttcaaagccacagaactggttctttaagaaagcaggtaagtaggtggaaattaagagtgtatatggaccgggcatgatggttcacgcctgtaatcccagcattttgggaggcggaggcaggcggatcacttgctatcaggagtctgagaccagcctgaccaacgtgatgaaaccccatctttataaaaaatacaaaaattag

SEQ ID NO: 160522 - DNA, 343 bp, Homo sapiens
tccgagctggtacccctagttttagaagtttcaatagcagctagctactgcttcaaagtaaaagtgtgggaggcagtccccttaaaacaagaaagatgaggatgcctctagcagatgacagggtaattgggcaggaagaacatttatgtctgttcaggagatggaacagcagaaaggctttgacgattaagaggcacacccagtgagccggcccagcgcagagttgcacaaagaccaccagctttcttgcacaaggatgatggccaagtgggaaatataataagagaatgctattgaaacttctaaaactaggggtacacagctcgattcgtatcatgtctac

SEQ ID NO: 160523 - DNA, 277 bp, Homo sapiens
tccgagctggtacccctagttttagaagtttcaatagcagctagctactgcttcaaagtaaaagtgtgggaggcagtccccttaaaacaagaaagatgaggatgcctctagcagatgacagggtaattgggcaggaagaacatttatgtctgttcaggagatggaacagcagaaaggctttgacgattaagagcattgctgcctgggggttttggtatcgtgtgctattgaaacttctaaaactaggggtacacagctcgattcgtatcatgtctac

SEQ ID NO: 160524 - DNA, 515 bp, Homo sapiens
tcagggataaggtccaggctgcgttcgcggctccgggcagtcacagtcatgcacgcagctcctatttttcgcgttgctaatcgcgtccgttgcagtccaacccatcctgggccgcggcccccacagggtctgtgaggagcgcttccccccgccccgggcgcccgctacgccgcgtccgaaggaggggccgaggccgggctcatctccccgggaggactccttcggcttcgtggggtgtcatgtccattgcggcccgaggctggccgcggggctctgctggagggcgctgagagccgggccccgaggccgcacggccggagactacaactcccaggaggcaccgcggcggcggcgcccacacgtcactcgggccccgccggtggcccggggaagcagcacgggcggggggcaggggctggggccgaccgggaggccggtgccaaggatgggggccgcccggctgccccgcgcgtgaggaggccgaggggcgcgccaccccggcccggggcggccgc

SEQ ID NO: 160525 - DNA, 447 bp, Homo sapiens
tccctctgatgaagagagcaggttttattctccacaaaattaatgaagctctctagtcaccaggagttacaagattatgtcactagtaccaagacaactggtagtggttgatgactcactatttataaaccctgagtatgaacttaaggctgtctttctggagcatgggcctgagaattgccagaatgtgctgtctgcccgtggttacccattctgctgactccggtgggaacacatgttaaatgaattctggaatgtatctcgagtgatcagagccctgggtggtaaaccaaaggctctggggcacaagtgttttttgtgttttttttgtttgtttgtttgtttgttttaatcccttccagttgaaggtcatgtctggaagaggtatgggaaatgaacagatggttttatacatactatcaaataaaagttagtttttctggacca

SEQ ID NO: 160526 - DNA, 675 bp, Homo sapiens
ggaaaaattgtcttccacaaaacccatccctgttgccaaaaacactggggaccactggcttagagtattcaacaaatgttagccaaacagttagcaactgaattttctgaccctgtcagacatgctcctggaatatttggtgtctgaattattggagagtaccaagtgaccttggaaaagtcacttgatctttctgagttccagtaaaatgaagataatacatatacctcccagggttgtttgaggctaaaatgagataatatgaaagcatctatttgataatttgctcaacaaataattatggagtgcattccatgggttataacggtgaacaaaatagacaatggccttgataaaccctgagtatgaacttaaggctgtctttctggagcatgggcctgagaattgccagaatgtgctgtctgcccgtggttacccattctgctgactccggtgggaacacatgttaaatgaattctggaatgtatctcgagtgatcagagccctgggtggtaaaccaaaggctctggggcacaagtgttttttgtgttttttttgtttgtttgtttgtttgttttaatcccttccagttgaaggtcatgtctggaagaggtatgggaaatgaacagatggttttatacatactatcaaataaaagttagtttttctggacca

SEQ ID NO: 160527 - DNA, 279 bp, Homo sapiens
agccacctcaaaacaaaacaaaacaaacaacaaagaccctatatgtgtcctataaagaaaccagcatctgttgatggctagaatggagagcaagacaaccagcctgtgttcaacaagatagaatggagaagtgcctgtgtttcacccctctactattaattctcatgcctactgttctgtccagttttgtaagaaagagaaggaaagagggtgagggaggagatggagagagtgaaaggtcagactacacatccctattgatatagaatgaaaaaaaca

SEQ ID NO: 160528 - DNA, 654 bp, Homo sapiens
acttctagctcggtaccccacaccacctgagtcacaccacctgagtcacaccacctgagtcacaccacctgagtcacaccacctgagtcacaccacctgagtcacaccacctgagtggaccacctgagtcaccatgcccagcttcaagttgttttttgtttttgtttaagttagttttttaaaaagtatgtttttcttgagtgccagctgtttggaaatagtaagtttattttgactatggtatatcatcgtttgaatatatagctgatgtttgttattcaaagtagatgtgccaaaaagttcttgagagcgctgaattagtgaacactgagctagctattgctcctaggggaaatacagtattaggtttctttgagcctctggtaacatttttgttatcccattaacatatacccttgtttcatgtgtgtttctttttaaaggcactgcatttagtatatcattttagtatattcatttatattccatagcactagaacacatgtctgaaccaagctatctaacttgctttttctctgtaagacacatcacagcctccttgtgtttactagccagcacttgagccgtatgcttgggggccattttaaataatgaaatcactaacaaaaatatgaaaaccgtgccactaaatag

SEQ ID NO: 160529 - DNA, 488 bp, Homo sapiens
aaaagttattacctgaaaaaatataatgatgtgacatgccatgttatctaatcatatgacaaatgtgtctttaccatgaaaatgttatatataatatttaaaatattaatagatagagatttcagtgggtatgggattagtctttgctgtggttctaggttggagcagcaatcttaaacgtttccagcggtttcccctaaaattaaaggttctattaaacgcatgtctctctgctttctagcatatcactagatactattttacctaatgttttgccacagcatttgtgagggtcattaactagcttttaagcctcttcgtcattctactgataagccattgctacatgtcatagtattatgtataatctcccactgtaaatttggaatttggtattggttatgatgtaagtttggctgcttataagaaatctcaaaagaacagtgacttaaacaagataaaagattatttttctctcatgtaaaaat

SEQ ID NO: 160530 - DNA, 457 bp, Homo sapiens
ggattcgaggttgcagtgagcgatgatgggcccactgtactccagcctgggcaacagagggagaccccatctcttgcacaattaaacaggtaaatgagaagtatagaatacattcagaatgcacagctcgacgatcctcacaggaaagcatgcctatgcaacccccacccatcaaccaggtcgctacagaaacccccgtgccccctcccatcaccacctcaagggaacccatgtcttgacatcggatacagacgatctgcagggtcttgaactttctatctgttttacttggcctggtttccttccctcagcattttccccataagattcttccaccgtgtcccttcctgcaatagctgtttcttcttcatccttctgtagtattccactgcacgaacaccacacttgacttctccacactgatggaacgttgcattctttccgtttgggggctctc

SEQ ID NO: 160531 - DNA, 489 bp, Homo sapiens
ggattcgaggttgcagtgagcgatgatgggcccactgtactccagcctgggcaacagagggagaccccatctcttgcacaattaaacaggtaaatgagaagtatagaatacattcagaatgcacagctcgacgatcctcacaggaaagcatgcctatgcaacccccacccatcaaccaggtcgctacagaaacccccgtgccccctcccatcaccacctcaagggaacccatgtcttgacatcggatacagacgatctgcagggtcttgaactttctatctgttttacttggcctggtttccttccctcagcattttccccataagattcttccaccgtgtcccttcctgcaatagctgtttcttcttcatccttctgtagtattccactgcacgaacaccacacttgacttctccacactgatggaagcgtcgcgcatatgcgccatgcttccctcaccagtatccccagctccacgtcgtccttttc

SEQ ID NO: 160532 - DNA, 535 bp, Homo sapiens
atggggaatatagagggtagggatatggtgggggaagagcatgaattgtaatagtccaacaatacatcttccctgaaaatgtgctctattacaccagtaatttctaatgaaaaacttcattcttcacacactgtggttaagcatcatcaaatcagtactgaaaagacctttgatcgtatttgcaagatgcactaaaatgaactttcactgaccaagatttcaaagtttgtaattaatactcttgaaaaatccctgactaatctgtcaactctcaacgtctttaaccacacagttcaaaaccatgaggtggcgtacacagcccctaaactttccacatattgtcatatgattattcaagataattttccctttgggtttgcattatgaaactcaaccaactttggtaatatattcaccggtgggggaaatacaatgatttgaatgagtgtaaaatagagtatgggttttatctatctggtgccaaaaacagaacgtagggccagaggtaggaattaaatgaggcagatttcaatat

SEQ ID NO: 160533 - DNA, 572 bp, Homo sapiens
gaaatccacaaatgactaataagcatgtgaaaaatgtttaacttcattcacaattgaagacatgcaaattcaggccgggcctatggctcccacctgtaattccagcactttgggaggccgaggcaggtggatcacctgaggccgggagtttgagaccagcctggtcaacatggtgaaaccccgtctcttctaaaaatacaaaaattagcggggcgtggtggcgcatgcctgtaatcacagcttttcaggaggctgaggcagaagaatcgcttgaatgagggaggcggaggttctggtgagccaagatcacgccactgcactccagactgggcaacacagcaagactccgtaagacatgcaaattcaaacattaataaaataccatttttcatctatcagaaaagcagacatcaaaaaagttgcatccagtgcctacttcgaggtcatgatagaagcagccactcttatttgtgctgataaatacactggtttttttttttccttttttccctctctatcatcttgtaaatatactgttaagagaataaagcaaggtacagaaatatgtgaag

SEQ ID NO: 160534 - DNA, 429 bp, Homo sapiens
cgagtcatgcagcagcggctggtttagtgtgtcctgggtcctaactttgctgttgtttatctttggcatctttatttcaatcttggtgtacttttgctctgaaatttgatatttctttttgaccttccaggctgcaaatttgaatctcaagagtgaatttattccccttcaactaatacaatgacatattttaagttctaaaaatcagtcctttttaaaaattctgcttgattcgagtctccttaagagtttgtattcaagttgtaattgcattctccaggccctctattttgccaatagccttgaatttattttactaggtaatgtatttacaggtttttttaatcaaagcaatattttaaaatctatagtaaaaatctcacatgtaccctgtttccctgctctgttctccatcaactcaaaagtcac

SEQ ID NO: 160535 - DNA, 296 bp, Homo sapiens
aaaaaagaatgaaataggacttctataaatgaaaatatgactgaaatttaaaattcagtgactgaatctgtttaatacagcagattagatacagctggagaaagagtaaacacgaagatagttctagaagacagatgaaaagtaaatatccagaaagtagtccagaaagacatgaattaacaacatgactgagattaacagatacagaagacagagtaaaatactaacgtatgcttaatctgtgttccataagaagtgactagtataaactgtttgaagaaatgatggctgaaaac

SEQ ID NO: 160536 - DNA, 235 bp, Homo sapiens
gatttgctgattttctccttttgggttaattctggtatcactatttagctttttctacattagtctcttttaagactataatagtgttcaaagttagaaaaaaacactttggcaaaaagtagactagctggaactgtataggtagttccagccaacacatgccttcatgtccagaaaaagacaggttccatggaatcagtgctctcgggtctagtaagaatgaagggaagcagtg

SEQ ID NO: 160537 - DNA, 406 bp, Homo sapiens
ttacataattatttatgtagtgatttgtggactaaagagttagaaaagtttatactttacgtagttattgaggtattatgccatgctaactaaaatttgacctgtgctcttctgcagggagtggtattacttaaccatagtaactaaaatgtgcatattggaactatgcaaaatgagggctttctgtgtttttctgtagttaccttagcgtaatgaaagggcgctcaaattgggacggagagataccccactacgctggtgatatgatgaaatagttaatagtacatagttaattcacttagaagtcttagtgatttacagtcctcttttgagtgttagcatctcttattgaagaaacagcaaaattgcattcaatgttcttaagttataaaccgaccagaaagat

SEQ ID NO: 160538 - DNA, 228 bp, Homo sapiens
tcttttccaagaaaccaaggccattcctggtaagaagtatgttaactttagagtaaaactcctcaaatatcgtttttcctaggaaacagtggtagcgctgattgtgatctaaaagatcctctcagttagtgggtgagcagattagatcctcttctcccatgctggccagagagctcttccaaggctgactccttgtatctccttccaacctaggttaccatcaagcag

SEQ ID NO: 160539 - DNA, 182 bp, Homo sapiens
ctcaaatgggaaaggctcatgttgtaaattagcccttcacagttggaggcgggagagacagatcaggatcacctgagggaacttttacaagttaaacctgctgtaacccacagccgtggaggttctgatttacctgctctagtcctgccacaagcctaactttgtgcaaataagaaaaatct

SEQ ID NO: 160540 - DNA, 739 bp, Homo sapiens
acttacaagaagagaaaaacttggacatagagacatgaacacaggggaaaagcctttttgaagatggaggcagagattggagtgatgcatctccaggctaagggacaccaaggattgctggtaacaccagaagctataagaggcaggaaatgatcctcccctagagcattcagagacagtgtggccctgctgacaccctgatttcagatttctagcctccctaaatgtgagataataaaattctgttgttataagtcacaaagtttgtgggtatgcttttttggcagccctggaaaactcatgcacagcttccttcaggaagtgacatctaagccaacctctggagaaggagtatattggaagtggattctgagacagtttagtgggcagaaagtttattagagagaaccatcaggatctacatttgcgaaaggaaggggaagaaacagtattcagcagagggagaagtcaaactgtgatgccagcctcaggggaccccatggggagctctgtagctacaatggtccattcaagttgttcaaagatgctccactcagtaagtcactggatgtgggtctctcccaaaagggcatgctcttgggcaaggtggttggatccctgaagctgaggtagtccttgaaggggcttacaattgaagctgggacatcacatctttcctgagagaggatttgggtgacatctttgtgtcaccatgagccaacaaataagttaagggagt

SEQ ID NO: 160541 - DNA, 372 bp, Homo sapiens
  misc_feature (28)..(28): n is a, c, g, or t
  misc_feature (36)..(37): n is a, c, g, or t
  misc_feature (316)..(316): n is a, c, g, or t
ctatcatcatactatcatcacatcaccntcagcatnnttactatcatcaccatcaccatcatcatcgctatcatcatcatcatcatcgtgagccatagattccatcatctatgcacatttcattatctatggatgattccattcatcatcatgaatgttgagccatagattccatcagagatagtaaagggggccttgaaatattctgaggcttgtaaaagggtaaagtaaatacctaaagtaattgtgatggatagtgcttgaagtatctgctttcaagtaccatctatcaggctgtggtgagcccaagtaagcnattagttgagcagaggacaggctaatttaattataatggattttaggggggaacgg

SEQ ID NO: 160542 - DNA, 257 bp, Homo sapiens
tgctggggattacaggcgtgagccaccgtgcccggccagaatttgaactttaattcttcaaattgtatagcattttcaggtaccatcgagggcttttcttctgtacttctgtgtgttcaaatatggaccttgttccaaaaaggtccaaaaaggttgagttgtggttccctgtaatgtcaagaaatctgttaatgcatgagacccggaagatgtttgaaagtgactagtgagaattgggttggttgctgtaggatatt

SEQ ID NO: 160543 - DNA, 367 bp, Homo sapiens
ttttacaataatgcttgaaatagtgtgattacttgtggatttgtggtctggaaagttgagttgtgatagtcgtgattctattgttactcaggtggtgtcacaatcatcccagaccatatcgaatgctctttgctctgcccagtccctttgcagggcagcaggagaaagagttctgggtgataaccaggaaacaagagctactctgatctggtctaaagtagcaggtgagaggtcgggggtaagaagtttgggaagggtggagccagcatcaggaggagggtgtctggtgatggggaacgtgaagctaagaggaatacttccttttcctttttcctcagccccagctctgccttcaacatgacgccct

SEQ ID NO: 160544 - DNA, 347 bp, Homo sapiens
aggacactatggaggccggatgacagaagtccttgagtgctagatgacagagcctggatttacgaggcaggcatggagagcagaagagaaacatggctcattcattaattaagactttactgcgaacctgctatgtgtcacatccagtgttgggggccttgggattcaaagatgacccctgccagcagagtgtgcatctggtgagagatcttgatatgtaaacacataaacaaaaccaaatggtattggtgcctcaagcagagcctccaagggcacgtattatccaagattcttttacttgaagtgatagacaccaaacaccaactggcttaagtaaaaaggaaaat

SEQ ID NO: 160545 - DNA, 262 bp, Homo sapiens
actttcttaactgcctgaacccagaagtggtaaatcactttcattcacattccattctcaagtaacagtcacacagttctacctggatgcaaagagatagggagagagtctagctgcagtatgcctgggaagaaaataaatgaagtttgcagtagcaatagctagtccctccatagaccattttctgtccttagagaatttcttttggtcctacctttggtcccctggttaactacaactctcttttaaaattcatctttca

SEQ ID NO: 160546 - DNA, 173 bp, Homo sapiens
tcagtgagagactgatataagcaggcaggatgctttgattattccattagttatcattttaagcaccctaccaagatttagttctttctttctggcaactaacgttttgggggttggaggcatcccatttagaggatggtgtgtgcacaaatagattagcctgaaacctgcgt

SEQ ID NO: 160547 - DNA, 394 bp, Homo sapiens
ttctcctctaataatcttactaaatcttctggctccaacagtcccccgtctgtgggaagcatgtaaatcattatgtccatccttgttctcttcccaagtatgtcttggtattttcagctgcccgctcctcatctctaccaggtaacacatcagacgccccaaactcatgtccaaaatgaaactcatcacttacttcccagtcccttctccaaggttctctatttatattaatagccatgcatagtgttcagcacataatcagcacgcaataaatattttttaaattagtgtttgaatagaggaatagccaactgaagaatataaataccttagcctaagcgtgaagagcctaggtgagttgactttaaactcaccttttttttttttttttttt

SEQ ID NO: 160548 - DNA, 262 bp, Homo sapiens
catcaactatcattattttttgagatgcctttataaattcaccatcaaagtatggagcctctgtatctgttttttccactatatctggtaaatataaatttattacagttcttactacactgtattataatcacctgtctcataggactgaaactccctttttttgtcaccagtgcccagcacatctccacagagtaagttttcaatacatatttattagaagaatcgattaaagcagaggtcagcaaactatggcccgtgg

SEQ ID NO: 160549 - DNA, 649 bp, Homo sapiens
gcttttggtgggaaaagtacctctctgaacagaacagggcaatactgttgtcctggaaataggagagtgcatatgtaatggaagaaagaaaaaaaaaaatacctctctcaagatgaggccaccagggcttagagagcatccaaaattgtgatgtcattacagtgcagatcccagggagtttctattaatgcaaaatggctctctaagaattaaaagttgagctctccaaggtagaggtacagtatagtggtctctctcttttcccatggaggaagtcactgtggcttcctccaaaaaaataagaaataaataagaaataataataagaaataaacctcctcaaaagaaattggcttgggttctccatctgcaagccaaatgcccagagattctagggaaaacagagaaagaaagatgatgagagagagtttggaacaatacgtggtgttataatttaagggagatttgtcttccaaacaaaaatttcccaggaagattacagaattctggggcaaaatggaattctggcaaaatggaaggtggtgagatgtttctttggtcttttcaaatcttgctttttgcatactgtgtctagagaagtggtctacaaataaaagcaggaacattttgaattggtctacattagata

SEQ ID NO: 160550 - DNA, 292 bp, Homo sapiens
cttgctgccagtgggggaagggagggatcccaaacaaagactctgtcagggtttccatcacctggttcctgtgactacctggagtcgggtcagcaggaactggagagacagcatcagggattctttgggagcctgtggccccagcacggaggggtgtttgctcctggccaggcagaagcagtgagtgatggcttgtgtctgggcggtgatgaatggccctgggagaagtgagtcctggggagtcattatccgggagggcgaggtctggggtcagagagcccgaccagcagct

SEQ ID NO: 160551 - DNA, 326 bp, Homo sapiens
aaacaattaagtacagaatcacacttataaataaaataattttaataatacaaatatttaaacaatgttatttaaaaatatttcaattttaatattttatactactgttagcagtaaaaatcctataagaaacactgattgtaaagtagtagcttggacattccatggtacattaattccaaaccttggacatagattatgtgctttcagtttgttcataatttattatgaatcaatgacaaatacctacctttatatttagtgttttcactgatttttcaggctaccgttcctttttgcctaatgagttgttaacataagatatg

SEQ ID NO: 160552 - DNA, 354 bp, Homo sapiens
agtcgcctgggaatgatgccactctgcatttatctctacacctggtcctggagtcttcagcagaatctcaccattccttatcagaacataggaattacccttgtgtgcctgaccattcctgtggcctttggtgtctatgtgaattacagatggccaaaacaatccaaaatcattctcaagattggggccgttgttggtggggtcctccttctggtggtcgcagttgctggtgtggtcctggcgaaaggatcttggaattcagacatcacccttctgaccatcagtttcatctttcctttgattggccatgtcacgggttttctgctggcactttttacccaccagtcttggcaa

SEQ ID NO: 160553 - DNA, 276 bp, Homo sapiens
gcataacgttctcaagggtcatccatgatgtagccagaatcatggctgagaaggagccgtgtatttgtgtgcacatgtctgtctcaccctatggtgcctgaggctctcccagggctgcttgagaactgagtccttgtgtttttcaggtttggggtgatccacttggtgttcaccaacctgcttctgtgggccaacggcgtcctcaatgagtcaaagcaccaatgagcacaaggaatggctcatcactctgggctttgggaacataacaacaggtga

SEQ ID NO: 160554 - DNA, 432 bp, Homo sapiens
tcggattgtggccccaagcctgaacgatatttcctattcgcttacacaattctccgatccgtccctaacaaagtaggatgcgtccttgacattcacagtatgcggccaccaagacgccaccctttcctgcagtggctgattctcgaactgaaggtcaggggctctctttccagcctcgcattaacccatgccaaacatgcctgtctgccaccattctgtttttcaacataatcacttttagatgaacaatgaatacaaatccaacaacggacaaaacacagtgtaccccacacgtgaggctcaggaggtaactggtggtctctccctgcagccccccactcgctgaccccccgagaccagcacatggcaaatgacgtggactttcttgtaatgagggtttcttatgagatggtaacagccaccactgctagg

SEQ ID NO: 160555 - DNA, 301 bp, Homo sapiens
aagacgttgatggatagttgagacaaatactccaataatgattcttagcagcaggctggatggcagggccacatcctgagttaagaaacactgacaggttaaaaaaatagtttaggagtaaaatttaagaattgggaatgagatatattgatgttgatatgttcttatatatccaaaatgagatatcatgtagtttacaagtttgaagctcaaagaaacagttgagctggaaatatattcttgaggattcaagattatggaaataatatttacatttatgaggttagattactttactaag

SEQ ID NO: 160556 - DNA, 485 bp, Homo sapiens
tgtgtgtgtgtgtaacagaattttctccaagatcacagtaaattagtttgtttcttagttttcagtaattccacctttaaaataatttattaggctagaagtcccattattagttccaccaaccacataaagaagagaagacaaaactttagagacttttagtcacctattgaatccagacatcttgactgttaacgatcctagctacagaatttgctgaattagaatagattcatagaaaaaagcgaatataaatgcaatgtatgttgggtatacgttctaagctacctgaatatgatgatcacagcatgtaacaacacaaaaccgttcatttagtccttcctttgttcaaatacctaatgaaggattactacatgtccagcactgtgctgagaacttctgatataatggttatccaaaacatgcttggctctgttctcacagagcttagtgtaatggagaaaacaaactaaatgtgccagcag

SEQ ID NO: 160557 - DNA, 278 bp, Homo sapiens
aagggaacttacagacctactgagacttgctcctctgtcagatgtggcaggagggtcggggtcttggagttgttcaagtaatttcatcagttaggggttaatcctgacccaggatccagtcctgctgggccatactttcttaaagtgactatccagtgacactagcaaatgttacctcttcccgggaagaaatgacaggatgtgtttgtattttcttttacaaaggatcatgcgattttatttttactttttttttgttatagaagtggtatatgtct

SEQ ID NO: 160558 - DNA, 456 bp, Homo sapiens
agtgtgtccccaaaaattcacatctacctgaagcttgggagtgtgaccttatttggaaatgggatattggcagacgtaatttgttaagatgaggtcatactagagtagggtgggccctaaattcagtgactgatatccttacaagaagaaaagacacagagacacatacaaggcagaaggcctcatgacaggagaggcagagactggagtgatgcatccacaagccaaggaacaccgtgggctaccagaagccaggagagacaagtaaggactctctccagagccttcagagcgagcacagccctgctgatgcctggattttaggttgtggcctctagaactgtgagaactgtgagagaatcaagtcctgtagttgcaagccactgtttgtgggactcgcttacatctgccccaggacaccgagatgccagcatttgcagcagggaacccagcaag

SEQ ID NO: 160559 - DNA, 198 bp, Homo sapiens
acttttttcagtttctggactacagtgggcttccactgcctctggcctgccccacatctttttcaactcagcctataaagttctctggattcttttccaccaaactcaatcttaatcactctttagatttcaactaaaaatttcactttctagggcagcgtttaacgacctcctgactacatccagtccccctgtttt

SEQ ID NO: 160560 - DNA, 423 bp, Homo sapiens
tgtaggggctcttagaaattatgggcagaggattttgcaaggagctgaagttcggcatcagcaagcaaagacaggagccaatgaaatacggattgcgaaactattcctaattagttcattattaatgtaatcagatagctcatatagagttaatgtaatcaatagctcatatagaatatgagaatgggaggtccatctgctgtttcctcacttggtggtccccatttccgcaaggttcttatttgtgttaccatttcacgaaaatgaaagtattggtagtttttaaaaacagttcagggcttttttttttttaacaacacaacccatatatgcaagtcaaatacaattcttcatctggtgctcaaccaaagaaagagtgatacattccaatactggaggaaaaactggcctgactaaatttat

SEQ ID NO: 160561 - DNA, 727 bp, Homo sapiens
tactttccacagggaatgcgagaggccatgtaaggtgacgtatgaaagaaacttcaaaaagctgtttttgtcttcagatagctcccaaatgcagtcccttcactgtcaaccttggatactctaatgcattaaagagacttaaagtaatgacaaacaaaaattgagaaacaagcattggtgatatgtaggatacggatctagaatctgaacccagattccagcatcatgcttcagtctattcaactgtgaactgttgaacactcttccaataatgaaggcacacatacattacagagctacattagatgaaacactattaccaaaaacttcctcttctccttccactgtgcagtgtatttgcatcacaactctggagttctgtgtgtctctcacattccactctatggtttagacataaattcattagactctttgggtaaccctttccctgtattctcatataaatcactaccttattctttcagaattttcagttcataaaacacattgcgggactgttctgacaggccatgatatacaaactcttccttacagtacaagatactaaataatgcatctaagcaataacagatttttttctaatcaacactgattcaggtaaaagtcacctgtgcatattaaacctactatgtggaagtttgatgaaaaatagaatacctgtatagttccaaattaattatgaaggaatgttaactatagtggaaaa

SEQ ID NO: 160562 - DNA, 307 bp, Homo sapiens
ctgtgcccaaatgcactagcccattctcacctttccctttcccactcccacctgccatatcagaattcagaatcaaaagggggaaagtgatggggaggaaaagcacaaagcttcctattctgaacttgtggaaacagcagctacatttaagcactgcaggccccctgcccatttccatgtgatatcctttattttattttttgtttttttttgttgttgttgttttgttttgttttattttgtttttgtttttttgttttattattattatactttaagttttagggtacatgggcacaatgtgcag

SEQ ID NO: 160563 - DNA, 884 bp, Homo sapiens
actttgggaggccaagatgggcagatcacttgaggtcaggagttcgagaccagcctggccaacatggtaaaaccctgtctctactaaaaatacaaaaattagctgggcgtggtagtgggtgcctgtaatcccagctactcgggaggctgaagcaggagaatggcttgaacctgggaggcagaggctgcagtgagccgagattgtgccattgcactccagcctgggaaacagagtgaggctccatctcaaagaaaaaatcaacaccagaggttaataatctagtaactaactgtcttctatgtgccacatttttgcaagatccaagttttaaagtgagaacaagttgttcggtccccgcccagctgactgtgacaccaaggtggcggcctgcattggagatctggttccatctgacttggaaaatttggggcaccgtgggctggtgtgaaacaaattaaaagaggtgccaaacagccaggcacccagcaaggatgcccagggctcttgttcggggatttcgttaaaaaactttttggaacccacctcaaagaatgaaaagtttcctataggaaggcaggagcgagcgagataattgaactcattgatttccttcacggcttgtttgccctttcattctcttcccgaggtgctatttgttgaggaatgtctccaattgccagaaagacagtggggtgtctcatatttcctcgccacctctcctttcagccagtgctgagttctaaggcaagcctgcaatatgaatttttaatgccgagctttatggcatcactcccgcacagcccgactgcatcactctcctgagccttcagatttaatgctccaatgaacagagcaaagactggggcattcaacatcagtgagaa

SEQ ID NO: 160564 - DNA, 219 bp, Homo sapiens
attaagtacggtgtgtgcaaatagacaagagacagtttagtacagagaatatgtgcttaataaatgtgaccaggctcctctcttccttcactgaataatcagtcgtcatcttggataggatatttacaaaacgtctaattcaatgggatttccttttttttttttttttttttggaaatggagtctcgctgtgttgcccaggctggagtgaagcggtgc

SEQ ID NO: 160565 - DNA, 349 bp, Homo sapiens
cctgggctggatctcttttttatgcttctcatatcttcctccttcttgatttgcaaactgagttctgtgggggatatctaggagcttcttgaaaaatggtatgtaggagttattttttataattagctcaattattatttttagtttttttaaaaaaatttttactttaagttctgggatacatgtgcagaatgtgcaggtttgttacataggtatacatgtgcgtggtggtttgctgcacctatcaacctgtcatctaggttttaagccccgcatgcattaggcatttgtcctaatgctctcccttcccttgccccccaccccctgacaggccccggtgtgtgatgtt

SEQ ID NO: 160566 - DNA, 756 bp, Homo sapiens
tagttactaactgtatgtaatatagttattatcttaataagatagtttcataaccaggactatcttactaagtttttaaatagaagtaatgggtttcctacatgataatgtagatcaaaattgtagtttaaccaacataactgattttttcttgccttgataagaataaggtgcttcctatgaccataatataaatttggaaaatgatttttagctgtgggggtagatttatttctaagttgggaaaccagaaactattaaaaatgaaattcacaccctttaaattgtggactatgaacaggatcctatttaagataagcttctgatatttgagaaaagcatttgtttatatttttttgttttaattattggttttacaggtcaactctggcccccaaaccaccatttattataccgagtttatgaagtattctaatttaaatatagtattttgtagaaatttacacataaagaaatgttaatctttgctttgtctttccttcacttttagagccatatgataattgtaaaatcaatgtcagataataaaaatgaaacagattaagaatacctgctatagagttaacaatctatgttgctttctagatgtgattggattttgctcaggcactaaaagtctgatgagtgccaagtttatttgtcgtaagtgtgaacacccaaataaatggagagaaatatagatatttatccaagtatatatataaaacaccatgggtaaaagtttccattcaaaag

SEQ ID NO: 160567 - DNA, 206 bp, Homo sapiens
tgtaaatggagtgtaggtaatttaaaatgttggaaaattcagcttggggccagattccagagagttttaaatgtctgaataagaagcttgtgttttgtttattaagcaatggaaaatcattgaggtgtttagctgaggagtgatatagtcagagctatgttttagaagaatggatctagaagaagtgtgtatgcatataactgaat

SEQ ID NO: 160568 - DNA, 170 bp, Homo sapiens
cacagatggtaaataaacatatgaaaatatgttcaacattattagtcattaaggcaatgcaagtcaaaatcacaatgtgattctaccatacatctatcagaatgggtgaaattttaaaattgaacaaccaaatgttggagaaaatctggaggaactgaaaggcttgcgca

SEQ ID NO: 160569 - DNA, 300 bp, Homo sapiens
caaaatcttcagagctcaattccggtgctactcactgcttcctccctgccaaagtggcttctgatgctcaaagcaggaccccagctctgtcaccaccttccacgattggtaataatgcagtgatttatgtaccttgtttctcttctacattataaactccttaacaacaggaactaattaataaatatttgttgacctttataaattgaacatttcatctgatttggcccttggtggacctgggggcaatattttggggctgatgtcagaggagggttttctgaataagtaagggtcagc

SEQ ID NO: 160570 - DNA, 297 bp, Homo sapiens
cgtagcgcggcgcctcgaggacccaggattcgtagatctttaattcaacagtgtttatttttctatatcgtatgacggtgaaagctaaattctttcctctcagataaactgcctaaagcatttttaaataaaccactcttttctcaaatagacaaaatgtcctcttcattaataatttctcattcacacttgaatgtgtttctaaacaccattctgttcctgccatgtatttgcctactactttgctaatacccctttataccaaatataaatttacagcaatgcttctttttttgt

SEQ ID NO: 160571 - DNA, 328 bp, Homo sapiens
ctctttgtttgttttgcatgttgatactctattattccagtcctatttgtcaaaaagactattttttctctgttgacttacctttgcacccctgtctaaaatcaactgaccatccatgtatggggctgtttctggattctctattatcttcaattcccctctctgtctattctttcaccagtgctacactgtcttgatttctataggaagcggtgcaatcagatagcatgtgccctccaattttgttattctttttcaaacttggctattctaggtaatttacctttccatatatagtacattttaagatcagcctgtcagttagtac

SEQ ID NO: 160572 - DNA, 216 bp, Homo sapiens
aggctgagggatccgcggagttctgggcaggcgaggaggcagctgacttgctcatgactgtgggtatgcgccaccacactaggctaatttttctattttttgtagatacagggttttgccatgttgcccaggctggtttttgtttgtttgttttgttttgtttttgagacagagttttgctcttgtttcctaggctggagtgcagtggcgcgatct

SEQ ID NO: 160573 - DNA, 238 bp, Homo sapiens
ggtggaggtttgggcgaggaggcagtggggactgcatgtccagccagtcgtggttgacagcggcagcgtggccttggcagacaggttggagctgtctgggctcttacctgtgggccgccccgccgggcctcgcaacctcctggtttctccagggccccagtttctcttggcatctcaggtagagtggtggagggcttcctcttggggctcgggttgaacaggagtgggatgaaggccg

SEQ ID NO: 160574 - DNA, 497 bp, Homo sapiens
agtcgatgtagccacgagtttaaaagaacctccctgggctactgtcaggactcccaggcagggtaagtagcacctaccagccaggccctgtgagcctccagtccataagaagtcagcaatgctgccatggaatgggaaggggccctagagtaatggggacagcactggccaactttaagattagaactactgaccacgagcatactatgtgggagaatcatgatggtgatcaagactcagcccctgccctcagagagctgtcgtctaacacaggagtcccccacccccgggctgtggaccagtacccgtttgtgtccggctaggaagcaggctgcgtggcaggaagtgagggttgggtgagtgagcataaccacctgagttctgcctgttgtcacatcagcggcagtattagattctcataggagtgagaaccctattgtcaactgcgcaggcgagggatctagctcgtgtgctccttatgagaatctgatgcctga

SEQ ID NO: 160575 - DNA, 243 bp, Homo sapiens
cttgctgctagaatagaccctgcagtcactcttggaaaaaggtatgccatgtaagacaggcaagaatttgaaacatgaagggctgttcactgcagctgttcttgttatcaaaatcaaatactgcaaacaagttaactagccatccagcggagttagttcaataaataatgagctgctatgcaagtgttaaaatgccaatgcagtgtttttgtttctttgttgagatggagtcttgctctgtcg

SEQ ID NO: 160576 - DNA, 379 bp, Homo sapiens
acaggaatggtggcggacagttttatatgagaaattaaaaccattttccccccagagagaacaggtttgaccactagaaacctcttcccaattagccaatccatgtgaacatgttcccaaacagcagcttcaatttaaagtcatgagccctatttctaataacgatggaagacaagaaagaccaaattaatatccttccactggaggataaaagctcagccagatgcctactgctagcaactcttactgtgcccatagaggtacactggtctggctgagtcaggaggagggtacttgagggcaggtaggctctaaccagctctggcctatgtaaggtgagggctatcaatccttctcttttaatgactgagagccagac

SEQ ID NO: 160577 - DNA, 555 bp, Homo sapiens
tactgtccccagaaattctcatgtaagctaactcatggatatcattactctggtcaccagtctctaacaatctgagacatggatatgtaaatacatacattgcttctatattattattcccataataaaatgctacatatgtaggctcaaaggctaacaaataattcactgacagacacaaaagactgaataataaaacccaggatatcatctgttacaaaatggcatggaaaaatatctccaaaaactacaaagtagaagagagacgattgtatttaactgacccaacttttgcttctgtctcatcccctgccagtaatacatacataaacaagcacaaatatgcacacgctcccttctcaatgaacagatttaacttgccagccaactagaaagagattcaacagaaggagccaaaaatgtggtgccaactggctgtgtgacatgcacagcaatgtctcctaataaaccaacacctgacgtctagtaagtgggaatacaataagcagaagaggagtgatgtgatgtaggaaatcaacctgaaatgttcccaga

SEQ ID NO: 160578 - DNA, 715 bp, Homo sapiens
gcaggagaaacacttgaacctggaaggcagaggttgtagtgagctgagatcacgcctctggacttcagctggggtgacagagtgagactctgtttcacaataaataaaaattaaaaattaaatgggatgaacaaatggtttgaaggttgaagttagggaaagccagacatcttgctgctgtgaccacaggctgctagatggagaatgcaacctggtatgcccacttttttctgatggttctcatggctggccctctgacagacaagatagcatctcacacttgtttcctgccttattatcccaaatacattcccacagacctgaaaggccatagaattcaaaggggggaagttatgaatccacagtaaggtatttagagaagtcctcctcctccatttacttcccagctgacagcagtgaaatacctaaacagcaatattgaaagatggaccctgcccccaagaagggacaagagcccctcctttctattctgcaggctagagcaaacccaaatactcccagccccacaggcaaagagcacattcaatcacactacttgtcttttaatttccaaaggaaaaatcttaaaacgttttacatgcaatcactattttttggtaaccttccaaaagtgagccttggtgtgtttgtcttttcagctctaaaatcctttaatgagatgaaatttgaatcactaaaagagctagcatggtaa

SEQ ID NO: 160579 - DNA, 1148 bp, Homo sapiens
gttggtcaggcaggtctcgaactcccgacctcaggtgatccacccgcctcagcctcccaaaatgctgggattacaggcgtgagccactgcgcctggcggaaactatgttttaattttaatttaaattaaatttcaatgaccatatgtggctagtggcctaccatattggacggcacagatccagagggttggtcagatccatgtccagtttctttcacaagaatacttaaatgatatagcggccttcctgttacatcgttttaggaggtatagaatgtctttctggcgatatccacattgtcctttcatttaatggttctaacagccattgtcatatgattattgcctaggtctattattttgaggttttttttatgtattgaatttatgatcagttacagtcatcattcttttttgatgttcacattgtgccatctgtagccattaggaattactaagttggttcctgtattttttaattccttcccccatttatctttgatagtttcttgttttctggaatagtaagacgtcccaggctcatgtatacttcctgcgtcatgcctggaatcagccatgtttctaaggaaccgtgatccttttaatagataatactatttggaagcaacaatttggatgctgacatgttcattcctactggttgtcattgtttctgggtcttttcagtaggtagtgctaggtaaatcatgaattaatggtgatatttcaaatttataaatacaggctaattttgggttatgttatacttgtatcatttttatcttatgctgaatatcttggttcttcaaatgatgttgttacttatgtaagtatcacaacatatatgtgtttctaaataatacagtattactactaacaataagactgttaaatgcaatttgggcttttgttttccttgtctttaggacatatcccactagaatgtaatgtcaaaacactgtgcttaaagtcacttgaaagaatttttttgtgtcatacagccaccaacttaatagttaggtttttttgttctctaatgctaggattgctttttcttttattattttttaattgtgttgagagtataatgtagttttatgtaggcaaaataaggtagagtcagaattttggcttctgtccttttccct

SEQ ID NO: 160580 - DNA, 899 bp, Homo sapiens
attgatttagattttgaaagattaatccatctgttataaagatccacattgtcctttcatttaatggttctaacagccattgtcatatgattattgcctaggtctattattttgaggttttttttatgtattgaatttatgatcagttacagtcatcattcttttttgatgttcacattgtgccatctgtagccattaggaattactaagttggttcctgtattttttaattccttcccccatttatctttgatagtttcttgttttctggaatagtaagacgtcccaggctcatgtatacttcctgcgtcatgcctggaatcagccatgtttctaaggaaccgtgatccttttaatagataatactatttggaagcaacaatttggatgctgacatgttcattcctactggttgtcattgtttctgggtcttttcagtaggtagtgctaggtaaatcatgaattaatggtgatatttcaaatttataaatacaggctaattttgggttatgttatacttgtatcatttttatcttatgctgaatatcttggttcttcaaatgatgttgttacttatgtaagtatcacaacatatatgtgtttctaaataatacagtattactactaacaataagactgttaaatgcaatttgggcttttgttttccttgtctttaggacatatcccactagaatgtaatgtcaaaacactgtgcttaaagtcacttgaaagaatttttttgtgtcatacagccaccaacttaatagttaggtttttttgttctctaatgctaggattgctttttcttttattattttttaattgtgttgagagtataatgtagttttatgtaggcaaaataaggtagagtcagaattttggcttctgtccttttccct

SEQ ID NO: 160581 - DNA, 639 bp, Homo sapiens
aatgcattgtctttaaatagcagtttaaccatgttataatgtaggctttttgtcttgttccgggctggtatttgggtgccctgattgaattacttggatttaaacagcaaactgtgggctctcgacttacatagtaagggcctttactgtttctttgtaggaaatgggtttctcgcctttgaaacattttttccccttttgtagtgacagtgccactaaatagttcagcttttgtcagtcccccaggaaagtgctatcctatggcctaactagccaagccttttttctttcatttaaaagaaattagctttaatttttacctttaattacttattcaaataagacagaaatatattttccttgcaataattaaaacattgcatataggccataaatttccttattttctctgaacgatcctgattccagtcatcttgttgaataccctagttctaataattgactcttgcttttctagagaaatatttccaaatgatgctagttttgtctcttcctttcaaagttgtataccacttctttttcttgtcattttgcattgcctgggacctccagaataatgtttcatgaagtagcatgtatccatatctggttcttgactttttcatcataataattgtt

SEQ ID NO: 160582 - DNA, 278 bp, Homo sapiens
tctgactcctgaggatacacgaggtgcgttcctgtagtcccagctactcatgaggctaaggcgggagaatcactttaacctggcaggcggaggttgcagtaagccaagatggcaccactggccactgcactccagcaggggcagtagagcaagactccatctcaaaaaaaaaaaaaaaagagactcagtcataattttggattaatgacaaaaaatggaacaaggttaggattaagcaatcaattcattctgcttggataaaaatgggcttagtggag

SEQ ID NO: 160583 - DNA, 823 bp, Homo sapiens
tagggtttattccattggagggcatcacagatgaactggatttttaagtttgtcaagcagggaatgagggagaaagccattccaggtagaaagaatggtgtagtcaaagagatttgagtgtgctgcatatttcacaattatgacttcctcagcatgtgtaaagtacaaggctctcaacagactttatatattatgttaaggagtttcaacttaccctgcagccagtaaggagccctggatgcttacgttgttttgtttttacgatatctgtactggtttttcccattgcaaaattaatagaaagctcattgcaaacaattcagagaggatatatagagaagaaaatagatgtttcattatcccattatcccgatatagtaataatttacatatagtcttctagattttttttctgtgcatacgcgtacatttatttatttatttattttttgacaaggtctcactctgttccctaggatgaagtgccgtggtgcaatcatagctcattgcagcctttgaatccttgggctcaggcggtactcccgcctcagcctcccaagtagctaggactacagaggcatatcaccacaccgagctcatttattcatattttaaaaaaaatggaattgtttcatgtgtactcttttaatactggatttttaaaattactatatcatggagatacttttatatgaaatagaggctccaaaatttttccccgttaaatggtgataccataattccttaatgtaacctattaatgtttctaattttcataaagatgtaataatgaacattcttaacgtatttctttgtgtacttg

SEQ ID NO: 160584 - DNA, 932 bp, Homo sapiens
ggatggctcacaagcccagcccaccccccaaaaaaaggcaagactgcagtaacagaacaggtccatggtggccagaggttagggcaaggaaaggtatggctaaattcaggttccacacagatactggtgaagaggggcagacaggcactggtcttttttaatttttctgtgaccttgtgctactcttttgtaaagagcttgttcagtagggcacattaaaggctacttcattgctatgctgggatccagagagaaagcttggacgggactgatgatatttgaagtactcaagggaaggaaggatccagtgtgcgggaagctctttggacaaacgggaagactcacagcctcaccggtttcctctattcctagctgttaggtttaggctacttggacaaagcaacatagaaaacagccaagaaactaacccaagtgccaactttttcctctcccctaaatattaatccataccaatcgttccaatgacctacacatttattatccatctgtaatagggtggtcaccagtgggaaagtcatactaccacgtggatgccgagtcaccagtcacctttggaggccctgagagcctaagcagatctggaccctaggcctctagtcttcctctgaaaccctggagtactggaaccttccagaattccagattaggaggggccttggcagcttgagtgccaaaagggtcgacatctagagttctgttgtctaggaaaggaaactgcaaactattgggctagttttgctcacatgtctttttcaatttaatacaaaactgagagggtcgtccttagagatcatctcatctcaaactgcctagatgagaaaaccaaggccgaagaagaagtgctactattatatgatagcatctaaatttctggtctattaaaagtcacataaggccgggcgcggtggctc

SEQ ID NO: 160585 - DNA, 448 bp, Homo sapiens
cggctgttatagaggatcccagaaagatgacatttctatcccagcgtggcttttcagagaagccaaacactcaccaaccaccacacctctgatcactttctttttccttgttgtgttttggtctgtatttttcatcattattggatagagctcagtcaatatgtgtgcttttcagaatgcttatcttaaaatagccagaaggagaaggcatttgtgtctacctcacaatcttaggccttcccatagattgtggggtctctgtccaagtcattgtaccctcgtccccacttttccctctgcaaatagcttccatgtgacaatgtgacaatgtgcatgcttgtgatcctatgttcaatgaaatgttcgtagcatgccctttgcccctagctgtgggtaagactttatgtccacgaccacctgttgttcccaatgctaatattcaaggtca

SEQ ID NO: 160586 - DNA, 144 bp, Homo sapiens
ttaggaaagcaaattggacctgttagaaaactccggggccagcaggaaagcggggagcctgccctgtgtcagccaaatggttaaaggagaagagtagaatccaggggaaatcaagccgtcaagtcgttaattgactttgcctca

SEQ ID NO: 160587 - DNA, 397 bp, Homo sapiens
aagcttcaacagcatgggggtggtgatagtgtcctatttgcccttggtaaaatattaaagcgtatttcttaacccaaagagtgattggttatatgaatatatttgaaaaagttaaagcaaatttgcaaacctttacaaaatcatgtatcaattttatgctatccagtttttacgtacccatgtgtcaacatttcatatatccagttctttgggtgctggttcactttttttcatttattcaaattcagaaaaatacggacggatctaatgttaaattaaccagaaaccctggaacattcatatcttgagagggaatttgctactcttttacttttgggatttcattataaaataggctcattttatacatatgtcctgtggtctgtcttccagagtg

SEQ ID NO: 160588 - DNA, 288 bp, Homo sapiens
acgtggctggagtggcagggactatggcaaacaggagaacacacactctagctagatggggcagccattcctcaggtgtagttgattgttgccaggtgaaaagaaaagcccagttttgtcagatagtctcgttttttgagagaagccaaaaatctagattcattgaagttttccaatttgtaaatgttgtgttcaatttctttaaaacactgaaggccaaagtaaacaatctgtgagttgaatttgatccaaagtctcaactttgcaatctatgctataacatatttg

SEQ ID NO: 160589 - DNA, 371 bp, Homo sapiens
caaacatcccctcctttgtccttccacaatttatcactcttatgttaagatggtatatgagcctctaaatctaagtgtttctttgggattttacatctttttctttgatgcccctgtgcgtgcaacaatattaacatcaatacaagctgtagacctcttcccctgttaatgtcttttgttagtttaattcacagatcccagcaatagagcctaagtgggtggaggaaaagttttcctcccctacattccaaacaagctagccattatgcatttacattaagatgaaaatcaatgcaattaaatcacaaaatatggtacctaacgtaaagtaaatttaaacagttttgtattcactagttctcttgaaaaac

SEQ ID NO: 160590 - DNA, 490 bp, Homo sapiens
ccaaaggcagtatcaactacaattctgttagaaataagtaaacaattagacgttccttattaaatgtaaactctgaaagttgtcactgacgtctaataattgtcaaggctatttttaaaactttgaagaatgacttgaagctacaaaccacacaaccacagaacgatcaatcaatctaaacacaagagattttcctttaaaaatccaaaaatttctattaaaatgtcaaaatatacattagactgtagagaaacagacgctttaaacgagtatctgtgcaataccaaaagcctacttttactagtacaaaaaaaaaatcctaaaacatggtgatagggtttggaaagtcatctagctcattgctactccaagtatagtccacagaccagcaacatggaaattatttgttaaaaatgcagaatcttggccaggtatggtggctcacacctgtgatcccaacatttttgggaagccaaggcaggaggatcac

SEQ ID NO: 160591 - DNA, 380 bp, Homo sapiens
ctgcgaggtaaagtcaatgaggcgctccccagtaccactctgaggggatgctggggaaaactgcccatgagaagagggcacatgctgctggccacttgtgctaaagaacttgaagtctgataggagtgcaccctaacctggcatagaaaccctttcttcctgctgagtccctctagcaccttatactggcaaagctttacattgcaaacctccattatcacagagcaagcaatgaaagatggactcagagctgaggcgataaattgatagctagcatagcctctaaactgacttttatgactacattttatggatagaaagtgttcttatatatattgtttctttacataataggggacttattcatggctgcagatgag

SEQ ID NO: 160592 - DNA, 368 bp, Homo sapiens
aatcatcgagccggtcccttattcgtgttgcctagttgaggatctaacattttcctaatagaagatcaacaaagataaaattcagttttgaaagttatctgtggcagaatacagagggaagattagatagaatggagagaactaggccacagagaaaagttaggaagctatggtgaaaaaagatgagtgctgaactgacgcaactgtatcagtaaaataggaaagcgatgtgctgggttcaagagatatttcaagataaaataaaaatgatttgaaaactggatagatatggaacttgggcaaggagctgagaatgcttgattaatttaggctataaaaggaagacaaagtgtgtgtgtgtgtgtgtg

SEQ ID NO: 160593 - DNA, 457 bp, Homo sapiens
tttaatcacaagggtctggaatcagtactcattactgctaatagcacagttgtataaaagaagacacaatgctaccttacgctagcctgagtcagataggattaggaatagccaaaaccacaatatagttccctttttttgcttgttttcaatgatgcttagttgggatttgtcatctgaagacagcgttttttataggtcataataagaccagtctataatcaaagtctgtaagtccagtctatattttataagtccagtctataatcaaagacaccaaatttaggactatcagtctcagactttagagaaacataactgttttgataatccaggtaattttaattttctccagtggagaaagtgaaacatctccaacagattgattgtcaccaagagttttaattttttgaagaggacaaagaattccattcagcttccagagaatgagtgaatg

SEQ ID NO: 160594 - DNA, 203 bp, Homo sapiens
cctcagaccagcccttttggtaccaaccaggagcttgttagaaacatagaatctcagctctacctcaaacccactacgttagaatctccactttaataagatccttaggtgattggtatgtacactgaagtctgggacaccttgatctctagcaaggaccagcaaactctgtagagggccagagagtaaatatttcaggcttg

SEQ ID NO: 160595 - DNA, 227 bp, Homo sapiens
gagatgtagaagtagttccagaaattcacagtaaggagttgaaggatattccactcactgaagagctatcttttgtcatacttgcaataaaaaacaaaacaaagcaaaacaaaatacttcagattctcatagtaactaatcttgagatgagaagagataaaagacaagtgatagctcatccactgtgaactttctgatacagaatatatttttcctctgtcttaaag

SEQ ID NO: 160596 - DNA, 287 bp, Homo sapiens
atttgggacacactgatgtttcagcccctccctcttaggaattctgatttgaaaatcactgtatctactctgtattcctatgagagagactaaaagattttgttcagatttgctttcttctgattgcaaataggaacatgtatggtttttttgggtgcactttttcagaccagacgccaggtcattctgacccaccccactcctctcctgagaatcactgacttagtgcagttatttgagggcaaaaagcactttttttcccagcacaaagtaggtgctaaacaaag

SEQ ID NO: 160597 - DNA, 439 bp, Homo sapiens
cacatggttccctgctaatcattttacaaataaacaaccaagtagctaacctagagcccacaaaagcagagtaaaaattctaacacttgttgaaataaaaatgttcatatacccatgataaaaagaaaatgcttaagtattcaaacacaagcagcaaattacagctactgagaacatcattgtaagcaaactgaggcacagaaaaaggtgctgatgaggatctgaaccacctaagctgcagaaacccactgggtggtttcctaggttccaagttgggattatctttcagaatcttctagaagagatcacataacactgttacaaaggatctggaaaaagggacccctgctttatcactctggctctccagtcatgcttgacatttggcagtgactatctccattcaactcaattccccacccctcaactagctgacatt

SEQ ID NO: 160598 - DNA, 259 bp, Homo sapiens
gttgctgtcccccaccccaccctcaagaaaaattctccagacagactaatgaggaggattgatggtgctaccacccttttcactagggaggcatctcagaagccgaggagacgagaaaaaacaacatcaacttttaatcgagattgcagattcagaaaagattcataagtgaaatgattccctaaggaaatataaaaagttacttacggcattgctaaattgggcatgcttcaatcaggggctgttgagaaatcattaa

SEQ ID NO: 160599 - DNA, 243 bp, Homo sapiens
ccccaggtctccaggtgtgcagggctgtgctaggctagctgactcttgctgggacctgttgcctgcgcagcccttgccaagccagttccagtaccccgccaactgcatcttgatgctgctctgggtgggctcattgaagagtgagcactgggctgtttcatctaagctccacagcactccaggggatgggatgagctaagcatcagacgggggaggccaagaagctggagctgctctagggaa

SEQ ID NO: 160600 - DNA, 459 bp, Homo sapiens
aaaaggaagccaggagccacgcctcctccgtgactgcggatcctgggccaatgtttcgctgctgcagtgagacccctgactttgtgtgggcagtgggaccaactgggcatgtgcagtgatcagttgctaaatattggcactctcattagccttgggatctggaaacctccatccaccagacacagcccatttccagctcacccgctctccacactaggactctgaacaccctttcttcatgcctcttctccttcctaactgcctgcctgctccagcaggcctcaggccacttcttttttgtgtgccaccacacccagtggtgtatttaaaataacaaaagctggaggaacatggtggcacctacctataatcccaacactttgggagtctgaggcaggaggatcacttaagcccagaagttcaagaccagcctgggaaacatgttgagacctcaactct

SEQ ID NO: 160601 - DNA, 228 bp, Homo sapiens
caagacagtcaaggatacagaaaggttaagtgactcatctgatcagatcatctctgggtgatttgggatgtgaaaaccacagatttcttctcgaactcgcatggtgccagactagcaactaaattatataacatctcttatttcgcttcaagtatcaatctaacgcagttataaaaatgaatttctagaacttggttgaattttctgtgaactagctacaacaaacca

SEQ ID NO: 160602 - DNA, 239 bp, Homo sapiens
ttttgattttccatcagtagagacagagtccctctgtgttgcccaggctgttctcaaactcctggcctcaagcaaccctcccgcctcatactcccaaatgctaggattacaggcgtgagccacggtgcctggcctgtgcctcttgttgtacagaaaatttttatatttgtgtggccaaatctggtttagtgagttactgagttgagttctagataaagtttcaatcacttggcttagcc

SEQ ID NO: 160603 - DNA, 171 bp, Homo sapiens
ctggcctggggagaagcaaccatgtcttgtgcacagccgattaccaccatttagaagtgttgagcacataacaaacaaagctcaatggcagcttaactgaatgaaccaatgagtcaaccagtcagtctatgttctcatttcatagtgaacttcacctccaccctctccttc

SEQ ID NO: 160604 - DNA, 363 bp, Homo sapiens
gcattgaagactaatgtgatctttagcagtgtttgttccggggttgctactgtaacattgtagctattgcttttataaaagatgttcttatgcctatgtcccaacactgccatcagccagcagcaagtttagctacagtcatgtggtcctgtcttataatttcatttatcatctccctaaccacagtaacaaattttgtttttccctcaagagatcatggtgaccttcaggtgaagaggactaattctgagtgtcctcagtagcaagtgctggggtaggacactcagcctttcagttatagcactcacttttttaaccctcttttccagtgctattgaaataaaaccaactccttatgaaggc

SEQ ID NO: 160605 - DNA, 389 bp, Homo sapiens
ttgcaaatcttaagaattctacgtgctcagacaaatagctgctgcaaatacttaatgcaatgaagccactttttacttgactttttttttaaagtcctttcccaaactgtggtattattacctgtaacataatgaacattaaaattgattttcaccagctcatatgatttgcctacacataaggctttaatgcagagtaaagaacagattagaatagcattggcctcaacttttaaaatagcttttctcttcctactgggtgaatgagtacatgaagccacttgattcacacagggaaacttaattccttcctcattctctgccatctatccatctacctgttttgtattatttttaattgctttgatgctgcactcctgctactctac

SEQ ID NO: 160606 - DNA, 293 bp, Homo sapiens
aagctgcctatcgtcaatgatcgcgatgagctggtggccattatcacctgcaccgcgctgaagaaccgagactaccctgtggcctccaaggattcccatgagcagctgctgggcggggcagctgtgggtacccatgaggatgacaaataccacctggacctgctcacccaggtaggcgtcaatgtcataggcttggactcgtcccaagggaactcggtgtatcagatcgccatggtgcattacatcaaacaaaagtaaccccacctccaggtgattggggggaacgtggtgac

SEQ ID NO: 160607 - DNA, 343 bp, Homo sapiens
tgtagctgttctagaggataccggaaggcagattgcaacaggaaggcagtggcagggagatgtgtggcaacaggagcaggcaggtgcagcgggtggtgctggcaatatgtgtgagtcctagagttccattctgatggcttctgctttctaggtgggataggaggtaataggcatcatcggctgagaacgagagtgaggcaagaggaatgggaaattttaggagagggaaaaaaagatgtgaaatcgttatctaggagaatgggagagtcaaagaattagggaaactcaatgactgccagtcagcaccaaggttcaggtaacactacgttttgcagttatgcag

SEQ ID NO: 160608 - DNA, 500 bp, Homo sapiens
  misc_feature (178)..(178): n is a, c, g, or t
  misc_feature (192)..(192): n is a, c, g, or t
  misc_feature (215)..(215): n is a, c, g, or t
  misc_feature (288)..(288): n is a, c, g, or t
ggccttttgaacaacaaaataaaattggaaatgctaatgttttgagccaactaaaggaggaaaataaaaatgtcaccatggtaacaaagctgctttctagatggtttcctaagatatgcctgaactagaagcagatgtctgatttgagaatcttgcctccttcatttaagtatatctnttggaattgttccnagtataaaaatttatattctatngttatatatttcgtgttataaactatacatttcatatcagttacaattgtgcaaggaaaatccacttgtcttnctttttttgaagtgtggctataaccaattgctttatatcatcaaacttccttctgcaaagcagagttgtttcctttaaaaatccatttcttttttaatggtaggtttggagacagtgtttcaccatgtgggccaggatggtctcgaactcctgacctcaagtgatctgcccgcctctgcctcccaaagggcggggatcacaggcatgagcca

SEQ ID NO: 160609 - DNA, 451 bp, Homo sapiens
agtacgggtgtaatcaatgatgacctgcctcttaatttatcaggtggcaaactgaggctgtgggcactgaaagagacctagcattttctagggcaccgctctcctgggtacgctggcgacaaccagcggcctcggcttgggagctgagccactggccggaatctgccgctgagcgaatgcactcgctcagacccgacttctccctctagggcgcggctcccgggcaggtcccttcacgagtcttccatccgagcagagcagggtcccgcggaggcgccgaccgggcgcgaggcctcctgcctgcccaggttccccggcgaccctgagcgaaccctctcggggtcagctccgtctaggctgagaagggaacggcggaaggcggagtgcgcccccgggagcccggagctgggactgcagctcccatggggccaagttcacggggtgcggccgc

SEQ ID NO: 160610 - DNA, 310 bp, Homo sapiens
tagccaccacagcaaaataggaatacaaaggagcttccttaatccgattaaaagctcagtaaacaccatacttaatagtgaaatgtcgaaagggttccctattttaagggtataatttatttatattttgaaacaatctcaaatttatagaaaaattccaagtatttccagaaatctatctttcttgaaccatttgacagtacactgctgatctgatataccaacaaccccaaatactttggtgaacattttctataaacatggacactcacaaatatgaccgtgatacgatcatcaaaaaatggtaact

SEQ ID NO: 160611 - DNA, 290 bp, Homo sapiens
ccctgctctctcaggtcttctccccaggtggcttcagcatcaatcctccatgctgccacagacccagtgtgaacactttcctagcacaccccacatttttccggaaattttctgtgtccactgcacacatgaagggatgcaggctccttcagggcccttattcagccccgcactctgcacaacatctgacacacagtagatgcttaaataaacatgttgaggcactagattgaatggacaaactgagacctgttacaaaggaagaatcaacaagccttgataatgtggaa

SEQ ID NO: 160612 - DNA, 338 bp, Homo sapiens
cagaaaagtaaaaatcaactagggaaaaaaacgtgaatacttgaatatgacggactttttttttaatagaagttcagttttgtctgctttcttaagtttgtgtagcctttcttcttaggaagacattctacaattacctgctctgctcccaaagtgaaattcctattttgctaaagcagaacagaaagaaacctttccaagtttctataatttgtatcacattctgaagtcccagttactgtaatagctgcaaagaagcaatacaaggtggagggtctgagagggagagaaaaatgactaaagtgcaacatagctgaaaaattggctggctggaaatt

SEQ ID NO: 160613 - DNA, 778 bp, Homo sapiens
  misc_feature (725)..(726): n is a, c, g, or t
  misc_feature (745)..(745): n is a, c, g, or t
  misc_feature (752)..(752): n is a, c, g, or t
ctgagaaaacaaatgacttaaacctggagtcatttccatatcattgcacagggaaaccaaacagaacccgaaagtctcagtgagttggaaagaaagtggagtccacagaagatagaagtttcagagaagaatactagggaggaaagaactgaacagacaagaagctccagaaatctgcattgactctttgacttaataccagactgatcatgcttatgataaaactcaacatggtggggctaagatagtaagagctttaagttaaagaattcccaaaactaatacagagctaggaattgttgagaccctactagacacttcggagagaccacagtcttgctacctcctgtcctatgtctgagacttgagagttattcaatagagaccctctaagagacacgcctgaatagtaaaactaaactagccgtagcgtaacagccactctaaaccttactggaaaaaaaacttttaaactagttttgaaggataaagttgatccacaaataacttatctgcctacaaaaccagtctaacaatcttaaaaggaatatgacaaaatccaacactcagcaacataaaatttgctatgtctgatatattgtctaaattcagtagccataagcagcagaaaaatgtgacctacataaaggagcaaatcaatgagtaaaaaactgactagaaaatgacattctagaatgaaaaacaagagcattaagcaggattannccctttaaaaagtttaaanttatgancatagtttaattgttgcgcttaaagc

SEQ ID NO: 160614 - DNA, 264 bp, Homo sapiens
atgaaaataaaactgaggggtcaagaacagatgtgagctggcaaaagaatcaataaacttgtagaccaacaggagattctaatctgaaaaatggacaattttaaaaaataaaagacaagtaatcctcagaaatcttgtgcaacaccatcaaacacatcaatatatgcataatgggagtaaaagtgggtgaagaaaagcagaatgggctagaaagactatttgtagaaataatgtccaaaaaatgttcaaatggtgaggaaaact

SEQ ID NO: 160615 - DNA, 480 bp, Homo sapiens
ggatggagtgcagaaaatcacttgtaagcacaaagagtgtggcaagtgatgtgaggtagctaactggaatccacattgaggaccagctgcgtgcttggaacagcagctccaagtgtcactgcatcatcgttgagagttattgacggtgaaaacacaaacatattaccgaacactaccttgctagctttgtggccctagcgaagtcacttcaattctctgcctcagtgtccatatttgttaatgaggaaaataatagtacccacctcacaggtttgtggtgaagattaaacacttagagaaaacataaaatgcctcttgtgaagtaagtattttttgaatattagccatgattatgttattgaatcaatgttatgtatcaagctgttaccgaattatatcggtgttagccgttgctgtcatcatctccattatccttgtatttcagacatgtgagctttggaaattaaaatctttgaaaat

SEQ ID NO: 160616 - DNA, 370 bp, Homo sapiens
tcagtgtgtgtcatgagtccacatctggttacccagaaagagttaccaggagagggactcccttcccggaaggcacttggcttacatagttcccagagctagaggtcagggcaggtctggaaaagagccacaaaaactctgaaaagcacattcctcgggtgccaaggcctggccaaggtttccagaacagcgttccccaggcccctgacctgcctgccatgcacggacacggccatacatggctctgaggactgagtcatgctgataaatttttctgtttcttggtttccatttgtgctcctgtaactagctcacagggctcttgtaaggattaagttaaaatatataaagcgactagaggccaggcgag

SEQ ID NO: 160617 - DNA, 137 bp, Homo sapiens
cctcaggtgctctgcccacctcggcctcccaaactgctgagattacaggcgtgagcctcattttctacttagtattcagagtgaccattctgagatataaatcatatctatttacttccctgcttaacaatccttca

SEQ ID NO: 160618 - DNA, 264 bp, Homo sapiens
atctttcaacaccataggttggaatgtaattctggctgtctgtccaaaccttattaaagttcaaacctattccttctttctggaatttcagtaacatgtgtagttttaaactgaaaaagtttaggcaagacaacatatttgaaagtacattctaaagtgctatataaatattattatgaacaacaactaaaaataagaacaagagggaaggaattaacaagaaattctagatatttttgctatgggaagacattagactgaaaa

SEQ ID NO: 160619 - DNA, 336 bp, Homo sapiens
ttcattctacattagcatatattcatataatagtgatgttgctaatactgccaactgatttccaaaatggaattctgaaacaaatccaatttaaatcagttccatcttttaatttacattaaatgttaaagagcttgtatatctgattctatcaataattttaattactattaaaaactataaaattcaaatttcattcaattcagtctatcttaagataatacaaaagaatatcaataaacagtaggaatgcggagagattgttaaaagttattcaaaggtttaaagtaatgagcactcagtatatttttttctttaagatatcaagaacataaa

SEQ ID NO: 160620 - DNA, 117 bp, Homo sapiens
gatagaagaatggatccatgaaagaacagagagacaaatgatgcatcatggatagatgaaaagagatgggtggaaggataaagagatggatgtgtgaaaggatggatgtacagatgg

SEQ ID NO: 160621 - DNA, 737 bp, Homo sapiens
taaagctaagtgatgggagttcactaaattattctatttttctgtttgaaatcctccatcatgaaatgtttcattttgtttttaagtaagtttccaaagatctttatcattaatatactctgtagataaaatgacaggctgcccttaagctgtcaaactctggtggctcaaccaggtatgctccacactgagcccaacagtgtagactcactcaatgcaggccccttcacagaaggcacacaaaaggcccctcagaaaacaatcagagccccagttcagaccaccaggcagcagtgcagggagctgtgcggcctagtctctctcacattaggtatccctaatgtgaaaatccaaaatccaaaatgttccaaaatcagaaacttcttgagcagcagcaacatgataccacaagtggaaaactccacacctgacttcatgcaacggggtcacaatcaaaatgcagtcaaatcttagttttgtacacaaacttatttaaaatattatataaaattatcttcaagctatgggtgtaaggtatacacaaaacataaatgaatttcacgtttagacttgggttccatccccaagatatctcattatgcatatgcaaacactgaaaaatccaaaaaagtctactatctaaaagatttctagtcccaagcagttcagacaagggatactcaacctgtatgatatccaagcttccaagttgcctgctcaactcctcactataccag

SEQ ID NO: 160622 - DNA, 782 bp, Homo sapiens
gtaacaagagcaggcctggagagagggaggttgggtttgctgctctttttcttaaattctctgcctggaagggagtgaaggtcctggaggtcacctgatctagttggactccttgcccaggcttgcttccctcctctacttcaacccagaaaggctgatgtggtcggccttccccccagtaacttagaccagtatgaagaggggccctcggaggcttcagagaacaggcatttaacttcatttttgagagttgagaagaaagagcaagggcatcgggcttagctcatcagaagcttctctcttgagctttatgcctggagggctgagcataatgaaaatccaaagccccaaagagcagtgatggtctcctgggtctagaagacttggatgtgatgctttaagaaggggtaagatggttgtctcaaacctggcccttttgacagactgacattagccagggctgacagctctaggcccttttgacagagtgacagcagccagggctgacagctctagtttcccctatgggtgtaactgggtctggtggtgtgcggcaccaagaaggggcactcaggccaggctcttggtgggctggtagtgcgctacgatatgctgttggaacagtcactctctatgtaacctccacgtttccaacagtgacaaggattttgcccatcatatcgtggtcttttcttctctgtctgtatttttcctttccttgtcctggttctctgtccctcactaacttcacggcgattcttatcgcttcgcaagacaggatt

SEQ ID NO: 160623 - DNA, 307 bp, Homo sapiens
agctggatttcacttgaaacgtttctaaatttctagaagaataaaagcagaaacactaaaaaaaaattgctgttaggatatcttcccctcaactgtccaaattaaaaatacttctatcatttcacaaggcttttcttatggtgttaaaggctaggtgttcacttaaaaaatctctcaaatgctaaaattcaaataactagacaaatcacttcagctatcccaggctaagatacatacattggcaatgtacacctgtaactaaggggtatattcatagctccaaaagggaatctaaaggcagcctaag

SEQ ID NO: 160624 - DNA, 718 bp, Homo sapiens
agggcagtgtggaaaggggtgggagtcactttacagccaagaaacctggcaaactgactgcctcggcccagtgatcacggtcagcaccagcagccataagtcacgttgacggcctgtgcccttgacatcgtgtgacgagaagggcgctccagctgtgacagactccagcaaacccaatcgagagtctacgggatgtccgaccagtcctcaaaaccgtcacagtcacgagaaacaagaaactgtcatagtcgagaggagcctgaggggatgtgactgctaaatgtcacgtgggatcctggatgaggtcctggggcaggaaagaacatgagggaaagactaaggaagcggctggggcgtggactagaggtaatgggaacattcatcgtcaccagcatttcatactcacttgcggtggtacccataggggaaactgggagggggccatatgggaacttggtattatccttgtaatttttctgtaaacctaaaactgttctgaaaaataaaattcattttaaaaagaaagtggcaaacctgggttaggctctctgctggatttgtaatcttgctgtcggtgagatggatctggatgtccctggcccagctgccaggaggatctctgcctcagtggggctccaggccacctcctgttcggtgacctgctcgttgtcgcgctctgccggctgggggaatggagcagtgctgggtgaggctcagg

SEQ ID NO: 160625 - DNA, 571 bp, Homo sapiens
ttgtggtggaatacaaagctaatcaatagtgggcagctctttttcatattaattagccagctgtgcaggaataaaaaatacatcaagctcactcgtgctctctggggatgctcactttgctggtgcaatgacagcagctcccgggaaccaccacactctgccagggactgggcttctgcgggctgtcacagtctgtggtcctggaagtgctctgtctgtgaacacacttcggatttgtctcagagctcttaggctccttggactaagaccagtctcagctaacagctcggcagcacttctccttcagtgcccatgtgtcaagggggcctagggtagtgggaggatgcaggttcggagtcaggcgggtatctgtgtttgaattcagccttattaggcaggtggcctgacagctggcacttaatttgtttgagcccctatttctgtagctgcaaaaaaagaaaataccaattttatagcgattttaagaggagaatgaaatgagatagtgtatttgaataggcttatgtaatatctgacctgtaataagtactaaatgataattattaaataa

SEQ ID NO: 160626 - DNA, 495 bp, Homo sapiens
ctggctgttgttgtgtctttaaagtttcacctgggtagtcaaagatggatcatgggtctcagtggagagctgagccaggcaggagctgactaagggtgagaggtgggagttagcagcctctgaacatctgtgtaccatgggaccccctttcctcctgcatggtaccccagacaaggagcctagtaagagatactaatggcttgttgtccagagatgttcaaactgcagagaaagataagacaacaagcattggcctccaatcatgatgacagataggaggaggtgggagctccttagcagtgctggttggccttccatgttctactgtgggccatctctgccatgtactgtaggctactagcttctatattaaagaatgcaagaggggccaggagcggaggctcatgcctgtaatctcagcactttgggaggccaaggtgggcagatcacttgaggtcaggagtttgtgaccagcctggccaacatggtgaaact

SEQ ID NO: 160627 - DNA, 280 bp, Homo sapiens
taaatctccttcaaatttaatctcaaaaacactttccaattttggcatttccttggctattctcactgcctctacttagttcacccacaccccagtataatctctacattgctagaattatctgtcactttccacttcaaaacctctactggttcccaactaccttgaaacacaaactaaattttcttgcatggactggccacagtgcctcacagcaaggccaaactaacctttgtcctggccacttgcagtgcttccctctccatgaacatctcaccat

SEQ ID NO: 160628 - DNA, 545 bp, Homo sapiens
acaagatttggctggggacacagattcaaaccacaactatcagctataaacatctaacacaagccttttaggaactactaaagaataacactataggctgcacgtggtggctcatgcctgtaatcccaacgctttgggaagccgaggccagcctggacaacgtggcaaaaccctgtctctaccaaaaatagaaaaaaattttttaaaacaagaaaaaaaatatagaattggtatcttggccacacctctttccctgtggttgagtttttttttctttttttttttccctgtcctttccctttttttggagacaagatctcttcgtcacctaggctggagtgcagtgacatgatcaaggcttgctgcagtgtcaatctcctgggcttaaaggatcctcctgtctcagtctcccaagtagctgggactggaggtaggtgacactagcctggctcactttaaaaacattttttgtagagataaggtctagccatgttgcccagggtggtctcaaactcctgggctcaagccatcctccctcctcagcc

SEQ ID NO: 160629 - DNA, 399 bp, Homo sapiens
tgcaagggaaaaggagaaaaagagatctatttttgtatctagttcctgaaactaaagctaaaaacagattagtattcaaaaaaaatcacgtagtggaaatcataacttccaacttattagaaaactcctagagtctcagggatttttttcctcccaattttttctctatcaacacggtgtctcatgaaaaggaaacagtcacaagccactgctccttctagtatcaggtattaatttcagtaagacgactttaataattcagaaatatcgactcaaacaaaacaatgtgtgtggtgctgcctaagaaccgacctagcgatgcatggtcgtggtcattactttgggaattgagtacgctagggtttgggaagacaaaacgcagtgtgaggcatcaatgaa

SEQ ID NO: 160630 - DNA, 498 bp, Homo sapiens
ttatagagtacctacagtcaacaaatatttgtagagtatctaccaatggctagatcctgctctgggcattaaaattatagttgtgagtaaatttctgttttcatggagattatattctagtgggatgaagacagataataaagacataaatcagtaagataatatcagaattgttaagaaagaacttggtaatgtaaaaggtctcactgagagggtgaggtgacactggagttgtgacctgagtgttcagaggaaacttccatatgaataccttgggattaaagtgttccaggcagagggtacagccagtgcaaatgtcctgaggcaggaatgagccagataagttggagaaagcccatcagcgaagcctcagctaggtgagggagggtgagaatgttgtgaggtgaagttgaagagtctggcaggcaggggaccaggaagggctcttaggacatgacgaatagggagtctggattcattccaagtaaaatggaaaac

SEQ ID NO: 160631 - DNA, 356 bp, Homo sapiens
aaagtgggcaatggagccccatcccagcactatcctctgcagtgcgaacaagtggccagtcccttggggagccctggattctgaccacagcccctcccctttctccttcatctcattcgccctcaccaaccctcccctggaatggagagatctgcattggcattccacctgtgcctctcccctgcgcttcagaagtacatgtatgttcctaccatgtgggctccagacacatcgaattcatcactttccgcagagctgcagtccccatcacccctgtcaccagcatggctgacatctctgtctgcagatggacaacctctccctcccctctgctccaccacttcctctcctccgtt

SEQ ID NO: 160632 - DNA, 411 bp, Homo sapiens
aattagccatgtatggtggtgtgtccctggagtcctagctatatgggaggctaataaggtgaagaattgcttgtgtccaggaggtcatggctgcagtgggttatgatcacaccaatgcactccagcctgggcaacagagtgagaccctgtctcttaaaaaaatttttttttttcctagcatgactcagaagagaagtcagagagatgtgctctggctaacctggaagaagaaagcaaacaatgtatgttgtaaattgcctatggtgaccccaaggcaaggaacttcaggtgtcttctaggagctgtgagctagaaggaaaatggaggtagaggtcatcatcctgcaacacccacctcccactccctactcaaaatgaattttatcaaaaaccagcaagcttgggtgaggac

SEQ ID NO: 160633 - DNA, 244 bp, Homo sapiens
gggcgggggcagggaggcggacggtccaggcgcagtccgtagggtgaaggtgtggagctggagtgcatgctgagcttggcttcctcaggtcctggcctcaccgggatgcccaggcgacaatgtatggcatcagctgtgagagcatgggcctggggtcagggacctgggctcaagtgtggtcgtgaacaaggcaccttgctttcccaggccttggtcttcacctctgtaaaatgggctgacagcc

SEQ ID NO: 160634 - DNA, 387 bp, Homo sapiens
tgctctgttgcctaggttggagtgcagtggcgcgatctcagctcactgcaacctccgcctcttgagttcaagcaatcctcctgtctcagcctctgagtagttgggattacaggccagcgccaccacgcctggctaatttttgtattattagtagagacggggttttaccatgttggccaggctggtctcaaccttctgagcttgtgatcctcccgcctcagcctcccaaagtgctgggattacaggcgtgagccactgcacccagccggggctcttggttttataagaaatttaatcacaagtcaaaatagactgtatttcctaagtaaccttagtatttttttactttctaaggaaaaagaaaaagacctccctttttaagaggaa

SEQ ID NO: 160635 - DNA, 325 bp, Homo sapiens
tgggcccaagtgtgtgaggcgtgagcacaggctgcgcatctgtccctgccttcataagactttcctgaaaggtaaattcacttaggcagaagcctcgaactccagcccgtggaagaaagtggggtcccattccgatgtgagctcatgatacatggaggaattaggcagttctgcatccgagctgtgctgcccactgggagcggctgaggggatgcaggctgggtcactggagttgtacaaatacagacagacaacatagcaaagctgcaaagagccaggctctgagtggacacacctgggttccaatcctcacctgtactggctg

SEQ ID NO: 160636 - DNA, 803 bp, Homo sapiens
ttactttgtgccaagccctttattgagataggcactattattatccccattttatagaagaaaccaaggcttagaaagcttaccagcagttggccaactgcggtgggctcatgcctgtaatcctaccacgttgggaggccgaggcaggtggatcacaaggtcaggaaatagagaccatcctagccaacatggtgaaaccacatctccactaaaatacaaaaattagccgggcgtggtggtgctgcctgtagccccagctactcaggaggctgaggcaggggaatcgcttgaacttattccaataaaactgctccttattggtaattgtgataataaaattgtaccatacttaaaaaaaaaaaaaaaacacaaaaaccaaaaaaaaaaaaaaacaaagaagcacaaaaacaaaaaaaaaaaaagaaacaagaagcaaaaagaggaggggcgggccacccataaaaccccccgcggcggggcggaacaacgaacgacgcaccccgcctgtgaagaaggggcgccccaacaagagacggaccaaaataaacagcacagggaagcgtggacgcgcgacaccaaccacgccgactgcgcgcggacaacacaaggccacgagcgggatctagtcgagaaaagacacaacaatccacgggggcggacgtcaacaatacgtggacgaccacacacacgacgcaaaaatgaccgaccgagcagcaaagacacaacagacgatgctacgaccggcaacaacaaccaatgcgcggcggcgacaaacaccgcaacgaggagacagagacaatctc

SEQ ID NO: 160637 - DNA, 100 bp, Homo sapiens
ccagaagggattctgcctaagtgtccgcctcacagagctgtactgtcttctcctggccaactttcaagatcaatttgattttcactgtcatcacaggctg

SEQ ID NO: 160638 - DNA, 158 bp, Homo sapiens
tgtgatacaagatgattgaggaaagacagggaaatgcaaagagagaggtaccaggaatagaacattgttaacagctggcatgccctgactcagggaatggaggggtatttagcctgtggatgctaaggatgtatagaatatttaccaattctcagagt

SEQ ID NO: 160639 - DNA, 432 bp, Homo sapiens
caaagacctatgacctatgcagcttattcttaaatacccagcctgtttgagggccagaatcctgagattacagtttatttaaggccaaaaggcaacaaaataagcccagtgaatgtgggtgtgtgactcctccagtcaacacataacctgaatttaaaacttttgtgctacaacaaatacaaggcttgtttgattaatggatttggttcctggaaactgtcttagcagaatttactttaggctttcaattttgtgctacgaaataagaagtttaaccaggatatcagttgttgcatttcctttgctattttcctaagagcaagactggaaagttttatgacactgtgttctcaggctggcagggtttaaacaaacaaggttccctggacatgagggaaggttgcctttgttcttgtcatagctgtgtcttgg

SEQ ID NO: 160640 - DNA, 340 bp, Homo sapiens
ttcccttctattcctactttgaccatttttatgatgaaaacgtgttggattttgtcaggtgattgaagatgctacactgctggcttagaacatggaggaaggagcccatgagccacagaatgcagctctagaagctggaaatagcaaaagaacactttctccacatagagactctagaaggaacacagccctgctggcactttgatttttaaacaagtgaaagtcattttggacttttgacttccagaaatgataacatgataataaatttgtgttgtcttaagccactgagtttgtgataatttgttgttaacagcaataggaaactaatagagtagta

SEQ ID NO: 160641 - DNA, 128 bp, Homo sapiens
aacccagccgtgtcttgttccctgtgagcctccgggtccggcggggtcctcaggggaacaggtgaggccccccagctcctgagtccagccctaggtctgtgcggctccttagggggcggcatggggct

SEQ ID NO: 160642 - DNA, 342 bp, Homo sapiens
tgcccaaaaggaaagtcactggaaacagaagatgtcatttccaagtggctctaaactaataagatctgttaaagggacaaaccagcccaaggaacacatcacgtgcccctccatctgtcagggacaggagccaacgggcatccgatgtgcactggtgcagcacccactgaggcacaggcagtgcccccgcggctcatccacatatccctggagggacacatcaccaaaggccaaataaaaacgcagctggaaacgccagcatccccggcacagctgcttcttattaaaagaaaaatggcacggggcgcctacatgcctgtggagtctgcttactgagaaaac

SEQ ID NO: 160643 - DNA, 327 bp, Homo sapiens
ctcataaacaaattcacacgctgactctttgggcaaaagaaaggcaaagattaaacaggtgcaacccagcaggatacacacgcagaactagactccgctcagcaactccatgccacagaaggccgctttcggaaccgcaaggatcagttttgggttctgcttgactttgatgataaatatggaattaaaaaatcaatctatgaaaatgttatttaatctcagaaatctttcctgccttattcattaatgtgattatttgtttcttagtcaatgccaccttcttctataactttctacgtagagggggaaaagccccagtatttagca

SEQ ID NO: 160644 - DNA, 355 bp, Homo sapiens
aaaataatatgaagctattctaaactgaagccttcacagacaatttcctggcatacaaatgcagttatagaggagatggcgtgtgggtgacattatacacaaccaccctgtgagatttagtatccctattttaagggaggaaagtctgaaaaactgacttgtccaaggtcatctgctgccacagtgtcacaattccaacccctcttctcctccatatcagtgattttaacaccatagggactgcacactcttttatacaaatctcatttttaaaatctatttgaaactccgtctaaattgtacttaaaaataatggcctcaaataatattaacaaataatctgtctattggagat

SEQ ID NO: 160645 - DNA, 537 bp, Homo sapiens
atgaaaagaatgaacttcaagatcaggttcccaggaatacaaggatgttttatcccttaaaaataaatacatgtaatgtatggtgccagccatgattaagtaagccccctagtttatcactcccactggttagagttaaaacttttgaaaaaaaactaataaaaactacttgagaacttttaaaatgaataattgcaaagagattggagaataaagtatagagttgaaaaccaagcaatgcacagagtaagttccctcattttttttctgtctatatctcctgcctttgacctaagggtaagacaaattaggaaattgttagtccaaactgcaccattttggaagccccccaccatttcacaaaacctgatcaaagtgaaacattccacagggggttcgggctgtgagaaacatcctgcctcttatcatattctgctgggagaaagtgcaaggaacaccactttccgcgggaatcgcctcatcctgggaacatgtccccccaggcccctctcacccaggcctataaattgccccagc

SEQ ID NO: 160646 - DNA, 543 bp, Homo sapiens
gcgaatcctgtggcggtcgccaaaggatgcatcagatctatgtcctctttggttaagtctccactgactggggggctacagcccccaaatcctccaaatcttcaccgaatccctgctccgtttcgctttctcgcaccccgttgtctgggcctgtcacatcttggaggccactggaactctcgagggcgaggcctgagttgggctgactgccagagacagacccctctgggtctcggtgaaccagccaggcatttacctcagtggttggcacctggaacctgtccagggccctcacctgactgaggagccgccgggcagtgaagtaattgtccaggtctatgctcttggggtggataccatagccatccaaggtattcctcaggttgtggaactcggtcagaggtgcacctctgaccgagttcctaaagcacccgacacctaaagctttaatgtatcacaaggtggaaagtggtttctgcttattcaactaaagattcttttcctacagagagctatgagactattttaccattttgtctaatt

SEQ ID NO: 160647 - DNA, 169 bp, Homo sapiens
tctcttctacaaccagaagaaggaacagaaattacagtatggtgtttctataagataaatgaaagaaatcagagattttaatgaagaccaatgttacattacttagactgctaacgaatacacatcaaataacataaccaaaatacatcttggccagaagtaatatgta

SEQ ID NO: 160648 - DNA, 501 bp, Homo sapiens
ggctcactgtaacctctgcctcctgggttcaagcgattctcctgcctctgcctcctgggtagctgggattacaggcatgcgccaccatgcccgactaattttttgtatttttagtagaaacggggtttcatcatgttgaccaggctggtcttgaactcctgacctcagttgatccactgccttagcctcccaaactgctgggattacaggcgtgagtcaccgtgcctagccggcactcattcttatgggctcacgcaccaggggtggaattgttggatcagttgccattcatttccccgaagctgccggattcagatcccaccagccacgttggtacttgctctccgcttcctgtgtgtagacaggaggcaccatctctgtattgactctgtagcaatctggagggtgcaacgtgcgatctcattactgcttttcttttatgtccttttgtctccatgggaggttgagcttcttttcctacaagtttacttactgtttgca

SEQ ID NO: 160649 - DNA, 302 bp, Homo sapiens
ggcttaaacaacagaaatttattttctcacagttctgcaggctagaattcccagaacaaggtctgtcagggtcatttctgatgaggactcttttcctggcttgcagattacctcactatgttctcacgtggtagaaaaagactctctctctctctctctctctctcttgcttgcttgatgacctcttaaagatctcacctcttaatactgttacaatggcaattacatttctttttctttttctttttttgaggcagagtagtgctctgtcacctaggctagagtgtaatggtacgatctca

SEQ ID NO: 160650 - DNA, 448 bp, Homo sapiens
caggatgggtacaggggcactggtcttaaaatttagcgttcccaagtcacgtcttttacgaatacacacgcataccctctgttgtggatggtaggcctagcacagtccagtgaaggacggacctggtgtgtgaagcaagtcccatgccctaggattaggaaaccctcacctaaccgtggtgtcccttggtgtctctgcaccttagtctaattttcaatcttccactagccagagatcaagtcttgatgctatccagttgaaacctagtctcccgtgaaacattttcaaggtcggggggtttcaggaggacactgtggcagaaaagccaagtctctggcaaacatgaggtagttcaataggctgggtcctccatatagttgctcttcgtggttagaaaaacaaccagaagtattcctgctatgcaggcctggagcttctgccgacttat

SEQ ID NO: 160651 - DNA, 258 bp, Homo sapiens
cgttccgacggggggagccatacaacgggggaaagtcttcctagggacaacatttacatatgtgcctttgtcagggacatcggatcctcaggacctatcatagattctatccctctggtgggcctctgcaacagttgagatctggttccaccctctacttctcttcagccctctcctgcagcatcccaccaccgaaagctcctcctctgaaacagttccgactctcctctaagcccccacctacttcccagcctccgt

SEQ ID NO: 160652 - DNA, 421 bp, Homo sapiens
gtttcttttatattttccctaagtgtcagccagtctgagaaataaagagaaagagtacaaaagagagaaattttaaagctgggggagacatcacatgtcggcaggttccgtgatgccccctgagcggtaaagccagcaagtttttattagcaattttcaaaggggagggagtgtaggaatagggtgtgggtcacagagatcacatgctttaagggcaacaaaagatcgcaaggcaggaggtcagggcgaggtcacaaggtcagggcgaaactagaatcactaatgaacttccatgtcccgctgtgcatgcattgtcattgataaacatcttaacagggttcaagagcagagaaccggtctgactagaattcgccaggctggaatttcctaatcctagcaagcctaggggcactgcaggaga

SEQ ID NO: 160653 - DNA, 665 bp, Homo sapiens
tggctgtactagtattgatttatttactttcttttttcctgtttacttacaatgctatgaattaaatgttcatattatggtacatgataaagtgtgtggctgtgtgtgtgttcatagaggtggtaagaagtatttaaatggtcttacaggttaacaggtgaattaaaattcagggctggtgttactgttgacagatttgtttctcagagatggtggcttgctttttacaaattatatcattctactatgtcttctttttttactccactcagattcgaaatcagagcaaagcctctgggtctgggctctgtgagggagatgaagtggtttccatcaatggcaacccttgtgcagatctcacctaccctgaagtcatcaagctcatggaaagcataacagactctctccaaatgctcatcaaaagaccatccagtggaataagtgaggctttgatatctgaaaatgaaaacaaaaacctcgagcatctcacacatgggggttatgtggaaagtaccaccctgcagattcgaccggccacaaagacccagtgcacagaattcttcctcgcccctgtcaagactgaagttcccctagctgagaaccaaagaagtggtcccgactgtgcaggcagcttgaaagaagaaacaggcccgagctaccaaagg

SEQ ID NO: 160654 - DNA, 648 bp, Homo sapiens
ctggggcagcggctgcagcagcggcggacgctctgcattacccagtcttgcgtcctcggcaggcgcccgaagctgagtgcgcatcctctaccgcacccaagcttcgtctgtctcgtcaagctcttcatgctgcccaactaaaaggaaaacatgggcacaggggattttatctgcatttccatgactggaggggcgccctgggggttcagattgcaaggtggcaaggagcagaagcagcccttacaagttgcaaagattcgaaatcagagcaaagcctctgggtctgggctctgtgagggagatgaagtggtttccatcaatggcaacccttgtgcagatctcacctaccctgaagtcatcaagctcatggaaagcataacagactctctccaaatgctcatcaaaagaccatccagtggaataagtgaggctttgatatctgaaaatgaaaacaaaaacctcgagcatctcacacatgggggttatgtggaaagtaccaccctgcagattcgaccggccacaaagacccagtgcacagaattcttcctcgcccctgtcaagactgaagttcccctagctgagaaccaaagaagtggtcccgactgtgcaggcagcttgaaagaagaaacaggcccgagctaccaaagg

SEQ ID NO: 160655 - DNA, 453 bp, Homo sapiens
agcattcacagttgccaacttgcatgctccaccgatgtttcagggcatcgtctattgacactcatattgctttcattgatgtaagagaaggtcaaggagttaaaaaatgaagaaaaagaaagcagaagtaaagtaagaggtatgggaggaaagccaggagtcagcactgatctgtaagtttggaaggaaagacagtgaagagaaagcctgggtccatctctccatgagctgtcaatgagggcatgggcagccttccaaaaggttctcagcagggctttgagggtagcagctcttctatgaatggagtggcaggaagatgaataagaggaagtgagtgcctgttactcctctaagaagaggacaggggagtgaaggagagaggagagggggtatcgggtgcctttatatagaaagaaagaaacataagcctgtttttaaactgtaaggatctga

SEQ ID NO: 160656 - DNA, 128 bp, Homo sapiens
cacacatccccgggagctgggcaaacaccaggcagtggccagaaagccgtctgaatatccaagggtctccatgaatgttcaatagtaatatgatactaattctagactgcttctggtaagaacctcgt

SEQ ID NO: 160657 - DNA, 466 bp, Homo sapiens
tagaattcagcggccgcttaattctagaagtccaaatcactcattgtttgtgaaagctgagctcacagcaaaacaagccaccatgaagctgtcggtgtgtctcctgctggtcacgctggccctctgctgctaccaggccaatgccgagttctgcccagctcttgtttctgagctgttagacttcttcttcattagtgaacctctgttcaagttaagtcttgccaaatttgatgcccctccggaagctgttgcagccaagttaggagtgaagagatgcacggatcagatgtcccttcagaaacgaagcctcattgcggaagtcctggtgaaaatattgaagaaatgtagtgtgtgacatgtaaaaactttcatcctggtttccactgtctttcaatgacaccctgatcttcactgcagaatgtaaaggtttcaacgtcttgctttaataaatcacttgctctccacg

SEQ ID NO: 160658 - DNA, 218 bp, Homo sapiens
ggaatactatacagcgatgaaaaagaacacatggctgctacatccaacaacatgcatgaatcccagacatgatgagtaaaagacaaacacaaaagaaaacatgccttatgattccatctatgtaaagttcaagaaaatcaaaacctaatccgtaatgataaaagtcagaatcgttcccttctgtcggggggacattattgatgggaaggggtacgaag

SEQ ID NO: 160659 - DNA, 182 bp, Homo sapiens
cttccatccttccatccttccacttgggtctttgacttacggcaaaaaattccaactaagaataaagctgaaccaaccacttcctgagcctcagaggctagtaggtcttgaggcacccgggaaacaaaaacatcatagttacagctctgctgccctgagagctgggccatcctcttttctac

SEQ ID NO: 160660 - DNA, 325 bp, Homo sapiens
aaagcatttcaaactcaactaaaagacatttctttcttagtaaggctaaggctttcagacacatttcaaaaatgaagctaatgaacaagtgtcaaagtataaaatatttggaaattatcaaaataataatgtatacaaaaactcaacagaaccaccaaataaactgattaaaaagatagtaccacttacggtgttctttaattccataattgtgcacgggacctacaacacataagtatttcacatggccttcaaattcaaacaaatcagtgaactcacaaatgggccctgggtccatattatcacaaatgccagggtatagcat

SEQ ID NO: 160661 - DNA, 444 bp, Homo sapiens
ggtgctgacagacactgtctgtcttatgcccaggcctaccccattgctgtcgatgcaggtggcattgctgaggggacagtcacagcttgggcctgtccaaccaggctcacacacacactggcccatggagcagcgtcctcggtctgcagagagggacaaggaagggagatgagagctacatctgtgcctgtagtccaggctgcccacctggcagggagggcctgtgggagcagagctgtgggagccaggatgccgctagcctggggtagaagtcatctcttcctcactttcctggaatctccttccctccatctctgcctccatcctacctaccttccactctgcagcctgagtaattatctcaaaacaaatccaatcatgtggctcctgctcccctggctaagaacctctaatgggtccctgccaatgcaataaggtcagaaa

SEQ ID NO: 160662 - DNA, 507 bp, Homo sapiens
ctggccgacctttttctttctgttcttctggacattagcttaagaatgggcagaaactagagggataatgaataagggagtgcctctttggtgttctgcctttagcagtctggagactttctcacatttaccaaaagcaaagaaaagagaagggcccatttgtaaaaagtgccaataagggtgttaagagataaaagaattccagctgagggaggtatcttcctctttgctgcagactggatgttttcttggatatgtgacgggagctaattttagaaaaaatgattctcgaaagaaaatgactgctgaaggccattaagatacacgagtatctcaccacagctcacatgctaaatcttctttattatttcaacattaaaataaatacttagacttagcattagtccagacaactctttgacacaaaaaaaggacgtgagtgtgtctcagacccacagaaaacttggccagctggcaattaatagcagacacatcaatcaaaatgtg

SEQ ID NO: 160663 - DNA, 304 bp, Homo sapiens
gctttgtgtattatttctttcttttgaaatctctgtgagtcccagtctacctctcatccactcacttattcattaagcaaatatttgctgattgcatactctatgccaggctcacaggtagcctggaatggaattattaaaactagaaaatcaagatctgaacataaatggcagctttatcaaggggagttgatgatgtttaaaatgtctattttaaacagtgaagaaaagaagctgtatcttgggataacacagaagtggagtaaaaggttatacagaattcagctctccagcaaaaccacct

SEQ ID NO: 160664 - DNA, 186 bp, Homo sapiens
ccacccccaaaaaaggcagtgaggaagaaaagaactgaggtctcttgggttctccatatagagcaggtgtaaggaattttctgaatcctcacgtgcaccccacctgggtccacctcacaaatgaaactaaaccttacaagtttctctactatttagcaacgaattatttttggttaggtttcatgc

SEQ ID NO: 160665 - DNA, 401 bp, Homo sapiens
aagaaaaaaatttataactgttaaattttattcagatatcttgcagtatttacactcaggtagaaaggcctgaactgtttttctcagtcttatattctttaaatgaatcacataatcaatttttacctgtagctttacatgccttgaaaagtaagaatccacagaagactaactttcacttctttttcatggggattctttctccacacctgaagctgctgaattagttgatgaaatgtttttcttttgttttcatattgatcaataattgctcatgaataacttcatttgaaattaaataatatcacagaaattattgaaccagcttaagatagattattttaagtggtttcttggtttccttataattacagaaagtctacctataaacttgacgatat

SEQ ID NO: 160666 - DNA, 637 bp, Homo sapiens
aaaagacctaaacgtgtatgctaagattactgtcttgaatctgaaactttgttttctaatatttgctagatgataacaactccattaagtcagaaaccacattaatctttttcactgctttaatttaggactgagcacttaggtctcacacatagtaggcagtcataaagtatttatttaataaatgaatgttcgtctaacttcttaatttaatatcctatttccttgttcaaatgacttgatttttattttgcctatcagttatctgctaacacaaacattcagatctatagttttaaagacttgagataattagaggcttctaaatgcttacattcaatcatgataatttatattttatttctatcactatctgcatttccgtttcctttggttaaaagttagcactggtatctttcatttactttgtgaccaagtgactattcattcaaccataatttattaagtctctcaactactgggaagtaaaagacatgaacataagtaagaactctgcccactttcagagctcccagtctagtttggatagaaacattcaaataaataattgcagtacaatgtgataatctcttaactgcctatttcagcaggccaaagcaaatagcaatctaacact

SEQ ID NO: 160667 - DNA, 368 bp, Homo sapiens
gcagagaacccgtatataggtgagcctggagatgggactggattgctgcaatcccatgatcaaacttgaacagatgaggagttgcttcttatggatgagcagacaaagtggttcctggagatgggatctactccaggcgaagatgctgtgaacattgttgaaatgacaacaaaagatttagaatattacatcaacttatttgatcaatccgtggccagggttgaaagaattgactctaattttgaaggaagctctattgtgggtaagatgctatcaaacataatgcgtgccacagaaaaatctttcatgaaagaaagagtcaacccatgtcaaaaacttcagttaagaaactgccggccaggtgcagt

SEQ ID NO: 160668 - DNA, 315 bp, Homo sapiens
tgcagtggtttaaattcagtagatgattttggagagcacacagttttaacaaatatatcttgataaggttgagaaactattggagacaatctagtaaactaagaagtacttgcaacgtgatttttcatgcaaataagttgcaagttagccttttcccttcgtgtaaaatatgtactattccagagagatggggtccagactattataggcatagtataatgaacctcactgcagagtgtactcagccaggagctggtgatttggctgtaatggttactgaaatattctgaattggttgataaaagctgctgccct

SEQ ID NO: 160669 - DNA, 546 bp, Homo sapiens
gatggcattcccaagccccactgcagcagcaagcactgtaatttgtcccactaatctcccatcttctaaatttctgagaggtcaagaaaagaggtctcttgattcctttaggaactgctccctaagcatacagggagacatagatctatgtggagcaaagggtggattgtaataagcaaagagatacactgcctgattcactttaagaaaggactgacctcccagttgcaaggaatgaggtcagcagcctccaactgtcagctccttcagagtctgcttcaactgcagaaggacactgtgcttgaggtcatacccttcccatgtctggtgactgaagtccagctgaatgtagctgccaaagttaccttaatgcccatgggaagcaaaaaatcaaagagtttaaacagaattttgagaaatcccaaatcagttttttttcagcatatgacattttggagtagtttgttattcagcaatagataacagaaattggtatcaggagtggggtgttaccataacaaaaggttaaaccttacatggtaaaaa

SEQ ID NO: 160670 - DNA, 243 bp, Homo sapiens
tatgcagtaggtgctcagtaatgctgggctggtgtgcagtaggtgttcagtaatgcagggccggcatgcagtaggtgctcagtaaatgctgggcgggtgcacagtaggtgctcagtaatgctgggccggtgcacggtgggtgcctggtgaacacgtgcctccctggtcatcactgctgctcagttcagggcttagggatggacgtgccatctcagcgagctcgagggtcaaagctctgctatg

SEQ ID NO: 160671 - DNA, 154 bp, Homo sapiens
tccaaaataatccttgaatattcacttaagtggaatgcattagagcagctactaaaagtgaatctcctttttgtcatatgaatcagcacctcataatttatatgcttggtaaatgttttaccagagagtggactttcttagttttttttttttt

SEQ ID NO: 160672 - DNA, 562 bp, Homo sapiens
gcaggcaggcggggcagaaatcaggaagatgggagagaatgacagaatttggagtactactgagacctacactacaggtctcctatagaacatgtggtgggagcagaataaatgcatctttctctttgtgtctgtcctggtacaaggaatgtttggggcattggtataagaagctcccagagaaaaggtgatggtgacttagctttgtgcactgcatcaccctcacaggcaacgctgtctgctctaggcgtgacttgcactaagtgaatgtggacaagatggccactttttctagatccttctggggaagctgttagttgtaatagtgttagaacctaagagctagaagagactttggagatgatttactgcattttatgttagacttagacaatttttttacaaaagggaaaaattaaaaagccccagagagacctggacttactcaaagccacacaagtagttgagcacagtggctgagatgaatcattttgtgtctttccccaaggatctctctttccttgtccctctgtctatcctggtcaatagcatcattgtttga

SEQ ID NO: 160673 - DNA, 437 bp, Homo sapiens
agagaggagaacaatataacagagtaggctataatgtcaaagtcagaggttgtctgccaatgttatccacaaaaacttctcaaagctcacaagtaatatgtccaatgtggtctcatgccccttctgtgctaaaaagaatccggactaccaagctggcagccctatgctacagtaagcagagttgcaatctatagccagatcccttcaacatggatgagctggggggaaagcagaactaggaagccaagaggacagacagataaggaggtaactatgcaaacaactttccagataccacgacagcacttaaaagcagatcctatacaaagtctttcttgccttaagttcagaatacaaattactgccactcataaaacagcatttgcctgtgggcaatacaaagatgtaagagacactgaacacttaccttcaaggcg

SEQ ID NO: 160674 - DNA, 646 bp, Homo sapiens
gctgtgagctcagccttgggggtggggtggggacgggagtgtgccatgaaaaggcttggcagaagtgatgctggagctgagtctaaaaggagaggaggggaggcttagccaggtgagaatgaatactttgagagcgagatagacaaataaactcatagtttattccagaaatctcagattgttcaatctagtggtatggaagttgatatggtgcaagtgaagcagtataggttcatgaaagaatgccatattagcaatttgagatatcatgcccagggcagccgggagcaagtgaaaaggtctgaagcagaggaatgacatgattggttacatattttagaaagatttcactggagtcccagtagaggagggaaggaggaggacaggagcgactgaagggctggagaactcttcggagacaaacctaggcttctgagagaggagagttggtgctggggcgatggatctttgctgaggaagcaccatgtgcaaccagtgccagatggcaagctcctgcattggcctgggcttctctgcctggcgcagaagtgcctggcacatgtgcccctctcttcctgggattgtaggttgcttgagcagctggagagataagactgccctctcagaaggccagttgtaaagggtg

SEQ ID NO: 160675 - DNA, 230 bp, Homo sapiens
tctatgcatgcttgaggtttaatttgctttcttctggcttctgaagatggacattaatgctgttaattttacatcttttcttccacacaaagcatttaaaactaaatttccttccaggcagtaagttagctgcgtcccgtgaattttaatacgtcgtattttcattatcattgagttagaattgttttctaattttctttatggtttctgattttatccatagattattg

SEQ ID NO: 160676 - DNA, 442 bp, Homo sapiens
tgtgcctcagcctctggagtagctgggactacaggcatgagccatcatgcctagctaatttttatatttttagtagagatgaggtttcactatgctggccaggctgactttgaacttctgaccgcaggtgatccacccgcttcagcctcccaaagtgctgggattacaggtgtgagccaccgtgacttgccaggaggattttaaagaccacggtgaatcagccctccacaacacagtctcaagcttgttttctcttccacatttgttatcgagttgacaacaaataaaagagtcataaacgacagagatttgagcggtgtctactagccctacccagcaagtattacacaaatcaggaaacagatccccaaggacagtgagagctaatgcacatgtggaatgagatccagcacacatgtgcagtgggatccagtacacgtgt

SEQ ID NO: 160677 - DNA, 493 bp, Homo sapiens
atataaataaattattcattgcctattatggagatatagtgcttgactcaggagtacacatgaaatgtattcctaaaaggatctgtgtggagttgaaaaggcttccattacactcttttgactcataggagagtgctttttcttttatcgttttcctgcagctatacaactcctgtttctctgaatactattttcatttgttctttccaggctagtacagtattcatgcattcttttttcctttctctggtataaacttttttttaaaaaaaaaataatgctatttagcacttctttgcatgtttttagtgtttactaattatctcagttttattaagccattttattgactccattttaattttcctgaagacagtattatatttttggggaaaagatcctcacctgtccccaacatactcgtgaatatgcacacacaccacactcacacgtgcacatgcacacacacaatctcactctatactttttgaaa

SEQ ID NO: 160678 - DNA, 467 bp, Homo sapiens
aggcacacacaggtatcagaagggtctcacatttacacctttacctcggggtcaacctcaggcacacaatagtaacacctagacctccttcacattgaagcacacacaggatgctggtaaacctttcagacacccttggacagcattcttgagctgcctacacacaggcgatgcacccgggcctcccacccaggtacttacacacggtactactgaggccctctcaggaacactcaactcaggtgagagcctcattctaaaacacacccctgggcctctccaaggtaagtgaaggttgtaaccacagagttctgtccccccagcacaggtggggaaaaaggcagaagcagccaatggggatgcagacactgtcacagaaggccactgcttcatcccccttggccctcccttcagtccagcggctctcccaggggtcaaacaaggtcttgtcttctctttcctcttct

SEQ ID NO: 160679 - DNA, 531 bp, Homo sapiens
aggcacacacaggtatcagaagggtctcacatttacacctttacctcggggtcaacctcaggcacacaatagtaacacctagacctccttcacattgaagcacacacaggatgctggtaaacctttcagacacccttggacagcattcttgagctgcctacacacaggcgatgcacccgggcctcccacccaggtacttacacacggtactactgaggccctctcaggaacactcaactcaggtgagagcctcattctaaaacacacccctgggcctctccaaggtaagtgaaggttgtaaccacagagttctgtcatacaggaggtccaggtcctcctctgcctcggggatgtgctccgcagggtcctgctccgagtccaggtcctcgtcggacactttgaacctccgcagcagcgctaccactttctgcttgaagttctgttgcctggtcatggacgtcgttcttacaatcgatctccgctgcttcttcggcttccccacgtcaaagtcgtcctcgtccaagtccgagt

SEQ ID NO: 160680 - DNA, 430 bp, Homo sapiens
gatataccaagttatttaagttatatattcagcatcttttgagctttaaattaaaggtgcttaatgaagggttggaagatggtagtcatcatgtattttcagtttgattttagttctggaggtaaatgttttgttgtatgttaaatggtttactaagtccatatttgtgttgataaatgtgcagcaaaacaatgtgattgatttttgtctttgaaaatctcgatgtgagaagaaaagttgactgaatcatgaaaagtaatttcattcttggtggccttttaccttaagggcagaggcaagtcctggctttttcacgttgcagatgttggatgcagcctttcttttgcaaaataagaattataatatctggccaggtgtggtgactcacgcctgtaatcccagcattttgggaggccgaggagggtgggtc

SEQ ID NO: 160681 - DNA, 388 bp, Homo sapiens
ctccagcccaattcctccttgaaatgactcagtccctcaatggagtaagtgagacagactcagcggggccagacgagaggaaggaaatactgctgggcacatgcatggccctctcctgggcaccaccatagcagcatgagtgaagctgcagcctgtcatctccaccatctgtgcccttgaaacaagccagatactggctggggaaagcatccttcaaaattcactagttcatcctggttctcaccttcccaacaatactgccatttgaaggaggcaacatgagtaaagagcctagaaattaaaagattagcccactattaatttagcatattagaaaggccttctttggttctcacacctgcaaaacaatggaaagctggtccgctgt

SEQ ID NO: 160682 - DNA, 721 bp, Homo sapiens
atagacttctcacacaatatggcgatagcacagcggtatgctagtagatctttaataaccagctttccagaaaggtggaggaaaccttgatttgtagcttttacctgtgtccatggcatagtactcccaccatggccaatctgaacctaccaacgtgacatcactacataagcagctgggaagagatgtgcactatcaactctcaaatgccagtataaggtgcctcagcacaccagtgtttgcctgcagtatttaagtacttaattactaagagtgaaaagatacagaaaacattaagaccaaaaatacatattgataggatttaaaagtagaaggtaacagccagccgtagtggctcacacctgtaaccttagcactttgggaggccaagatgggtaaatcacctgaggccaggagttctagaccagcctagccagtatggtaaaacctgatctccactaaaaatacaaaaattatccgggcgtggtgacaggcacctgtaatcccaggtactcgagaggctgaggcaggagaatcactttgaacccaggaggtggaggctgcagtgagccaagatcacaccactgcactccagtctgggtgacagtccatctcataaacaaataaattaaattaaattaaaatagaacgtacaacgtcatgaagcaattcatgatctattgctggaacttttcttttttttttttttttctttttgtta

SEQ ID NO: 160683 - DNA, 271 bp, Homo sapiens
tgctgcttgctgtgctatgtgtagtcttatctttgacccaggagtctcatgtcttcggtcagctaccgtgaaacagttaacaggctacaatgtattagtttataaacagtgtaaaattaaatactgacagacacctctctaacactaatctccctttttaaaataataaccatttggctcagagcctacaacaggcaatactgtctgataacattgttttgtttttataatatttatctttacagttaccttaccagtggcaactgtcaca

SEQ ID NO: 160684 - DNA, 417 bp, Homo sapiens
tgctggggccgactcccaaacggggctgtcgaggcccggttggctttcagaggcgtatccatgggagtaggtgtcatgtatcaaataggagattcaaagtcagctgttaccacggctacagaaatgccagtcttttcctaagagtgcgaatggacacacacatgtgcatacgtgcacacatgcaccctcaggctctcacggagccctgggtgcctacagcaggacgtccaggacgggaacaccacagtgcactacgccctcctcagcgcctcctgggctgtgctctgctactacgccgaagacctgcgcctgaagctgcccttgcaggagttacccaaccaggcctccaactggtcggccggcctgctggcatggctgggcatccccaacgtcctgctggaggttgtgccagacgta

SEQ ID NO: 160685 - DNA, 373 bp, Homo sapiens
agttgattttttagcctatttggagtttatgagaaactatagtatttggaacacgaatgtatttttgaagacagatcctttgcataggttacaggggtagagcagagactgtggtataggaggaaagcttaggtcatcgtgggtaagactgttgcacatgcatgagactcatttgcaaaaccaggctctaaaatgctttacaaattttagtaaaggaagtaggtgtggagtacagtggagctgaaatgtaaacttgtgttaatttttaaaatatacaaacattaacttgcaaactagtgagtttgcttgtgatttacaatatcttaacaattatccatgtgggccaaaaacacagatttgtttaaaaaaaaat

SEQ ID NO: 160686 - DNA, 160 bp, Homo sapiens
aactccaactgccgagactcactgtcttcacattatacattctcctagcaaaatctgcaccctaggtaaataaatccctctaacttttccttgcctatactcaggctgcttagcactgcaagatgggaagaagcaagaaaaaaaggtttcactacagatt

SEQ ID NO: 160687 - DNA, 613 bp, Homo sapiens
aatttttatgagggtgagggaataaaacttctacaagtttgactatataagcagtatctttggagaacaggaattaggaactttatgtaaacagagacaaaacataaaagaactatcagatggtaaaattacctcccctcaggagagctaaattttagtgaatactttttacaaaacagttcaaaaaattgattgttttttaaacccaaaccccgagaaatgagatgagaaaatgaatagactgatgaaaaaagtgtatatatataaatcatcctcgattttaaattctttttcctcttggatgccatattaaactataaactgaagtatccaacattgagagtactcaacagtgtttatttgaggttaagatgttctcactgtgttatcagactaacaatgtaacaaagagaaaaagataagaaatgacttcttaaaactaaaaatgttgccagtcgccatggcttatgcctgtaatcccagcactttgggaggccaaagtgggcggagagcttgatcccaagagtttgagaacagcctggacaacataacaaaaccccatctctacaaaatacaaaaaaattagccagacatggtggtgtacgcctatagt

SEQ ID NO: 160688 - DNA, 275 bp, Homo sapiens
gctcatgcactacccagggtcccccagctccaggggtggcaggcacagtgggctctgtgaatggcaccccctggagttatgcaatgtggtagctagagtgggacccctcctgtcacctgctcacctcctgcttctcctgagatcagcaagggcacgacatcctccagggtcggagggcttcctgtgaaccctcctggtgccgcagcgtggacaccctggtgtgttcaaggtgtctctgcacctgtcccatttcataacccacccctcaaggccag

SEQ ID NO: 160689 - DNA, 420 bp, Homo sapiens
aagaaaatgttttttgttctataaaaattataataccattaaacacagatatttaggttatttgacattggttggtcaaggttaatgagagtttttgttaatggctttctatgtttagttttctcataaagcagatttatttctcatgtgagatatattcttttgcttagattcctttgcagtattccttatgtaataactaagtcaagatggattttaagtttgaaagtgaattaaactagacacatttaaaatttaaaaaattggtcaggtgcagtggctcatgcctgtaatcccagcactttttggaggcccaggtaggaggattgtgtgaactcaggcattaaagaccagcctgggcaaaatagtaagacccggtctttactaaaaataaaaaaaattgtttaagtgtggtgctgc

SEQ ID NO: 160690 - DNA, 291 bp, Homo sapiens
gatgcccagtgtctcctttaaggcagcaggaagcaggtgatctttgtcagtcacggcttccaggcagagtgactgaagtctcataaaggggtgggtccccaggatccaggggagcatagccacaggacccctattccacttgcgaggctagtacactggcgaggctaggacactggcgaggctaggacactggcgaggctaggacactggcgaggctaggacactggcgaggctaggaccactggcgaggctaggacactcgcgaggctaggaccactggcgaggctagga

SEQ ID NO: 160691 - DNA, 286 bp, Homo sapiens
gatgcccagtgtctcctttaaggcagcaggaagcaggtgatctttgtcagtcacggcttccaggcagagtgactgaagtctcataaaggggtgggtccccaggatccaggggagcatagccacaggacccctattccacaggcaaggccaaacagccatggcaggactgtagttcattcaaaggctttggtgtagggcctgggctggagctcagagccaggttccaaagggaagggctgcgcagtggttagggcacagctgtggccctgagggatggggctgggat

SEQ ID NO: 160692 - DNA, 309 bp, Homo sapiens
ggagggcatagcaggacacacgtgtgcccgtgtgattggcattcaaggacgctgcccgcaggctggaatgctgcccgtttcttcagtagatttgtctttccctgaccagcctgagaatttccctcagttctttttctgtgctgtacaaaagccctgaaactcccaggaatccttggtaggttccatgcgggaaagaatggtttcttcagtcatcgtattttgaagctggttattgaatgaaaactaagataagcttagaacaagtttaattagtttaaaatgaaaagctagatgggcctagaagaggaa

SEQ ID NO: 160693 - DNA, 180 bp, Homo sapiens
cttgaacccaggaggcagaggctgcaatgagctgagatccatgccactgcactctagcctgggtgacagagtgagactctgtctcaaataaataagtaaataaatcagtgttttataatctcaggaaatgaatcaaatatgactttagctttgtagaaccaacttggatttcagttgtta

SEQ ID NO: 160694 - DNA, 243 bp, Homo sapiens
caagtcctcaaaaatctctagctatcattattccagaaagtcatgcttctccaaagtctcccctaaagatcaaaaagaaccaggctgggcacaatggctcacgcctgtaatcccagcactttgagaggccaacgcgggaggatcacttgagaccagtgtgggcaacatagggagatcccgtttctacaaaaaaattttaaaatattagtcaggcgtagtggtgcacacttgtggtcacagcta

SEQ ID NO: 160695 - DNA, 175 bp, Homo sapiens
cctacgaaaaacaaagctggatctcaatctcactatatatgccaataaattacaaatcaatcagatttaaaccacaaaatactcaaacaataaagctctaaacaaggggaagagctggtgcgttgggccgtcactgccaacgtggtacctgagctctgaattctgtaatctatgg

SEQ ID NO: 160696 - DNA, 512 bp, Homo sapiens
cacaaagaggagtaagtggtagggacaaagctgaaagcaaaagcagtaggttcctggaaatggcaggtatgccatgtccctccctcacacagcccatagagctgatgtccctgccatggctgtccgtcctggcattgctcgcaataccagcaagaagccaggccaggagaaaaccaggggcctggagattccggccaaatacagggacccaaaggtacttagatgctgaacctgattcttgacaggcccaggtgatgctgagaaaccaaagaacaacactgcaggtgcccctgactttaaggacaacccaccccatccagcacacatacatccaaggacttcataggaacaactggataggcctaggttaggagagggtccttggctgctctgaagatggtgagtatctcaactgttcccagtgaattacacgtcagacttcttcttccactctttctccccatctcactactgcactcgactggtcttaaaaataataataataaaggctg

SEQ ID NO: 160697 - DNA, 149 bp, Homo sapiens
aaatgagcagacgctggaacaggaaggatagttctatgtcattggatgggttatgaatttccctgagcctgactcagtttcctcagctataaaatggaagtcattgtaatacgtaagtggccaacatttatccttacattgttctgtca

SEQ ID NO: 160698 - DNA, 177 bp, Homo sapiens
gcttgtgctgcccccagctccctcccaacaaaaccaaaggccattcatgctaaaagggtcacttagtccaaaccttctggtcacaacagaggaaggtgctctgctgccctcagcacaccaaggggggacacccctaaagaaagcactagaaggtggggtgcagtggctcatgcctgt

SEQ ID NO: 160699 - DNA, 357 bp, Homo sapiens
atgcttttggggtctttgcttagtaggagtgtgaatgattacaggctcactggtcagtggtccatagtctagttggtcattttggctcctcccattcctttcttctttcccagcaaggcaagaatgtttttcaccttactaaaggcttctaatggcctaactcactatcgtttttgtcacttttgtttccagtcccatagtgtgtaactcctgtctacctaggtagggcaggggaggagaagggagccttggtttacaagtaaaattataatttagtgtggggggaacagcaatcacattgatcaatatttcaaaatctactcattcatactttgagacccataaagtactatttcc

SEQ ID NO: 160700 - DNA, 669 bp, Homo sapiens
tgcccgtaatcccagcactttgggaggccgaggtgggtggatcatgaggtcaggagtttgagaccagcctggccaacatggcgaaaccctgtctctactaaaaatacaaaaattagccaggcatggtgttgggcgcctgtaatcccagctactctgtagtgaaaactacccatatgtctataaactgaaaaatggataaagaaaatctatatatccatacaatagaatattattcagtcatgaaaaggaatgtagtattgataaatactgcaataatgataaaccttgggaacatcatgctcagtgaaagaaaccagtcttaaagaaccatatacggcatgattccatttatatgaaatgtccagaatgggcaaatctgtggagacagagagttgattagtgactgctagggcggatgggaagaggaggtggtgaccaccagtggtttggggtttctctttgggctgatgaaaatatcctaggattatggtaatggttgcacaaatctgtaactatactaaaaaccattaaaccatacacttttggccaggcacggtggctcacgcctgtaatcccagcactttgggaggctgaggtgggtggatcatgaggtcaggagatggagaccatcctggctaacacggtgaaaccctgtctctactaaaaata

SEQ ID NO: 160701 - DNA, 683 bp, Homo sapiens
ggaagctgtgatcctgatcccttgagggagcatgtattctgctctgggtctgtccttggggaacccccaagggagtgatcaggatggtcagaagtctgcaggccacattctaggggcaacagccaaaagaactgcggctgtttctccagatttcagctgggactgttcacagcttccaggtatcagatgagttctcatagggagatagggtaaggccttcccatggagccctaggctggggaagaactaccaggtagaagtaagaattccacagagttaggtcagtttgggtaggatttgtatggacctagactttctgatgattggattgtaagactgggttttctatcactgggactgttcatgcaggggccagggtgctgtggaggggcagtatgtgaagcaagttgaactctgaagcattccaactttgataacagcattccagatggaaactatgagggaccaagatgaggtgctgtgggctgcgagggaggagcgattgactgaggatcagtataggggagggctgacgctggaggcatctcagggtatagctttgggaaacatggaatgctgagtgaagctcagtgaaagatctgacctcgtgtgcactgctggtggagtggtctctcaggtatatgggccaagggggacacagggataacaagaggtctgagggt

SEQ ID NO: 160702 - DNA, 446 bp, Homo sapiens
atcctaagaagggagacttccagcaaagccactgtcctgaggcttgcagagccttgctggcttctttcaggacttattagaaccacacagaggcagactgctctgcagccgagcaggggcatccatctaagtatggtgaggagagggaggtgaggcctctgagcacagaaacgattctgtggctgatggaccagagcagtatggaaaggaaggggcagtgcctggtcctgtaactgggagaaacttctgacgtactccattaagtcccaacccccaaacacccagacactgcctggtgcagcaggtacagagacaaatgagatacaccaagaggcccagaataaccactcttgagggaaaccttccagagactgggaacacatacgcaaagggaattcaggaggcaaatcctagacagacgtttagtaatgtctcttcagtctgtt

SEQ ID NO: 160703 - DNA, 290 bp, Homo sapiens
gtacagaaccttaacgatactcccagccagggaggaagaggttacataatggagcctaggccagccaaaatgccaggggcataattgaccagggctacaaaggctttggtgggtggggaagaagggaagaggtaggtagcaggcttaatctgagccaggcagacagcttagacatttgatgactgatattcactacagagagagagattttactttcctttcaggacaccgaggagagagagaacagactgcctgcccacgtgaacgcacaatcaagagaggcctcatgt

SEQ ID NO: 160704 - DNA, 325 bp, Homo sapiens
gtggtcataggaactgtgggtatttgaaagcaaaggattttatttaggggactcagttgtttatgggaactaaccactgttcttccttcaccacaccccattgaaatgtactgtagatggccctaatgttactttttgaatgtctaaggtcttatgttgttgagctggcactttttagggctcttggttttcaataatgactataatattattttagttttcagtgactctaataataacattacactgatgttaaattcaaattaatgttcagacattacattgagctagtttccttagcagaatcaatgtgaaactattgttt

SEQ ID NO: 160705 - DNA, 247 bp, Homo sapiens
tggcagagtaaggatagccctgctcaacgctcctctctgaagacagtgagaaaataaagggaaaagaacgccgtgttctgatatgtaggaatgatcttcaaaccaaaccacaaccctgcctcgtggtgagcgtgagtagtaggggtgaggaaggccctagaataagccaccctcgggcagcactgtggcatgctggccatactttgtttgaggttcctgaagatgtacatcttgcttgtggttggct

SEQ ID NO: 160706 - DNA, 360 bp, Homo sapiens
acctcagatatagctagagtagttactgtctatctcagtaccaccctgtttgttttctctatagcatcaacttcaatttgtgattatttgtttacttgtctattgttttcctgcattaaagtgggatccatgaaggcagacatcataccttgcttgtttactactgtgttgccagaagcacatgttaggtccttaataggtatttattaaatgaatcaaactctttctagaagaaaccacagaccctagactgtaatttaccctaagggagaatacaggcatttagacaaaaaaaaggtatcggctgggtttggtggctcatgcctataattccagcactttgggaggctgaggcaggtg

SEQ ID NO: 160707 - DNA, 558 bp, Homo sapiens
agtttgccacacaagtgatggaggttggaaggagggatgaggtgacagaggtgaaggagggtaaattcttttctaagccctacttgcctgacatgcatttaggtttttagaaaggaacctgaccccaccctttattttctatctcccacttccatgactagccttacctgtaaaaatggggcatagaagagcccccatctcctagggcagtgtttttgagcagggggtcactgaacagtagcaccttcatctcttgagaccttgttaggaaattctggacttggggtggttgatcatgcctgtaattccagcactttgggaggccgaggctggcagaacatgaggtcaagagatcaagaccatcctggtcaacatggtgaaatcccgtctctactaaaaatacaaaaattagctgggcacggtggtgtgtgcctgtagtcccagctaatggggggctgaggcaggggaatcacttgaacctgggaggcagaggttgcagtgaaccaagatcatgccattgcactccaacctgggtgacagaggaagactctgtctcaa

SEQ ID NO: 160708 - DNA, 402 bp, Homo sapiens
aatggtcactgcaaccatctatcctataatggatgcaatatgttttagggcaagagaaaatgcaaaagacaaaagtaggctgaatgaacagttggcccagatccctatatcactgatgcctctctctcagcttatacatacagtctcctaggtccttccaaccagctgataccttagtaaacaagccaggcctaatgcaagggcactttggctaggtatattggcacaatatgtcaaccactcagatgtgggacctcaaatataatccatgagggtaaacctactctgataagtagaatacatagattcatcgccatccatagaaagggttcagaaaacaggagctggccctgtgcttttacagagctttatccttcccataagggcaggaccagatattat

SEQ ID NO: 160709 - DNA, 433 bp, Homo sapiens
gggcatagatttcagacccttcaccatcttgctcttctgttttttcctctggataactttgaggcagttgaggttccttttcatatgtggcctccatgtttcagtaattgaggagagacactgctaataatgcaacaaaatgagagccaccattccctagggcttgcccccttccaagtctaatttgggatctcactggcataccctaaggtaggccccctgtaaagtcctgttgtctcttcataggagtttctgactctctttccagctttccatggcttttcagagttgaggtttttttttttttagagagataagataataataggtccccattttctttcgggttttaaatttcctttggttttggttttaaatccccaaaatttttcaaaatttgggatcccttgtaaggttttttgccatagaccta

SEQ ID NO: 160710 - DNA, 732 bp, Homo sapiens
agagagagagagattgatgacaagctgtatctgtttcagaggctaacaatttgtgatttctgaactggggtagtaagtggagaactgaacctatccaaataccctggagccagctcccatgaaagccacagctcaccttggtgtcccaccctagctctgcctagcaccccccaggagctcagtgaattgcctgattaccacactgcacaataatgactaagtacaccaggcaactctgttgtaaattctcttttacttccaacagtaatctgtgcttctgtgtgatttatctttatgaacaagccagcttcctgtgggacagcatgttccaaaagttttttctttgttcctttacatttcttccccctgcatctcaacagagtcaagttctgttctgtgctttttgaaaatctacttttattttttaatacctatttttaaaaaatacttttctgtattatagctccatttcatttgtatagatcatcccttctgagggtcaggaaatctgtattccattcctcattcctcccttgactactgaattactgtgtacctctgggaaaagtcctttcccctctctgggcctgagtttcctctctgaacaatcagaaggttgttgtgtaactttgcactctactctcagaggcactggaaatgcagggccttgtgaaatgcccattttaaaatggaaatctaaactgaaaaaagcatgtaagattaaagaaatca

SEQ ID NO: 160711 - DNA, 300 bp, Homo sapiens
ccatccaccctttcaatcaagatgtgaggggcatatgccatcaacaaatactgtggaagtttctgagaatacagaggtgaaattttttaagggtcaaggaacaaaacccaatcactaggcaagatgttgggttctctaagagctctctatcaactttccctcaggatatcagggatgcctccactgaggagtaaccctgaaagaaaagtaggaattcactaagccacatatttatgtgggaaatttaagtgaggaaggggatgaaaggaatttttagggagagaacacagtgggtgcaaa

SEQ ID NO: 160712 - DNA, 1006 bp, Homo sapiens
tagcacttgggaggctgaggtgggcagatcacttgaggtcaggagtttgagaccagcctaaccaacatggtgaaaccctgtctctactaaaaaaacaaaaaattatccaggcatggtggtgggcacctgtagtctcagctggttgggaggctgaggcaggagaatcatgtgagcctgggaggctgagattgcaccactgcactccaacctgggtaacagaacgagagtctgtctcaaaaaaagaaagttgtctcttcttttccaaacattttactgccttttaaatccagccttatgatcatgctccagggttattgcaatggcacctacctggtgctccctgcttttgatccccactcctgcccccgacaccatcctgcacactccttcgggatcagtggatctgaactttctttaaacacctgagggaggaatatggccacttccaatagtagttatggttcattacatcaatgaactttttcctgaacgagggtggggtgtacattcatgtttagtatgaaaaaggcaaaaatttccctttggttctgattatttacctaccttcctcacatatacacacatagcatctacacacagtatacacagttgtggagaatcatttcactagataaatctttccataacattgcattatgttgcttccttactgagaaacctccattacttcccactatccataaaataacatccagcttcttagccagcctgtcagatctcctatttgatccaacttagtgttcctggctcttttagcattactctgtacttgaccctctgctttggctgaactcatctactcgttgtcctcaagatatgccctgtatttttcccaagtttgtatttgcttttctttctgactctatagttcctttttctctttgcattttgaaatacctatattttccacgagtgttttcttgctcatcttttggaagtaagcccatcctcagaagttctaaagcatttattgtttgagtcaccg

SEQ ID NO: 160713 - DNA, 147 bp, Homo sapiens
tctctctgctcctgttgtcacattgccttccatctctgtctcctgtgtccctcttgtaaggccacttgtgattacaagtcctacctagatgatccaggattctcttcctgcttcgaaatccttaaccagttcttcaaaatccttttg

SEQ ID NO: 160714 - DNA, 750 bp, Homo sapiens
gattcccaccatgaccgatcccccaacaccacactgagtctatttccaggcagccagtgaccaggggtgaggacttgccccagaccactagcctccctgctgagaaagcaagcagaaagcaatcagactctcaggtttttggcatctcagggagcctgcagcggtgattcagttccttcaaagggtccgtggattctcttggctttcctggttgttcctgtggtaattcttggagcaaaagttcacaatactgattcactgcaagctctttagtggggcagaacaaggcagatgactattctacaaagggaaggcagccatggtggcccagagtcagtagttggagctgctggaatgaggatgacatctagacagaagagaacattctccacctaaagcaaccagggctctttgaagaagtgactgaatccaaggctgggacatacagcatttgtgtgtgtgtaccagaaagcataaaagcactcaaataataatggggacatgtcaaaagggcacaaaagccagtgtactacaatataagcatcacataactaatgatagtagcatatttcagcccacttattaaaataggaaactatgattttatatgatgtaatagatagacctaaaattgtttagtaactgaattgtccatattttcaaagtttctgccctaaattattaatttaaagaatagtccctgttaatggggtgtgaaacaatgttctaaataacactgaaaaatataag

SEQ ID NO: 160715 - DNA, 260 bp, Homo sapiens
cactagcctccctgctgagaaagcaagcagaaagcaatcagactctcaggtttttggcatctcagggagcctgcagcggtgattcagttccttcaaagggtccgtggattctcttggctttcctggttgttcctgtggtaattcttggagcaaaagttcacaatgtaagttaccacatgccgctctgcccgtccaagtgggagctgcaagctagtcctgtctcctatatgccatcttaatcctctctccctctttttaaa

SEQ ID NO: 160716 - DNA, 333 bp, Homo sapiens
ctgggcaacaagagtgaaactctgactcaaaaaaacaaaaacaaaaaagaaaacaaaaaaaacagcaacaaaaaaccaccaaccacctacagtattagttggggagacaaattatgcaccttataaaatagctaaaagactatttttagaaaattagatattcattaaaatatcataatatgcactttatttctgaacgcttaaattgaagtagcaaaaatattagagaaccaatcaaaggttttcagcaataaagtggcattattaagcttaggaagatcaatctgctgagaactttttgaagaacttggaggcgagactaggaaacagcag

SEQ ID NO: 160717 - DNA, 220 bp, Homo sapiens
cgattaaatcctatctttttggggtaaatctacaggaagagacattttaatgaaaaccttccatgtgactatagtcgactcccattctataactttgtatgtgtagaaatggttcttttcaaaattcccaatgaaatcagcacttcaaacataatacttgggccatgaaaatacacccaaataaaatacgggtagggtttaaataacttattaaacgttt

SEQ ID NO: 160718 - DNA, 451 bp, Homo sapiens
taattagtttgtcttaaaaattagggaccttaaataaaactgaatttacttactcattgcattttttaacctagaggtggtgggtaagagaaatatagaagaataacatgtgacactgataaatactgaccagatgactaattacatgtcattatatattttcatcattatacatcattcatctatgaaaatgctgtgtttgatagtataatggtaaatatatgtcattatacttttgtccaacccatagaatgtacaacaccaagagtgaatcctaaactaaactgtggattctgggtgatgatgtgtcagtgtaggttcatcagttgtaacaaatgtgctgctctggtgggggatgttgataatgatggaagctatgtatgtgtgcaggcaagagataattgggaagtttctgtacccttcaattatgctatgaacttaaagttgctat

SEQ ID NO: 160719 - DNA, 406 bp, Homo sapiens
agctcggtaccactctgacgagtcaggattcgaatgtggttatcattggaggggagagggtgcatttttcagccttccacaccctgcaatgaaggtatcaatgtctctattttctatgcaagtgctataatgtagtaagaggcaggcaggccagagtttgactcctggctatgcccaatacgtgggtaaattatttaaactcctcatgcttgagtttcattataaaatgcagacaacaatatctcattcaaagggttgccatgaggattcaataagacattgtgtgaagtgccttttccgaagtatccattctcagcaaatgctcacaaagcagtgagtattattactattatttgagacagcatctggctctgtcaaccaggctagagtgcggtggtatgatctc

SEQ ID NO: 160720 - DNA, 199 bp, Homo sapiens
cttattcgcatacaatttaaaaatcatcacagaaggtttgaaagaaggaaggggcagaaaattacctacttttcctctccccagcgatctccttcaaatctgtgccttttcctcaggcccaggcctcaatttactgagcagtcacacctcacagagggaggtctgggcaatccactcttggtcacaggaaagccattga

SEQ ID NO: 160721 - DNA, 314 bp, Homo sapiens
ggaccaccccagtgatccctctgggaagagcttgtcctttaagcaggaccatcggcaggaaacacagcagctccgttctgtgctgtggcggctggcctccaggtatctgcagccccgtgagtggaagaagctggcatattcctgggagttcacggaggcacatgtcgacgccatcgagcaacagtggacaggcaccaggagctatcaggagcacggccaccgaatgctgctcatttggctgcatggcgtggccacggctggtgagaaccccagcaaagcgctgttcgagggcctcgtggccattggcaggaggg

SEQ ID NO: 160722 - DNA, 320 bp, Homo sapiens
agaagaactttttatgatgtctgggatttgctttaaaataattcagaaaaagaaaagtggtgggacatatatagcacaatggtgtcagagtattggtaacgggaagtgggtgatggatgcattgagttatattgttctctctgcttttgtacttatttgaaactttccaaaattagatgtaaaacaaaataaaatgtaaaagcgttataaacaattataccctaatacacttggaggaaaaccagtaaaagctgaggagaaaatattttttaagaaatatgtgggctgggtgcggtggctcatgcctgtaatccctacac

SEQ ID NO: 160723 - DNA, 332 bp, Homo sapiens
cactgtaacacttggatgaatgatctcatctgctgtgggcctagtttccatctctgcttataaccccaaatctcatctgcagtcgtggacttttctgtctacaggtctgtgtatccaagtcatcatctctgtctgggtgtcctgtagccacctcagactcagtatacactgagtgagtgttcctccctgacacacttcactggccttagccccacacctgccttttctccttttccccatgtttataagtggtgccgttatttacacattttctgaagccagaaacagattcttccctcattcatttcccacgtcactaatactaatttcca

SEQ ID NO: 160724 - DNA, 229 bp, Homo sapiens
tacaaagactatctgcttcctgtaacaactcaaatttcccaattttgcagataaggaaaatgatgcatagagagtttaagcaacttcttaccatcacccacctcaaggaactgacagagtagacctggaagtcatgcagtctatctccaaagaccttggacatacatataaccaaagtgagatgctgcccccactcccatccctcttctagtaatatatcctttctacc

SEQ ID NO: 160725 - DNA, 618 bp, Homo sapiens
aagcagcatttggcagacttacaaaggaagatttgatatttttgatgttcctattgtatagaataggtgatacgaaatgtttcttcaaggtagttggtttatttgtatttttagatgggagaaagtttatcccttgttttctttaataattagatatgatcagtatttttgtgaacttgtatcttgttttcatttataaatgttgaagaaagcaggaaccaggtaattattaagcttagtttgggctaaggtacttcaaaaataagacttgctattatgtgtacctttttgtctgcaggtcattattgctgtggtttgagctcagcatggctgtagtcatccgtttactggggcttccttttattgcggggcctgtggatattcgtcacttcttcacgggattgactattcctgatggaggagtgcatataattggaggggaaattggggaggcttttattatttttgcaacagatgaagatgcaagacgtgccataagtcgttcaggagggtttatcaaggattcatctgtagagctctttcttagtagcaaggcagaaatgcagaagactatagaaatgaaaagaactgatcgtgtaggaagagggcgtccaggat

SEQ ID NO: 160726 - DNA, 794 bp, Homo sapiens
actgagggtctacctgttttggggaggctgctgcgacgaagagttccctcagcctccggccttgtgtgtccgactcggcagcagtgttaagttgcttttacagagttaacaggtctccaagaaattttaaaaaaggtcattattgctgtggtttgagctcagcatggctgtagtcatccgtttactggggcttccttttattgcggggcctgtggatattcgtcacttcttcacgggattgactattcctgatggaggagtgcatataattggaggggaaattggggaggcttttattatttttgcaacagatgaagatgcaagacgtgccataagtcgttcaggagggtttatcaaggattcatctgtagagctctttcttagtagcaaggcagaaatgcagaagactatagaaatgaaaagaactgatcgtgtaggaagagggcgtccaggatctgggacatcaggggttgacagcctgtctaattttattgagtctgttaaggaagaagcaagtaattctggatatggctcttcaattaatcaagatgctgggtttcatactaatggtacaggacatggtaatttaaggccaagaaagacaaggccattgaaggccgagaatccttacttgtttctacgaggtttgccttacctagtaaatgaagatgatgtacgtgtctttttctctggtttgtgcgtggatggagtaattttcttaaaacatcatgatggccgaataatggtgatgccatagtaaaatttgcttcatgtgttgatgcttcaggaggtct

SEQ ID NO: 160727 - DNA, 102 bp, Homo sapiens
agcttgattcttaataagttatgcaaatccaccagaaaaactgtttttccagacttttaaatagtgctgagcgagtgctagacactatttgttctatgagtt

SEQ ID NO: 160728 - DNA, 236 bp, Homo sapiens
tagactctgcccaaggctactagaactgataaaaaaaatttagcgaggtttcaggatacaaaataaatgtacaaaaatcagtagcatttgtatatacaaataaagtctaggctgagagtcaaatcaagagcacaatttcaattacaatagccagaaagacagtgaaatacctatgaagacatttaaacaagcaggtgaaagatctctacaaggaggactgcaaaacactgctgaaa

SEQ ID NO: 160729 - DNA, 454 bp, Homo sapiens
ctgaaggtcagagctcggtccacttttccacagggtatccttttctcctagtgaccccggcaccaggtccacttgtccctgacttcagtgtgatatggccgccccacctgaacccatctctccctcccaccagcacactgggctccctcttcggcagcaggcagcattgcttccccagaatacatcccaacatcaaccacgctgtgcatctgctgcttagtctcatacttggtggtggcttccctttccttccataacccacttatctcttggacagatccccaatcacgttacttgtcccattttcacctgtccatacatttttaaaatatatatttgatttccttcttgcggggcctggagcccctcagcccctctgatgctgccccacaaatgacctgaactccttgaagttcacccctgagctgatgcatccacagccctgggctatctt

SEQ ID NO: 160730 - DNA, 171 bp, Homo sapiens
gattttggcagaacttaaagaatagttaaacttcagcatcctgcaatttgggggcaggaagctgttttcctactaccatccttttaggcccagcccagacctctttaggctcttaatctgtgcttccttttatcttaaaagataataacctcccctccctggcttcagttc

SEQ ID NO: 160731 - DNA, 137 bp, Homo sapiens
gagctccggcggcccgcccagctgcggctgcaggtgtaccggctcctcagcacagcagggaccccggagaacggcagcgagcctgagagcaggtccccggacaacaggacccagctggcccccgcgtgcatgccagg

SEQ ID NO: 160732 - DNA, 289 bp, Homo sapiens
ccaggctgtattccggggtcaaagcaacactaactcacctctctgctcatttcagacagcttgcctttttctgagatgtcctgttttgtgttgctttttttgttttgttttctatcttggtttccaccaaggtgttagatttctcctcctcctagccaggtggccctgtgaggccaacgagggcaccagagcacacctgggggagccaccaggctgtccctggctggttgtctttggaacaaactgcttctgtgcagatggaatgaccaacacatttcgtccttaagag

SEQ ID NO: 160733 - DNA, 268 bp, Homo sapiens
agatgacttctgttgggcagcccgcttgaatccttgtgtggggcaaaggtgctttgtatgacctggagaagtgattccaggtgggtggaagcaggggcaggagaggagaatgaggcagcctgtaggacacagccaaggcaagagcaattgcctggggtgggagagtaagaggaagctgtgtcttggcattagtttcaaataaaccagattccagcagaccaaagccagcctgctcgtgcctcacctactgtgcgtcttgcgggggctg

SEQ ID NO: 160734 - DNA, 792 bp, Homo sapiens
tcaattttaaggtaaaatactggcagacaattccttgtataccatctgccttttgaagatactattctcttaagatgtacagcatttgaatacatctcagttgtataactttataaatagaatcaatgatcttgtttcctctggacttctgaaaggagttgcatttggcaatagaaatcgattctgggctggaatacatatcagtattattatctatcagtagtacattaagagctaattatatttgtcctttaaatgtactttattgttctgggatgtgccatatagctttttagaatattatgtgaattgtttataacttaggtgattgtgctgttatctcatttcccttctttagaatatgattttttatcactaatatgtatgttaatatgagaagctttaaaaaaacgattgctagatgatgtattacatttagaaaaaactcagtttttgatcctgcatatcattgtagatttaaattcaagaaaattttatctttaaatatgttgcttatctttgtagcatagaaacaaaggaattgaaggatgtcatacattattgggtgtcgttttaagttcatttcagactgacactttcaaagggcttaaagattgagtggtgacttggttccttatattaagctgcaaacaaagtattatcagtcataatggcttatttaaaactggaaatttttttgcatgttttttgacttatgtgaaaatttcaggtaaaaatgtggcctgagtagtttttctcaactgtaactcattttcctatgatacctatttc

SEQ ID NO: 160735 - DNA, 384 bp, Homo sapiens
agcatcatgttttcaagtcagccacactgcagcacgtatcagaacttcattccttttatggctcggtaacgttctattgtggggatacttcagtttgtccattgatggacagtcagttgtttctacctcttgcctattgtgaacagtgctgcttgtgcacattcgtatccaaggatttgtttgtgtacctattttcaattttggataggtacttacctaagagtgaactttcatgaaatttgaaaatattgtagatctgtttatgtactgtctatacacaccacacaccacacacacacacacagagtgctttgtacataaaaggaatagtaagataagattttttcaccccctaaaaattatttttgccccgttgggggccat

SEQ ID NO: 160736 - DNA, 151 bp, Homo sapiens
acgtaaacgtttatttatccaacactacgcttattaagcatgtatcaggagctgggctaggaggtaactctttggcctacatcgaatgtcatgatacctgccagaattcacaagatctgatctctgtccatctctccaatcacatttcatt

SEQ ID NO: 160737 - DNA, 271 bp, Homo sapiens
aattgccaaaacttggatgcccacaagatgactttcaatcagtgaataggaaacaaagtgtggtactctgacacagtggaatgttatacagtgataacaaggaaatgagccaacaaaccacaaaaaaaattaaaggaccttaaatgtatattgctaagttaaagaaggcaatccaaaaaggctacatactgtgtgcccagttttgcctgttccatgacttcatatgggtagggtcatacagtatgtagcctttttggattgccttctttaa

SEQ ID NO: 160738 - DNA, 234 bp, Homo sapiens
aggcccctcacattcttcccacccccattacctctctaactccattttctaccactctccttctttccacctcaaccacagctacagtgacttctttgccctttctcaaatctgcctcagggcctctgtactggacactctctccccactcccactccctcctccaggccttcactgaaatgtctccctctcagtgaggacttcctttcctaaactgcagtacccccaacctac

SEQ ID NO: 160739 - DNA, 233 bp, Homo sapiens
attgctctctttccaggaaatgttgtgagctgcagtgaaagcttgagatgttgcatttttttcaactcaagcatgtgtttttcaaaaatatcatccttcccccccaccccactaattttagaatcagaccaaagccaagctactgtcctctgtttctgttgggaaaatactatatttattcgagatgcagaagtgtgtctctgcaaacctccgactgcttcaggaaaacaaat

SEQ ID NO: 160740 - DNA, 550 bp, Homo sapiens
aagcagttaaacagactcaagatctggaagtgtggcagccatctgtgatcatgagacaacaagcctgagaagaagggtctacgtgctaagatgatggagcagaaacatggaacagcctgatgcactggcctagactgctcaccccaactttctatttgtataagataaatctactcccatctgtttcagcatcttgtatttagagctgaatgcatttctgacatatacaatacagattctattttccaaagcctctggtttacctgattcgggtccttgttgttgttgttgttgaaccggactcataagaataccttgcgtaatattttctgataacaggccaggcgctgtggctcacgcctgtaatcccagcactttgggagctccaggcaggtggatcacaaggtcaggagtttgagactagcctggccaatatggtgaaaccccgtctctaccaaaaatataaaaattagccgggcatggtggcaggtgcctgtagtcccagctactcaggaggctgaggcaggagaattgcttgaacccgggaggc

SEQ ID NO: 160741 - DNA, 430 bp, Homo sapiens
taaagcgtgtggcagtggtgaaactgaggccctggttcagctaagtgagccagcctcgggaggcctcttccgaatttatcacgtaaactgaggcctgaccgtgtcagttccctgcagatgcagtttcctacattatggtgccataaaaatgcctcttagaagatctaaaaattatgaaaaagaactattctcttagaaagtatcttcatttaatttttccagtgttatgacaacaaattgagataggcacaagttaattaaacttaagtttatttaaccaaggagagaaaagttaatatatagtcaaactgtgtccatcattatctcaggcctattccagcttgtaagaatccagtcccttcagaagcaagaacaagcatttctgtgccccgttgctctgttcatgattctattcatccagaaccactcc

SEQ ID NO: 160742 - DNA, 103 bp, Homo sapiens
atgggggtgtctcatccttgaagacaagcttgtcaaacccattgtccttgggctgcatgtggcccaggatggcttttaatgtggcccaaaacaaattcataaa

SEQ ID NO: 160743 - DNA, 124 bp, Homo sapiens
ggagtgtgcttgtagtctcagctacttgagggctgaggtggaaagactgcttgagcctggaaggcagtcagctgagatctcaccacttcattccagcctgggtgacagaatgggaccccatctc

SEQ ID NO: 160744 - DNA, 243 bp, Homo sapiens
taaggactaagtgacaagaggatgtgtttggattgctttgactgatctgacttccattttaaaaggatgttctttctggccgctgtagagaatagactaaagcagagtcaggatggaaggaaggagtcagcttttgaaaaaggtgagaggaagacttgggtggacgaggtggataacagtagaggtaataagaggtgataagatacacgaacattggatgtacttagggcaacagtatttgct

SEQ ID NO: 160745 - DNA, 282 bp, Homo sapiens
ttggaattgggggaaggagcagtgatatgtaagctgagacttacataatgataggccacaagaaaagtattccaagtagggaacagaaagcacaaagtccctcaaacatcgaagaaacagaaagaagaatcatagatcatggtaaacaaaaggggagatgatacaagatcagaggagtagtcctgtaggatgttacaggtccttgaagaccaagctaaagactggtttttttatttacaagtacaaaaggaagcatttggagggttttaagcagggaagtga

SEQ ID NO: 160746 - DNA, 862 bp, Homo sapiens
tgctggtggtggtggtagggttagggagggggtgcagcaggcagcccggcctgcaatttgaataactaactacatgaatgacaagtgccttgacctcagacctctccttgaagggttctcctcctgggggcgggggacagaggtattgttagagaagtcagggaaagtatggcattatgagagagagggaaaagagagaaaagaaaccagcatctgcttgaggcttgtcatctaacacactacgtgtagttgggtgccagaggcttcacgtggattacctcattttaatctttttatttatgggttaagggttggcatctccggtttccagagacaaggagaaggtaaatcgtttgctccatgtcacaccaggtttctctaacgccaagtctcttgctacactgtgggcatgccacactgcccacactcccactcctactctttagagacatcaggggcttctcttctgccttcaggcttcctgacagtagcagtgaaaagaaaatctcccgatcactgacagcaatgatgccaggccttttttggtaaaagggccaattcagtaaaagaaaacgtgtttatgggctgaatctttttttccattgaaagttaaaataactttaccgaggccctgagggaaagtggatgttcttacaacctaaagagtctgctttgttaattaaagatggttactaagaaaattgttattgtttttagcattaaaatattgctgctgagtatatttgaggaataacaacatggatgaatgtagctttataatttttcctgtgttaatttgtatatcactttaaagtttataatgaatgttctcatgctgctggtatcattaccatccactctt

SEQ ID NO: 160747 - DNA, 262 bp, Homo sapiens
ctcagctgtgacacaggtttttggttggaagtgggggtagggacggagggtggggaggtcatcaggttgatgacagtgggttttaaaaatacagagctggaaccaaatctgaattggtgatgcctaatcttggccttatttttaaagacaacctcagatggtattattggtgggtaagtgatttggtgcaagctttctgcagactgatttgacggtaaacatttaaaaaatcatagaattacatgtatctttggactctcca

SEQ ID NO: 160748 - DNA, 439 bp, Homo sapiens
ctcttagcatattaaaaaaaatatatgttctctgtagacttgtatgaagacctaataagaaagactgcaacaactacagttaagtgttactaaacaccgtgaaggagacttgacccaaagtcctgcttgtactaaggcaattatgtctattaacccaatcccccaaaataccatgatggctgggccctgcattgaagcccttccctcagctgttactccatgctcttggtactcagcctgctggttcctgacccaccgtttgaactgagaagcagccctggaagcagctatcttctctgggcctatggcttttgccagctgctctcagcagtgaattgtgaggccttctctgctccagggaggcacctgcaactgctggggagaagctccctttgtgcctttttttctttttctttttcttttcccttttttttttttt

SEQ ID NO: 160749 - DNA, 204 bp, Homo sapiens
tgtgtttaaacacacgtggtaaaagctgtgggaggccaggaatgtgtctggctcattcaccactagatctgtagttcctagggcagccagcaactagcatctaggaagcactgggtaaatatttgttgaatgaatgaatgaacatcttttgattttcttaaaccagaggcattgatttgcactgagctattcacacttcctcac

SEQ ID NO: 160750 - DNA, 481 bp, Homo sapiens
tgttgcccaggctggagtgcagtggtgcgatcttgcctcactgcaagctctgcctcccgggttcacgccattcttctacctcagcctcccaagtagctgggactacaggcacccgccaccatgcccagctaattttttgtatttttagtagagacagggtttcaccgtgttagccaggatggtctcgatctcctgacctcgtgatccaccctcccaggcctcccaaagtgctgggattacaggcgtgagccaccacgcctggcctaaaatttattttgaatttgctattccttttacccacacaattcaggaaatacttgaccacatttgtggagctctggagcagggagattggaacacacatttctaccagtcttcctttacatcccataatgtagtggttcagaagaggtttttttccttactttctactctgtggcctctccactttatctaaagcttaatggttgggatgtgacag

SEQ ID NO: 160751 - DNA, 396 bp, Homo sapiens
acagggaaatatgagtgcttcatgtcagataaaggaaacaattcaaaacggtacatgtagaatcagcaactgttttgaaaaagtacacagggaaaaatcacggaaaagaaaaacaacaaaatgcttttctagctggtcgttttccctctttctgtttctctctattttctgaagttgacagcatgcatatgctacttttataatcgaggagacaaatttaaaaattttaaacgttgtagagcattttcctattctataggctcaggaaccctgttgcctgcaccactgcttatccaatgtccctgacaacagaccgaacctcgtagaatcaatagcagacgcttgtcactcctataactgttataccctgatgtcaatgggctgctgattactcag

SEQ ID NO: 160752 - DNA, 614 bp, Homo sapiens
gactggatgagtactcgggagtagatttctttatacctacaaactttattaaaagctttttgattgaagacacactttcactttttaaaatttaaatttttgttttatttttaagaacaatctcagaccaaaaaaaggcacagtttcaaatttgcacattcatgatttttctggaaggattgcagaatagttggcacattttgggatcaagtagcttgggattttcttcagatttgcaaccataaatcttgtcgtatgagaaaatactggaaagttactaaggtgcttaacaaagcaaagggtttgacagtcatcagaatggtgggatttgacttcgaatgctattttctgtttatcgctctggcattcttgaatggatttagtgactccctggaggtccagcttggtaaatgtcatatgcttgctgttgacattctagtattggggtatagatacctgttcttactggcgagccaatgttgatcgcagtagtcattacatgggttatgtttttcgcagaggcagggaaggtgagggaaggcagagaaacaaacttagtcataaatgtttttgaatatttgtttattctgccctttggctcccgaaagggagta

SEQ ID NO: 160753 - DNA, 747 bp, Homo sapiens
gactttggtctttacctgatagaaaaaggaagttactgaggaatttaaagcagggtcagggatgtgatgagataggaatggcaatgaggaagttggatgtgggagttgcagggacctgcaggctgcactatgacttggggaggatggagggacagcagaggggcatgagatgggctgacatctggcaagtagtgtctagtatggacaatcactcttacagccctcctcagtcgcttttggcaccctgcctctcccccagccccaccatagaaaataacatgctgtgctgtcacttaaaacccccttttcatggccgggcgcggtggcttacacctggaatcctggcattttgggaggccgaggcgggcggatcacttgaggtcaggagtttgaggccagcctggccaacatggtgaaaccccatctctactaaaaatacaaaaattagccaggtgtggtggtggcacgtgcctgtaatcccagctactcaggaggctgagacaggagaatcacttgaatctaggaggcagaggttgcagtgagctaagattgcgccactgcactccagcctgggtgacagagtgagactccatctctaaagaaaagaagaaagaaagaaaaagaaagaaagaaaccaaccaaccatgttgctggtccctgaagtagtccgttttaggctatatagctctgggtgatgagagagatatggtgtagtctgtgttgaagagtgatagaaactcagtttgg

SEQ ID NO: 160754 - DNA, 402 bp, Homo sapiens
gatttctggatcttgcctttcccagatctctctcctttctacttcctcggcttcttcttgggaacgtaaaggcagaaaaaactaattgtagaaactcctatcccgcggcccgccctccttttcatcagagcttcttcggggtcaacggcgcggcagcgtctttgttactccactgccaacgcccgagggctagaggggcgggatgggaacttctcctgcgggctcgggacccactgtttctgcctctccaacggcttggctgtgtgaaagcgagcgaaggtgtcattcccgggagggagaagcgtcgccgcagggtgactgggaagccctttccttgggcgcgcggagcccagggcgcacggctgtgccgcccgggtttgccctcggagcgccggcgggccg

SEQ ID NO: 160755 - DNA, 329 bp, Homo sapiens
ggagacatgatacgaatcgagctggtacccctagttttagaagtttcaatagcaggagccctccttggcagactgggacaccaacgcctcttccctcttgggctgacacgagctgtaaatgtcagtggacatttaaatactgcgttacacattcgatgtcctgtctgcaatggagccgggttctgtaaacataagctgccatggcgaaatcggatcatcatcgcccatcaagctctttggcagcagtgctgtaatcagtgcaaacatttatttatataaatgctcccatccccaggcagcaatgtgctattgaaacttctaaaactagg

SEQ ID NO: 160756 - DNA, 511 bp, Homo sapiens
tgtccacccccgaagtgccctgagccctgcccaccaccaaagtgtccacagccctgcccacctcagcagtgccagcaaaaatgtcctcctgtgacaccttccccaccctgccagccaaagtgtccacccaagagcaagtaacagcttcagaattcatcaggagcatgaaaggataaggataattggctcaccttgttccacagcttcacctgcatcttctcatcaaagcctaccatggatacacagttagcttctttcctcttagccagtgatctgcccatgatgatccctgatagcaaaaggtttcctttctgaggctgccatattgccactgtccaggtggagactgagaaaggaagtcctcagcagtgtcagttcccagagctttggaagaaggaccagcagctctgtccctgggaaccatcaaaaaatgctgttgatgttttctgtgtctgtctgtcacctgggcatgggcttctaacacctgtgcaattgtcacttttctttcact

SEQ ID NO: 160757 - DNA, 407 bp, Homo sapiens
attgcaattttagataaggcggtcagagaaaagatcaccttaggtggtatttgtgtcaagaagggagagagaatgtttaattctgtgtggccagattggaaactgagaccctgctagggaaagcaccttaaccaaaaatcgtacggtagccttgttcttcctcccagatgctgacaactcacttctgtgtgcacatactcctccccccgccgcacaaccccatcattctgttttgtgccagacactctacactaattaatgatttcacagcccttttataaatctcagcctaaggactgtaataagaagttccattgaacacccctgctgccagtactgcctgagtctgggaagtctggctggcttagaatctgtaccaacccctaagacgatctgatgtttaaata

SEQ ID NO: 160758 - DNA, 181 bp, Homo sapiens
gcactggtgattattacttagtttatgataatataattcagattaataccaacttaattgtaatcatacataaaaactttgtccctacatagcttcattccttctcccttcctttgtgctttgtcataaaaatcacatctttctatgttgtatacccatcaacacatgaatttataattat

SEQ ID NO: 160759 - DNA, 431 bp, Homo sapiens
gagacgggaaaccaggtttcttatcctttcttttggtatgtgaggtagggggctgcccagcagtgcttgaaacaaggcatcgatcaacagtagacacttttagttccgggtttcattctgcaaacacgcctgctgcctcagaatcagaacatcattagggtgaggtcgccagagcacactgacagctctcatgataaaacactcatttgacactttgctcataagagcaaatggtgtcgactgctagagaagcagcagagcagaccgatgcaacctgcagacgcgttgcttcactcaagtttggaaatgtacagatatcaatatatacacgacgacaacagcagatgcctgctgagaaagcactggccctaagtcacacccacggccagcaggtggccaacagggcactgcatgtcatggctgcttcccag

SEQ ID NO: 160760 - DNA, 149 bp, Homo sapiens
ttataggtgaaattgaggtaaaggattttaaaaagtgttgatattaagtgtgtctatagaaccaaatccctcaagaattattctgtatgcacctaaccaattttcatctacaaaatacttgagataaacctatgggaaacaattttaat

SEQ ID NO: 160761 - DNA, 257 bp, Homo sapiens
tatctggtttgctgtacttctccaagacatactgtttagagatctaaaagccacatacactcagtgtagctaatcttcctctctgaaaacttgctggtgacttccatataaagcttccctgggcaaaactacacaagtgccttccttcatttgctccttgaggaatttaaaatctgtttttttttttttttttttttttttaaatttatccttaaggtccaggggaacatggtgccacttcctgcattatgtccccc

SEQ ID NO: 160762 - DNA, 319 bp, Homo sapiens
tcacttctccagccccatctctagcttctctctcactcacaatatattcaagcaataacaaatgcattttatgtcttcaaaaatgccatgtatttgctctcttctttgccttaattacttttcttcttctagcaactggatatgtgtatagcactcaaaacaatgaagtttagagacaagactggcttcgccacttgttaagggttttgtgacagagttccatacatgaagtggccctcatctgcagaaggaaccaagaaaccaaagaaggaggcagacaggtccagcttgtcctcatatggtgattttatttgggaac

SEQ ID NO: 160763 - DNA, 369 bp, Homo sapiens
aagggatgcaaggttcttagaatggggggaaaacgagaagaaagcctgacagaaaaagactttgaaagagtagaatacgatcagtcagtgctaggtgcggtggctcatgcctgtaattccagcactttaggaggctaaggagggcggatcacctgaggtcaggagttcgagaccagcctaggcaacacggtgaaaccccgtctctactaaaaatacaaaattagccgggcgtggcggtgcacacctgcaatcgcagctacccgggaggctaatgcaggagaatcgcttgaaatggggaggcagatgttgcaatgagccaagatggcgccatcgcactccagcctgggtgacagagtgagactctgtctc

SEQ ID NO: 160764 - DNA, 494 bp, Homo sapiens
actatgtactagtacctaagaagaaataccaggcttagtaaagcaaacaaaaaaccattttaaacataagcgtcaaatgactctacacatcagcagagatggaaatagagctgcacttaaaccacagagaaaggcagctggtactggttcccctttctgtggaaaggaaaataaaggaagattccgcaattgctgtgagcacagtataagaaataaaataaatgtaagaagaaaagtcaatggctcataaaacatcactacatgttacctcatctgtgctgatgataagctgggaccaactattccactctggacatttgtctctctcttcaaaggtgacatgctcagagttccagcaacaatgttcatggttaaaccagaatccccctgtgcatataccttcttttaagtctgtcatccaatgagcagagatgtctatcaaaccagctaacgaacctgatttgtggggagggagggaaaggccaaagttaaac

SEQ ID NO: 160765 - DNA, 367 bp, Homo sapiens
tttacctgtccacatgcctgtatttagaggttctgcctactttaagaaacagtgacactgcactccactggaatcatgcactctaatttatttaactgactttttagtgatggacatttaagtatttccagctttccctactataaacaatactgcattgaatattttttatatttacatccttgcacatttgtgccagcatttctagtggaattgctggatcgaaacatatgcacttataacaatgatagatttccgcaaattttccactaaatccccaatagatgttttagcctccttggtagccttggaagcttggaattccagtgttttttttttttttttcttctctacttccataatagtg

SEQ ID NO: 160766 - DNA, 119 bp, Homo sapiens
ccgtgcaaataattcaatgatgaaatccctaagagtgttagaatattggctaagatcctcagcagagaaataagtgacaaggttataacatagatttggtgtttgctttatttctgaga

SEQ ID NO: 160767 - DNA, 550 bp, Homo sapiens
  misc_feature (25)..(25): n is a, c, g, or t
agattactgatgtttcgacgcctcngctcgtagtctcttggctctggggacatcagggaatctccatggtggggcagagtggggacatccacagctggaagccacagtcagcccccacaccaccgtcccgccctccttgtgatcacgtggtttcacgactacactttttgaattcccggcagccaccatccacacccctcaacctgatattttcaaggggattcagcacgatctggcattccacagactccacctgccaacggccagctgactttctcccaaggagcacaggtggtgcaaaatacgcactgactttcccaaaaatgacttgtcttatgtgagaaatttaacaaagtattgtcggattatagaaagaggaccaatttaactaggggtggaagaagacttagaggagctaattttctagctgaatcttgaaggaatagcttagatttctgtttgtgagggaaagtcagtgaaaaagagggtgttccaacttaaagaccactgagatgaggactctagaaggaattagtgttctcatgtgact

SEQ ID NO: 160768 - DNA, 381 bp, Homo sapiens
ggtagccatcattctactctctatctccatgaattcaattgtgtgaatttgtagttcccacatacaagtgagaacatgagaattgtgtctttctgtgcctggcttattcccttcacataacgtcctccagttccatccatgctgttgcacacgtcagttctgttcacaaccatatcctgcagttcacacttgtcttcagttgggttctcagctattccttaggcataaagtacagtctgaggcattgtgtactcaagagaaatttgggaaatggggttacttgggggggtctgagcactgtggtcaccctcttaattcagctgaggaacaagaagggctcaatcccatatgcacatatctcagaccatctcagagacaggt

SEQ ID NO: 160769 - DNA, 639 bp, Homo sapiens
catgagtcaacataggacttaaagcagtccccagtcctgcccccaccgtgcttcactgttttgcctctgggcctctgctcacctgctttcctcagcccctcggattctttccatcatcaccagctgcaaaacactgccagtctcccaaggctcagctcagatggagcctttcatgacactgtagccagtcactgctcccactcctgcatctccgtgatatttggacacttacagcatttcccacattttgctccaagagatagccatgtttggctccaagaggtaaccatcactatacacacctcatcagccctattacaccacacattcctaaacgacagggtgatttcttcattcattcagcatgaatgaatccacctgcatttacctagtacctactgaatggtaggcattgacttagatgctggggacatgggaaatgaaacataaggggttgcctgtgttacaaaactgacattcagtgggaaaaagcggcagcagaccagtaagcacatacataaatgaaggacggattgtgaaaggtgctagggcaaaaataaacaggaggttctgacggagaccactctagcagaagtggcattggaggtatatgctgaaagccacaggaataatggtctg

SEQ ID NO: 160770 - DNA, 227 bp, Homo sapiens
aaaagtgcataaacttttcactccacttaacttcaaaagccaaagactcatgcaatcctcagtacttaggatcttggaggaagtttcagagtttgaaattaaatttccttttattttattttattttgagatggagtctcactctttttgcccaggctggagtgcagtggtgcgattttcagctcactgcaacctccgcctcccgggttcaagcgattctcctgcct

SEQ ID NO: 160771 - DNA, 296 bp, Homo sapiens
gggggagcctgactgagggcggcaggaagtgacgggcactcccaggccactgctgtccccagggtgactaggccacaatggcctccttaaggagggagaataatgagctcgttagggccagagtcaggccagctgcacacaattaggatgttaattaagtcctctgaggtcacagctcagcctaggacaaaacagctggtggggggaggggagaccccccactccttcctctccctctgaaatcctctcgtcctcccgctctgactcccaaacctcccagccctgttcagcccagg

SEQ ID NO: 160772 - DNA, 368 bp, Homo sapiens
aaatcatggacattatgtcatgcatacctattaaaatgacagcctgtgtgccatggtgctaagtgtgaaatgggctggaggtacaagagcctgcttccttagaagaaatctggtcaaccagacaccagctaaaagagacgaaaatatgagctcatggggcttcgtctcccatatcttgtaatttaaacttcagtaatggaatgaacagattgtggaggagacttacaccgcatgggtgctggacagtcattgtaatagtagcatattccacgttgtgaaaaacagagatgataacagcggagcatcctgctctccctttaataaaattcccccgtgctgctatgggcaggcatttaagtaggttaacg

SEQ ID NO: 160773 - DNA, 146 bp, Homo sapiens
attgatgcccagaggcccacagcatcatcatgaccccctcacattggggattacggagaccacgaaataaacctggacacatcacggctcaccatggggtcactgagtccacagacccagccctggttatctccccattctcctag

SEQ ID NO: 160774 - DNA, 586 bp, Homo sapiens
ccccactacctcagattaatataacctccttctgtcaacatagttgacaaggtttcagctttcttaattcacattccaatcctgtctcccagaaactataacctactcacttttgaccagacttgggtatccccggcccttttcagtcacacattttcttggaattacttacagtgatggctaaattccatcactctatttgattcaggctggtgttactcccagaggatgacttaattttcaaattatgaggacatttattttgccctttgtatgactatagggcatcactaagtattgaataatttctccagatatgagccaactagtacagtgtagagtatggcattcaccttccttgtgcatgactttatttatatgtgtgtgtcaactcagcccaagattaagattgtataaattttagggacagccatttcacactttaatttatgtcaagcttttttttttttttttaagtggagtcttgctgtgttgtccaggctggagtgcagtggcacagtcttagctcactgcaacttctgcctcccgggttcaagtgattctcctgcctcagcctcccaagttg

SEQ ID NO: 160775 - DNA, 408 bp, Homo sapiens
tcaccatcttggtcaggctggtcttgaactcccaacctcatgacccacctgcctcggcctcccaaagtgttgggattacaggcgtgagccactgcacctggcctagcctttcttaatcgtgtccctcatcaatgaaatggtagaaagccaatctgttttacaggtgtggtagaagggaaaaatgaagagacctctgtacaagcctttgcagaggtcttgggactcagtggtgagctccctgccaccacctcctgtgcccttgcaggagtaggagatctatagtcttggagaataagggtgataccccaataccccaagcctggttagggaaattgatgacccttattggagcctgtggggaggtagttgggaaattgttagtagcttcatgttggcattttctttttt

SEQ ID NO: 160776 - DNA, 131 bp, Homo sapiens
gagcagcctcaggtctggagagggggcgaggacagagaaagagctggttttggtgcatatttgcaggaaaagttgtagagcctgctgatagattggaagctgaagatgaggaagaaagagaaggcaagggt

SEQ ID NO: 160777 - DNA, 188 bp, Homo sapiens
acacaaggccagtgtcgatcccgctcacagccatctccccagagcctagcacggtgcctggcacacagcaggtgctccatgaatatttgctgaatggaagaacgacaggatgaattcccctggctgtgagcagggaggcctggttggtcatccccaattttccacctctccctgctgggcaaacacta

SEQ ID NO: 160778 - DNA, 244 bp, Homo sapiens
atgttgagttccgcagagcaccaagaaaaggaaaggaaagaatttgtatctttgatgtattagttaatttgactaggtgcctacccaggcagggcaaatctgatcaacaatccaatgtgtctcttgctatgccaattgcaaaaggagatggggtttcgctttggacggtcctcagggtcagccactttctagctctgagtccactctaaatgttctcaagtttgttcgatttgaatttcaaaaa

SEQ ID NO: 160779 - DNA, 224 bp, Homo sapiens
atttctaggctattgattagtcacatcagcactgatccatttatttcacttaacctcctttttcactaaaacttgtaagcagaggcaaatagagagccttcaagaggtgacagaaatagctaaaacatttagaaggtttttaaaaatggtaccatcagaactgtgaaaagatgtccccagagtaaaagaacagtgtgggtggcactactcagtcttagtgggaa

SEQ ID NO: 160780 - DNA, 246 bp, Homo sapiens
ccaggtagacctaacaacttactcctgcgccttattaacagtcacactcctttctagttggacaaaagagtgatgtttcagggcttttcttttgactgccccctgtggaatggccaggtctctgcttcatgactcttcatgctccttagacatcactcaaatcaaaaggccagttgattacagttctggaattagagtgcagcacatattcctaatgactcttctttcctggttaggtctacctgg

SEQ ID NO: 160781 - DNA, 251 bp, Homo sapiens
cagcccaggcccttcctctccccactcttctgcaggccctctaggactctggtaagtgagcagtatccttgttctcagctgaacattggggcatgaacactgaggtgggcactgagtttgcctactttcttggaagctctccgactcttgaagggccctggatctgctttggagatggatgggcacggagcatttgtgacccccagtgctctccctggcatgttgggcttattgtgttgggagcagcttct

SEQ ID NO: 160782 - DNA, 270 bp, Homo sapiens
ttctttcaagaataaggataattcgtttgcttatgcattacttttgttttctgctatgttccacaagtggcataaaataactatgaacctatactatgtatcacaaatcatacaaagagtgaacaatacaacaaagatgaacaacacaccaccaccacagttcttgcccttaatgaacttttaatgacacttaaatttctaaaatgtctaaccagctggttttcctacctccgatgtcaccccactttaatgtcttaaatatggttcctg

SEQ ID NO: 160783 - DNA, 533 bp, Homo sapiens
tgtcattaccacaggaaggcatagtttatggtgctatgccttactttagaactgtaataaggtgagtgctcttctttctttgtacttctcatttcgatctgctaccgtcagtctgtcctagccatcattcttcaagctgttgaattgtgggcttggcatatattggttgtcttagacttccctggagttctgtgttaaaacagtaatgtcttcagaagcattcatgaaagtgatcggaaacgatagaatgttgagtgagaagggattttagaaatcacataatcttttaattttctgaatagttttagccatgaaaatcttagttcatgtaaagccttacttgaaaacccaacagataaatttggaactgggagttttgaaaatcactgaggattctgaccccttttattttgcaagtgaagattcttaaatccagaagggttaaacgatgatgatctacagctctttccaccttactcctcttggcctgctgtcctcagacttctgaattggattatggttctgctttgttg

SEQ ID NO: 160784 - DNA, 399 bp, Homo sapiens
cattcagtaaatgtcacttttctccctgctggcccttgtctgacattactcagcatttcagaagtggcatatactatggacttacaacaagccttgaacattcttggaaaacttgcccaagctggaatcccatttttatctttataaccatcttagagatgagtagggcaggtagagtcgttgtgattgtggagataaagagcactgagtaaccgatggatgggaacttggccttccccacattagttaaccagtcagtggcagcccttggatgggccccgattcttgcagcaaagccctattgtagccactgatgtggttctcggttagctggtgaggtcagtatggggtcattccttgcttgccaaatcccttgtccactcccagctggaaaaaatt

SEQ ID NO: 160785 - DNA, 369 bp, Homo sapiens
ccaggcgggtcaggcacctcctcccatctcctccagtcccctcctgcaccacagcctttgtccctctgcccccggtggcctattcaggggtctcactcgccctgcaggagctgctaccgtttccccagtgccaggcgccggcgtgctatgcagtcaggagtgctcaggttgctacttaagtgcggaagttgctgggtgacccgtgcaagtcatctttgtggaattaggttccaaagtggcttgagaagtcgggggaggtgggcccagcttcagaattgtctggaaccttccccagcctctggctatgtctgccagtcacccccaggtggaggacaaggacaggttccaatcctcgtcttgcgggggctg

SEQ ID NO: 160786 - DNA, 367 bp, Homo sapiens
  misc_feature (217)..(217): n is a, c, g, or t
agcgttctcgaggatcaccggaaggcagacggcacagaatccttgtcataatgtagagaaaggattgtgttggagtgaggcaaagataatatttattttgattaccgaattttttgatacttgcttaaatttagtgcttgagatgagtgcttcactcagtttaccctaatctggccctggttgaattaacaaaccttagaatggttagatatgttanagttagggagaagataagccaaggtttaatgtagtgttctgaaccttgaacaactgggtaggtagtggggttattaactgagctagtgaggaaaagccagtttggggcaatgttgataaatttagttttgaacatgttgcattttatatg

SEQ ID NO: 160787 - DNA, 245 bp, Homo sapiens
gaacactctgtcgtctttctttttggccctcctccagtttatagtaatttctccgtagtaatcccttgaatctcatctgtcgttcccagaacacatccccttcccttgtaactttggatgcatagttgtaattttcagtaacctatgcagtcagaattaagaacatcagaatagcaacatcggttgaagtttatgattcattgagagttccatagtcttcttattgaggtgattaattcaaagtg

SEQ ID NO: 160788 - DNA, 546 bp, Homo sapiens
gaagcagttagtacagactcatggaaatattcaacaggaagatgatgatagcagctctggaatttaggggacaggtcaacacttgaaatatatacttgagaatcattaatgtattcattcaacgaaggtttgaaaagagcataaaatgttctaggactgtgctaagatctgagaatcccaaaacagtgagacaaagatcttgttatcaagaagctcacagtctggagaagaagatgaacgaacagaagccatcacaaagcaatgtggaagacaacaatagagatgtgtcaaggggatatcatggaaaccccaaggagactgacaggtaatcgataatgatctgcctcaggaatattaaaatataatagccataagaggaagttacttttttaagtctgtatttgaatacttaatacaatgtcacaaaaacacacagaagtcattcaacaactatttcctcaaaatgagatgaactaagacagtccatgaaaaaaggttgttacatatgtatttgtgtgtgtgtgtgtgagtctgtattaactgtgt

SEQ ID NO: 160789 - DNA, 280 bp, Homo sapiens
tggtgataaatgaggtagttatatcttggcttggtgtgaggagtgaaagagttaatatctggcacttaataatatgcaggacatgtgttgaaggagggctcaataaacgccagggatgatgatgatgatgacgatgaatgattatgatgaagaaaaccatctccatagtctcgtaagttccatttttactttccagtaactgcctccctttccaccctagttccataattgccggtcccgagatatatggaaccatggttataatcgccggtcacgagat

SEQ ID NO: 160790 - DNA, 323 bp, Homo sapiens
tgcctacctctcaggacaatgtccttttggctccacagtccctgaagccagagctggtgggggcagggaggcagccaccagcctctatatgtagtggaggagggggtgtccagggaggggctgcagggttccccttggcctgcaaacaggaacacagggtgtttctcagtggctgcgagaatgctgatgaaaaccccaggatgttgtgtcaccgtggtggccagctgatagtgccaatcatcccactttgccctgagcactcctgcaggggtagaagactccagaaccttctctcaggcccatggcccaagcagcccatggaa

SEQ ID NO: 160791 - DNA, 149 bp, Homo sapiens
caatcctaaatcttcagaggacagagagcccacatgccaccattccagtactgaatagcagcttgggtcctgagaatttccggtacccacattttagagactttttgtctaccaaaagtaacagtttcattcaggacaagaggttattc

SEQ ID NO: 160792 - DNA, 305 bp, Homo sapiens
caacaaaggattttaaatgttacataaatttaattgataaaacattggaagggtttccaattttgaaaaaaagttccgtggataaagtgctgtcaaatagcatcagatgctacagaaaaatcttttatgaaaggaagcatcaatggctgcagcaaatttcattgttgtcttattttaagaaattgccacagccaacccccactttaagcaaccatcaccctgatcagccagcagtcattaatatctaggcaagatcctccacctgtaaaaagatgatgactcactgaaggctgagatgattgtta

SEQ ID NO: 160793 - DNA, 893 bp, Homo sapiens
gggatggtcattgcagaaagttgggaagaaagtctcatcacctcactgttagattttacatatgtttatgtaattttgtgaattaccagtcttctgacttcaacacaaatagcaaattgcaaagtgttacttggggttcttgggatgggttgggaagacattctgacaatctcagaagttctaaagaactagttttatcttaactatcactaatttgcaaagtacatgttcctttttcctctggctctaattcctctctaacaaaagtatttctaaatttgacattaatctctggtgcttcttcaatttgtgcatctgcaaactgatttttttattaaatgagataacatgaaaatatttgcaaatataagatgatataatttctctttttttcctctgtcgttttacaaagtgatctgatgtgaaacaaaggtacagaaatctagtcttcctcagactttcagatttataatcatttttttgtttgtttttttaactactaggacccttgaatagtagcatatcagaataccatgttgaaaggaagctcagtcatatagtcctattcctattcactcacccaactccagacttttaaagttaactaacagtcacctttaaggaagaatttacacagaactttcaaagcaagtaataagccaaaataaatatacttcaggcaagtaatgaactatcctttgtgtctgcaattgtctttagcttaattgatgccaggactgtgcttagactatgtggacagggatgggagattgctttttatctgatctcaggtccctgcattcataggcatcttccagattgcagagaggacctgtctttatcagttgctgtgagctgtagcttcagcgtgtctctttactccctaaacattg

SEQ ID NO: 160794 - DNA, 703 bp, Homo sapiens
gcgttctctaaagcttccaaaaggatccagtcccagatacgtattacatttagtcatcatggctccttcgtctcctctgcacaaggggaagcagcctgtggccctcaccagatgcagatatccaatcttccagcaaacagaatcggtctgcctatcctcacataagccaatccattctccatctcctttaagcagacatatactgcctcgtaagtataggatgccttgtagtaagatcaactttaaacattcgcctggtagcagaaccataacagaaccctgcactcatgatgccttctgaggactctgcccatcttccttgattaactccagaatacagaagcaaccctaaaaatgcaagcaaacatcctgaagaagtcaggaatggatttttctaagactctgtataggcatacctcgaagatattgtgggttggatccagactactacaataaagagagtataataataagttaagtcacataaattttttatttacttatatatacactatattgtagtctattaagtatgcaatagcattatgtcttaaaatttgtgtatatcttaatttaaagatattttattgtgaaaaatgctaacaatcatcttgagccttcagtgagttataatcttttggctgatggagcatcttacctcaattgtggtgactgttggcagagtggtggttgctgaaggatg

SEQ ID NO: 160795 - DNA, 261 bp, Homo sapiens
gtaccaccatgcctggctttttaaattttttgttgagatggggtcccactgtgttgcccaggcagatcttcaactcctgggctccagcagtccttccacctcggtctcccaaaatgttggtattacaggcatgagccactgcctgtcattattttaaagagtactcctacttaaccaaaaaataaagttaattgtgaaacagcttccggcaggtctttcaggaggtattcctgaagaaaacattgttatcacatgttattg

SEQ ID NO: 160796 - DNA, 494 bp, Homo sapiens
aatctgaaagcatttaaaactaggtttgaaattcagtgaaagaggagtgttgtgtgtgtttaagactatctcctgggctatttagtcagcaacctgtaatttaactgataattaaacacgtttgagtactattgtctgaaaatatttattttatttaaatcatttatttatccacataataataaagaatttttagtcatttttcaatttctcttggaagaaggagagaataacctggtaactatattctatatttagaaaaattaagataccaaaaaataatctgctttaattgttaacaagccagagacaaatcaaacagctccatgtttcctctcaataaatatctgcacttattcttgcattcaagggaaaaagaaatccaaaatatgtatagtgataacagatgtgatcttaaattttatagaaatattcctatctattcatatggtagtagaatatttaaatttcctattagcataactggaaaaaaa

SEQ ID NO: 160797 - DNA, 447 bp, Homo sapiens
ctaacagctttgacactatcccactgatttttgtccctgccctgatgggtagccttgagtagtgtctgttgtctggagtctaatgtcacagcaattaaattcccacaggaagcagcagctttagaagatgtgattagattggagacactgatgcttgttttgattttgaaaatgcatcatcgatcatggctactgatttcagcagcagctctagctgaggggagctgtgggctaagcatctggctttatatttaactttggggaaaatgaagtcttcccttgcctatcaagtctactctgatatgtggccaatgcctttagcagataatcccaaagatgtcaaataacctttatttcccagaggtcatgttgatctttttcttctcattctgacctcagaacagacctattcattttacatctgacatcagactgtgagaagagtaa

SEQ ID NO: 160798 - DNA, 414 bp, Homo sapiens
caagagttcaaggctgcagtgagttatgattaggccactgcactccagcctgggtgacagtgaaaccctgtctctaaaaaatcaaaacagaacaaaaaccaaatgtgttcccttcagacatggaaaacacaaagtggggtatactgcctgccttctgtgcttcctctgatccacctagactgtggcttccacccactctcaaaagacatcagggaggggaaaagatgaaaagaaaaacccactagaaagctagtgacagacatcactcagccccacacctttgggggggaaactttaaaaaacataaaacaaaccacaaagtcttctttattcctgcctgaagctgaagacacaaatgctattgtattgctggtgttctagcatcccattcaatcattgcaacaccatccacga

SEQ ID NO: 160799 - DNA, 320 bp, Homo sapiens
tttgtatttttagtagagacagggtttcaccatgttggccaggctggtctcaaactcctgacctcaggtgatccacctgtctcggactcccaaagtgctgggattacaggtatgagccaccatgcctagcctcaacaaggtatcttgccatctttggcacatatcaggaggtgctgactgatccctaatgtaaatatgggctaacatatatttagttatgagctccatgcctcactgaagattgcatttgccccaacatgacttcttcagagacccaccctgagcttggcaggtcataccaggtctgcataaaatgagtg

SEQ ID NO: 160800 - DNA, 278 bp, Homo sapiens
tgagccattattgtaccttattttttctatatgctgggtctttcctgggtaagaggtgaaatgccccctgaattaaaatgtgggacactttcctgtcttaatgaaaacattcacctcatagagacttgtaattattttcctggaaaatttgcttaacttgattgtctagagaatggtttcatttttagtgcactaataatcggttttacctaatgagttaattggtcctcagtgaatcctatgttaaatgtaagaatgtcttagataattcttcaaaa

SEQ ID NO: 160801 - DNA, 639 bp, Homo sapiens
tatcatccagccttgtcattgtgtcctgcccgcgatgtcttgatcctctgtatgccagccattctacttagtggctgctctatgcaacaggctttctttcatccatgggtttttgcctagtctttctgtctggaacaccattctctgacgtgtccttctccaaagtgattcctcctttaggcctcaacttctctgacattctctggcaagcctcctagagttctaggggttggatgtgttttctcttacatgtgatccatgttattctatacaaccttaatagagcacttgcaacggtgtgtgagaatcgcctgctgacatttttgttctgtccatgagactgtgaattcctacgggatagcaaccatgccctgttggtggttttatctccatactacttagcacacgtgagccctagatcaatatttgttgaatacaaggatgagtgcacattgtcctaagaaacgggtaaaacaaccaatgcatggaggaaaatcctcacttatgaagaaaaatatgtggcaaatggagacgttcaacaaaataagccatgattctatagaagcattaaagcaaggagaggggtggaataaaatctagtgacagccatgagacttaaggaatggaaaatacaggata

SEQ ID NO: 160802 - DNA, 205 bp, Homo sapiens
atcagatttgagttggccctgaagaatcagtggtgggctctggaagcaggagatactacgtgagcaaggacacagagactggggtaagcctctgggatctgtaggacacggtaccgtgttttaggagttcacggggaatggtaggacacagggaatggctagaagccagctctcctaaccattactgtaaaggggcttccttgcc

SEQ ID NO: 160803 - DNA, 577 bp, Homo sapiens
gaagcaggcatggctcctctcattattatacccacataagcacttgcaaaatttctgtttctagtcctggcactttgagctctgatggtttggagatcttagtccttaaaggagaaatgcttccaaaggggacacaacaatgtttccgattaattggaagatgagactcccatatggcgattttgtacttcttatgtcactgaaaccaacatgccaaaaacattggttaatctactagttggaaaaatgaatccgaattaccaagggcaaaaaagtgtgctattttgcaatggaggcaaagtagggtaagtggaacccagaagattgcctagggcatgtcatactacttccatgctcaatacaaggttaatgaaacgttacagcaaccaaaaaacagagcaaataagacacagtcccttcaagaaggaaagtttatgagtcactcaatcaggttaaaaaaaaaaaaagccagagtaactgaaattctggcagaaggcaagagagctatagaacagggagtagatgaaggaagccacatatttcagctaccacctcagaccagttacagacacaagct

SEQ ID NO: 160804 - DNA, 323 bp, Homo sapiens
tgggaaacaacgaaggcgaagtgccctcccgggattaaacaccaggaaactccatttctaaccaattgcgggagtgacgcagagcctggattaggcgctttttcctgccccgcgagcccggcacacgcgcaggaacacacaccacacgcacacgcacaccccagtgtgcatgccccgatcaggtctggggacattcccagcggtgatgtagagtgcaaggaaagacgcggagatgtgaaaagcgggacagagctcgctccctaagactaggggatggcagtgtgcaaaaaacaggcgaagctcccagatccctatcccaccag

SEQ ID NO: 160805 - DNA, 342 bp, Homo sapiens
ctttggggcatggtgtcaccatctttgaaatgggcatgaataaacatccctataagaggataaaatcagaagatgcatgtgtctgtacctaataaggggcttctcaaagcacacagtatgaatggggtacaccttctttgtcaagtggggcacatagagacttcactttgagtaggtgagttagggcccctctgcttgtctaccttctggtccctctcaggagccagtgcccaaggtgagagcatcaggagactggcagtcatcgagtcacgtgagggatcttgtttccatttttaaatctagccaacaaccatacatgaaaataaaaacaaactaataaag

SEQ ID NO: 160806 - DNA, 277 bp, Homo sapiens
tacatctacatctatagctatatcaacatccaatttgttctttttctctgagaacacctactgataaataagtttctaagttttgtctatcagttgatgctaaaacattaaaaaaagagaacaactaatactctttttacactaattagaacaatgtaagcctttttgttttattaccaaataatttgtatttcctatgtaattgctgcagttttattttgcatatagattttttttccgtaacatctttgtctgttagtggttttatttatgaata

SEQ ID NO: 160807 - DNA, 245 bp, Homo sapiens
taatgccttcctagaatctcccactaggttgaagagaactggctccaagataatcttctgccaaccccaaatgtgtaaggcactagtccttctgcccccagggaaggtggaggcacaggagccagggtgaccatggatgggtcaggctcaagggcgatgggcaatgtcctccacttctttccccactgcaggaatcagataactaggaacaatgcccaagccccctgcccagtactccctttggg

SEQ ID NO: 160808 - DNA, 575 bp, Homo sapiens
cccacctgccgatgccatttaaaagtaaaaccttcttggctgtggctactggggtcaggtgctcccgcaacagagccagaagcactgcaggcatggagcagtataaacccttgcggtgacctggaagaggtgatcccagtatcatgtctcatcctactgcatcacatcaaatctgctcagcaattgctcttgacagtactttgtcttttcctttcctgcagtaccagggaaaagggcacaaaaagcccagaaacatgacaagtgagtgcatataattcagtcaaccctcacagtccttaaaaccacaaaacccccatgaagcctgtgcggctcccgaggccacatgaccggatcagtgaggctgccagtactcagcatgctgccgttagagggagtcccccctgcatgttaactcccagtaacaacaacgggtgctgtgctgatgacctcagaacgtggcaggctcctgggccatcgcagtgactcacagcagtcctaacagacaggcctgctgcttcctattgtgcatgaggaacaaggtctctcaggcagagctgcaaacacccacatggtga

SEQ ID NO: 160809 - DNA, 291 bp, Homo sapiens
tgcttaccctactacatacttccgctatatatactcatttacagaatacatccactgccattctgatcccccatgccaagctcactgtaacaccctaaggtcaataaccacatcttataatcaatccaatcagcaccgccctatgaactctgagattttaggcaaaacagtgacaagaaacctaatcatatattgtcagggaaataatctgacgacctctccagtcagatcaactctatattattatttttctgaagcaatcctcctacggaagtatgtagtgggtaccga

SEQ ID NO: 160810 - DNA, 897 bp, Homo sapiens
tagtggctcacgcctataatcccagcacttggggaggctgaggctggtggttcacctgaggtcaggagtttgagaccagcctggccaacatggtgaaaccccatctctactaaaaatacaaaaattagccggatgtggtggcacacgctgtaatcccagctactctggaggctgaggcaggagaatgaatcacttgaacccagtaggtggaggttgaagtgtgccgagatggctccactgcactccagcctgggcgacaaaagcaaaactctgtctcaaaaaacaaaacaaacaaacaaaaaaccaaccatgtaactggcagagtgttgtgagagttagaaaagacattttgaagctttgccttggtcttggcaggggatttgggggtgatagcatatatatgtacaccaagttgttcccccatctaagtaccaattactactggcactcccctttctcccctcactggctcattgctagaatagtagaagctagggatgagctggcaaagttaacttccacacaggcctctgtgaagaagaggaagagccagagaagatttggaagattatggtgacatggcagaggaggcgaggacagtggatctgggggcctggggcagctctgtggacccaatcttagcaactgttgagacaaaggatgtacaaatgggatcagaatgaaccatcagaggattagggctcaggacctgaggttcatgttgtgtgcagcatctgaacgtgccgctgctgcgtgggtcagctagttagagccacatttctgtgtgatgctctgttctcctgcagccagtccttccccccacctcccacattcctgatgagctctgtgactcagctgcttctcgggacgtctgagcagctgtttttttctagggat

SEQ ID NO: 160811 - DNA, 550 bp, Homo sapiens
  misc_feature (39)..(40): n is a, c, g, or t
  misc_feature (46)..(46): n is a, c, g, or t
  misc_feature (52)..(52): n is a, c, g, or t
  misc_feature (54)..(54): n is a, c, g, or t
  misc_feature (62)..(62): n is a, c, g, or t
  misc_feature (68)..(69): n is a, c, g, or t
  misc_feature (72)..(72): n is a, c, g, or t
  misc_feature (86)..(87): n is a, c, g, or t
  misc_feature (102)..(103): n is a, c, g, or t
  misc_feature (107)..(107): n is a, c, g, or t
tcaaaacgcctgagggtgagacactcgataagcaccctnnagttanaacagntncgctacancagctnnagntacaacagctccanntacaacagctccagnnacancagctgcagtagataactgatgcatatgtattgtatcatattaattaaaatcgtaaaaagatggttagcttaatatgaaggtttggtgcaagtattgcctcaacaggtaatgagtcttttccatgtagctgatttaaatttattcaacaaacatttaaggtgcgcacactgtgctaggcttggggtttatggaacatatgcagtaatggggagaaacataggatatacatagtaagcaaatctcaagtactgtggataaagaaaatgtgtaagaggataccaagtttgggagtgccagcactgtgaatgtctgcgagtttgtggtggaatgggatgaaatttagaaagactttgaagacagaaccttgctcatgctggatgagatggtttgggatggggtggaagcagggagccgtgtcaggtctcaggtaatttaaagctca

SEQ ID NO: 160812 - DNA, 421 bp, Homo sapiens
cacaaaaatttaaagtatctgtacaggcaaaacaacaaaccacatcaaacaacaaactggaaagataaaattataatacctgttacaaaggaccaaattcctccctatatagattataaataatagcatatacaaattagtaaattaataagacaactcaatcaaaaaatggcaatggatagaaataagtagctcttaagaaaatgggctttaatttttcacccagaagactggcaaagagtaaaattatgatagcatccagtgtcattcagagagtggaaaaatgtcaattatgagagtataaattaattcaataatgcaaactcattggaggtcagctttaatgttcatattttttgacccaacatttccatttctaggtaatttttcatacccttgcagatgcatacttaactggacg

SEQ ID NO: 160813 - DNA, 803 bp, Homo sapiens
tggtggcgactgacggaactgggtgaagatggagtctctgtcacccaggctggagtgcaatggcgcaatctcggctccctgcaacttctgcctcccggattcaagcaattctcccgcctcagcctcgcaagtagctgggattacaggcacacaccaccatgcctggctagtttttgtatttttgtagagacagggtttcgctgtgttggccaggctggtcttgaactcttgacctcaggtgatctgcccacctcggcctcccaaagtgctgggattccaggagtgagccactgctcgtggcctgtattttttatggaaacagaaaagcccatcctaaagtttacagaaaatctctctctctctctctgtcactctctctctttttataagacatggtgtcactatgttgcccaggctggacttgaactccttggctcaaataatcatctcacctcagcctactgaatagctgggattacaggtgtgtactactccacctgtctgtcatatggaatattaaggaaccctgaatagctaaaataatcttgaaaaagaagactatagttggaggactcacagttcctgatttcaaaacttactacaaagccatggtaattaaacagtgtgatcttggcttaaagatagacagagaaaccaatggtatagagaagacagccaagaaataagccactgcatatatcatcagttgatttttgacaagggctccaaaaaaccctctccagggaaagggtagtcttattaatggtgctgagaaaactggatatccacatgcaaaagaatga

SEQ ID NO: 160814 - DNA, 399 bp, Homo sapiens
cagcgagccatgtgtggtgaagagcagcgctctggtggtgtagagtggcattgcataggcaatcaagggatacttaggaagatgggtctctcgtaagacccgggggtcggttgggtgtggaaaacgagtgagcccgtgataatctagattgggggctctaagaagtttgtgggtggggggaaggtactgaatttaacttaaaaagagtttttagactgggcgcggtggctcatgcctgtaatcccagcactttgggaggccgaggcgggtggatcacttgagatcaggagttcgagaccagcctggccagcatggtgaaaccctgtctctactaaaaatacaaaaattagccaggtgtggtggcacgtgcctgtaatcccagctactcggaacgctgag

SEQ ID NO: 160815 - DNA, 446 bp, Homo sapiens
atatgcagaggaaacagcctgagaaaacatataaaggatgatataggtaagcaacagcaaacagtctagcttgtagaagtagagtttacaggggttggggatgataggctgtaacattatgtgactccagtacctagctgaggaacttggatttgtcaatggggcacctaggtagattttgagtagggtgatgacaggtttggggcctcaacttgagaaaattcatcttgtagctatctgtggtataaattggcatgggggctgataaggtttggctctgtgtccccacccaaatctcatgttgaattgtaatctccaatgttagatgagggacctggtgggaggtgattagatcatgggggcagatttcccccttgctgctctcatgatggtggttgagttctcacaagatctggttgcttttgtttgagacggagtctcgctgt

SEQ ID NO: 160816 - DNA, 150 bp, Homo sapiens
tcagttattcttgacctgagtcacatcagaaagccaacagagggtgtaggctctcagggtgttgccagccttgcaggatgaaggctgtggcgccgggagatttgtgcagtgggaccaccagctttggcaggtttaacagaaatgaacggt

SEQ ID NO: 160817 - DNA, 260 bp, Homo sapiens
aagctgaaatgatcacaggctgatcctcagacactgagatgaaacagcattggacaaacttggtccccctcccatagtgcaggcagtagatgctcccagcccaagggacctgttggcaccagccatcctcagctctttgctgtcttcagtggggtggtactgcctggcgaagctggcagaggggccacatcagagacaagcatccctacaacagacaagcagctccaaagcgctaggtttaaaacctcaaccaagataag

SEQ ID NO: 160818 - DNA, 274 bp, Homo sapiens
gtctttggttaatgcattcactgcccccgcacaacgccccccacccgcccttactgagaaaatgtagcatcctgtgtggcttgttctcgtcagggttgtatgctgagataatactgctagagcctttgaatggatagaataaggaaggcctcagcctacatgccgaaggaaaaaattaaaggcaaaggaatcatttgtttccagaaatcctctgggagacagaaacgtgtttaaggcacttacagcattcaagtaagataaattgtggcaaaaa

SEQ ID NO: 160819 - DNA, 438 bp, Homo sapiens
acatcccagagtacattagttcccttccatatgcttaaatgatcctccatcttaagaaaaactcaagtccgtgatcttaaaaatgagactaacttttcacgtcattcatgcaacatgttaatagctgcccgaaatagctgttttcagcagtagcccaaaaggctctctctaattctaagtcaatctccaaaaaggaatcgcaaagcatcctaaaaggttgatttcaagggaaagccaatatagcttactcataaacatctctgcaaacggaagaatgaataaacgaaatccaaagataaccctccaacctaattttagtttttagtttctgactcctcttcccagcaaacctctttcaagatttggcaagcaggccacagagtaagaaaagtaaagatttctggtgttccccaagctattacttcctgctgctttcct

SEQ ID NO: 160820 - DNA, 352 bp, Homo sapiens
gctcctttgacatactgggaaggctcaacactgagaaccaccagcctctacagaagatggagtgagctgggggttaaaatagaggggaagtggctgaaagactcctaataaagcagtaataagaaccaccccctaccctgcccccacgcacatattctacacagctggatgactttcccttcctgcccaaaccgcaggagacaagtttattttctctgaaatttgaaccagagaatttcaacctcagggatacttggcacaaaagtggacaagacgagggtcctaagtggaaacagcggggtagagtaaaactctgcctactacagcacaagactctctagccccctaactc

SEQ ID NO: 160821 - DNA, 516 bp, Homo sapiens
agtttgtccattgatgttgcctctggcaaatcctggccagaaggaaagaatgtaaaccaaaaataaaattctaagctccccaaccacctgaatggacccctcctcttggccaagggcattccaaagttaacctgaaaaactagttcaggacatgatgaggaagggggagtcggacatgcctcattaccatcaacatgaacactgtccttaagactgatacaatagactctttaagtctaataagaaacatttacaatctattctctctgaagcctgctacctggaggtttcatctgcatgataaaactgtggtctccacaactccttatcgtaaaccagacattcccttctaatgattccaggtctttagataataactcaaccaattattaataccagtcagaaaatttctgaacctgcctatgacctggaagtcctccaacttccatttgtcctgcttttccagaccaaacgaatgtacatctcacatgtatcagttgatgtcttatatctccc

SEQ ID NO: 160822 - DNA, 284 bp, Homo sapiens
atcaaacttgcccccaaaggcaatcacttgccaattgtgacactgtcaattctacctcctacaatatcacatacatctgcccttgcctctctgtccacgctgccacttccccagttttggtcaccatctcctttcacttagaccactgcatcagcctcctattctatctccatttctaggcttaccctactctaatctagttagcaaactgcaaccagaataatctttgcagtacattccagacagaagtgcaaaggcctgaagcaagaaagattgtggccttg

SEQ ID NO: 160823 - DNA, 271 bp, Homo sapiens
cagcactatgacagtgttaaactatttgcagttgcctaatacactatattttcttagttttatgtttttgaatctgcgattctagtttcctttatctcctcttctccccatcctcccagctttcccttaccaacctctgtatatcctttaattagctcaggtatcactactttttctgattctccgagtggtttgatgtgtctcttcatggcccgctatatcacactgaatacctcttttaaagcacttttcacactgttataatcatctt

SEQ ID NO: 160824 - DNA, 619 bp, Homo sapiens
aatgataaggtagagtaaaatgtaagaaaaatccagtttgaaagtgactatgcctgttttcaggcgataagtttttgcactgttggaatttgccatttgatattggaatacattcttaaataaatgtggttatgttatacatcattttaatgcacattctttcactttttttgctaatgacttattacttgctgtttattttattttagagtatggaaatgatgttagacaaaaagcaaattcaagcgattttcttattcgagttcaaaatgtgtggtaaagcagcggagacaactctcaacatcaacaacgcatttgcccccaggaatggctaaagaatgcacagtgcagtagtggttcaagaagtttttcaaaggagacgagagccttgaagatgaagctagtgcccagccattgaaagttgacaacgaccaactgagaacaaccatcaaagtttaccctctgacaggcacagtggctcacgcctgtaatccccagcttcctctctgttctatcttctgcccggggctggcttgccctccattcatctgcccagaagcacagccgtgtttgtgcgcagccagcagactctccagactccggttccacagccttaccc

SEQ ID NO: 160825 - DNA, 528 bp, Homo sapiens
ctacttttccacagggcttcgttatatacagcacagcatttttttacagcattttattttatgtgcacatttatttttgccactttttaaaggaaatatgtgcaagaatataatgagacggtatatgaataaagattgcagcattaaaaatacatataaaggccaccatgactgcaatttttcatgagtgagaatttggtgagaatagtttacatgctctcctcaatgtttctaaagacacaacactgaatggaagtaatatggacccacagatcagcactcaatgtagcatatcttagaacagctttttccttactcccaggatacacagctgctgcccatattcccctctggggtacagttatgtcagacttgaaagaaaaacccaattcctgctctgccctggtccttttatatccagacgtatagagcattggggaaaaaaagtatgctttcagtatacaggcttcttattaacaaggaatatttataaacactgtgacctcctgattcctccctgtggcaaac

SEQ ID NO: 160826 - DNA, 455 bp, Homo sapiens
gattttgctcatgccattgcctctgcttggaatgttctttctctttcccatttaccaaatctaatgcatctttggtgctcaaatgtcacctctcctctgcttaaacagctcaaggtgacagctccaacctgtcaattctcacttagcctttaacagagtgcctcacattacaattatatgggtatgtcttctttgtcccttgacaaattgtaagctctcggcggacaggtttcacgtctgaatcatttctgtgtacccaatgtaaaagggagaatatagttcctgatttgcaaatgtctgttgaacgaatgaccataaaaattgtgctccaaagggctcacagtcataaagcattcaaaatggggtagattgcagcaatagcagtaacaagctcttagtgaatgccatctaaacatcaagcagtcctcacaggccacagccagtatgcggctaag

SEQ ID NO: 160827 - DNA, 218 bp, Homo sapiens
gacagagtgagcaatcctataatttgggctaatatatacctccaatctagcccaacacacatacacacacacccttaataggaggctaatgtaaagataatgtttagtgctgaggacaaggtggactgaagatatttctatggcaacaaaaaggcccctccagacatctgtgttctaaagttgatgctgatgattagagactgcctgttctacagact

SEQ ID NO: 160828 - DNA, 538 bp, Homo sapiens
tctaaccaaccttctaagttgtcttttaaatattcaacataggcgcacctttgcaatacatttatagatactttttaattttctgtcccacagtctatattttcatgtagatagaattttagcaatccattttaattctgcctttgtcacctcattgcaatgtggttacagatcatgtacgcttttggacttcgttgattttgtctttcatatctattacatgaccattttctcattaatggtgtttgaaaaaatattaattaatttgaggaacataatgtcctgtttagagctattatatctgttagtcattgcagaattcaaatactgtgcttttacaaattatttttcaagaagacttactagtgttttaaaaagtactctaaaatatcccattttgttgtagatgccactgttcccatagtatgctgaagctgtgttgagcagcacgtgaaggttcaccttgctgctatattatcttagtggtttttaacatttaacatgctttgtcttgaattacatctctgtattatttcta

SEQ ID NO: 160829 - DNA, 291 bp, Homo sapiens
gatgaagggggcaggagccctgaaggaaggatttggggccggccattcattcattcagaaacacttatcatcccttatcagaagccctgacctattgagagtcaggcacgtgctattgagagtcaggcacgtgctcatataaagatgagtttaacatggatctccctctcgaggaactttagatggcctgttacaggagattggactttcaacacaggagggaagggccaagggaataagagggaataaatgttgtttagaacctgtcacattccaagctagatgcttcaa

SEQ ID NO: 160830 - DNA, 550 bp, Homo sapiens
tggaaatgggttcaaatctcacttctgcagttcctggatttgagatcttaagcaagtcatttgacttctctgtgcctaatttcctcatcagtaactgggacaatgacagtcccacttccaataagtagatatgtaataaaacaaacaaacaacaagaaaaaacaaaaaaacaaaggaaaagaaaagaaaataagtaaatatgcatgtctcagacatttcatctatggagcttttttacctggaagtcccaggcctgaaatataagcagtaaaccaatttttggtatagtttttcatccattatttgctctatattaaataaaagtacaattctaactcccagtgaccaaagatgaggaatgtaagtgattcccagaggtcactttgtcagggattggtagaacctggatcagaacctgggcttctggaatgttctttcagtgcatgttatggtttcccacgtgcactgcagacacttctctaaatgccaaaggatggagggccaggggaggggggaaattgttatcaggtattaattcaagagtgttaga

SEQ ID NO: 160831 - DNA, 413 bp, Homo sapiens
aatgagaggctttgactaaagacatgagtgttgcgttttagaattagcaatactgacagttaagtgttcgtagtggttgtcctaatttcttcagcgtttcacaaaaggctttttgtaaaaagtccactatctatgtgataggccctctactggtttagtcacctttctcctgatctggttccttgtctaaccatccagagtaactagatctttgcatagacgcattagttatgtgctgacaataggagcctgaaagttcccctatctagcttgtgattatagctcttaaagcaagatctctgtgagagctaccaaaataaaggcatactctttataaggctgttccatctaaccatgcctctaggtatgttctcaaaagtgttagacgcaaggtttttatgccatttttgttt

SEQ ID NO: 160832 - DNA, 335 bp, Homo sapiens
agagatgagattcaaacccaggcctctctcatgctgcataccattacctttcttatacacatacttctaatatacatggatgcatgaataaaaaaatatattttaatctacattttgaaattgaaaatctgagactatttatgtaactgatagaagcctgtatcctacagaacgggagtgggattgggaagcaattggctacagctccttatcctagctactaacatttttacaagtgaatattgttatatagtcagatttataacattcatattatataacatgatataaatgtgtacatgtgtatgtgtgtactttgtatgcttcttagaaat

SEQ ID NO: 160833 - DNA, 273 bp, Homo sapiens
aagtattttgtctcatttaatcctctctgtgtgataggttttactttttaaatgtagaaagcaatgctctgggataaagtaattgggctaaagttacaaagctaagcagtggaacccacacatgaaacccagttatgtctgattccaagtcaaagttttaaacctcttccctgttctatttcacatgtaccaccaccattaatgggtctctggtatctgtgctacaattctgccccacttggtcacctctgcaccagtcagatcttagtaaca

SEQ ID NO: 160834 - DNA, 284 bp, Homo sapiens
tatgatggtggagttttggtttcgggttttttttaggtttttgcagggagctacttcctgtgatagtgaataactggtatttcatagagcagacagcctgtactactccatgtcataatgtttcccatttctgttgttaggcctttccgaaagatgaatgagaaaggtgtcttactctgggataaaatccataagttgcagaaaggccagatatacaagcagggtaatttatatgaatttttgaagcttactggatggagaggatccagagtgttgtattttgg

SEQ ID NO: 160835 - DNA, 262 bp, Homo sapiens
gatgttccttcactaatctatctatctatcaatcatctattatctatctatccatccatccatcttcagagttgaggctgtgagttacttgacattgtatttctaatacctaatccagggtttgatacaggatagactctcagtgtttacaggaggaatagctgcccattctgagtttttatgtggatgctctattttcaaggacagttcttttttactttacacttttgtaatgagtgtgtgaagagagattattgcatag

SEQ ID NO: 160836 - DNA, 590 bp, Homo sapiens
cacagaaatttgactcggttctggatactggaagttcaaagtcaaggcatagggagagccactcttctctgatggctccagggaatgatccttcctcacctcttcctagcctcaggtggtagctttcaatccctagtgttacttagctttcagctacatcaccccaatgtctgtttctatcatcacatgacattctccctctgtgttcttggtgtctcttctcttcttctaacaaggacaccaatcacattaaattagagctcactttaattgaatatcatctcatcttaatttgatttcatctacaaagaccctatttgctaataagatcacactcagaagtactgcagttatgacatatctacttgggggaaacaattgagcccataacagtgtgaatcttgttgaatacatggagagccagttgtaggactaatattctctaagcagttaaaatcagaatgcatgaagcttccagattgatccacatcctaggtagacattaaaagtctcctgggaatgtctgcaaggtaaaagtcagaatgagttgtgcctggcatgagacttggaagttaactgtgacctcaatt

SEQ ID NO: 160837 - DNA, 790 bp, Homo sapiens
cacacacacacacacacacacacacacacacacacacgtcccatagcaccctgtacttcattcttactggccctcaccatgccgggtggcatgtgcatccttgctcatctctttggtgtccatgatggtgaggacctgtgtctgtttcattcgccagcccctgccacagaactggcacattctaggattcagtgaacacttggtgaaggagtgagtgaatggaagtgcctgttgcgtgtaggacctagtagccagcctaaatgagaagatttagccttgaggttattttagtacaatagggaagaccatcagtattcttggccatggaaataattcagggggaaaaaaagaaggttctgaagtgtataggaaaaggtataaattcaatacaagttgggaaattagcacctagataagactagagggtctggccctcagttttgtaggctcaaaaatgtttttttaatatacatagctgtcagttggaagcggattgacttaaattcacaagagctactttatgaataatcaaatggtgggatttggctgggcgccgtggctcatgctataatcccagcattttgggaggccaaggcaggaggatcacttgagtctaggagtttgagaccagcctgggcaacagtgagacctcatctctatgaaaaataaaattagccaggcgtagtggcgcatgcctatagtcccaaccactcgagaggctgagatgggaggatcgtttgggcctaggaggtcgaggctgtagtgaaccaaggttacgccactgcattcc

SEQ ID NO: 160838 - DNA, 536 bp, Homo sapiens
aagccactggaacaaacagaatgtcttaacaaaacagaaactggggccttggttctccacaatataggatattcggcacagcatttggacaatttgcttcaggcacttattactttgaagaaaaacaaagaaagccaatattgtgtcctcagagattttcaggaataccttgctgcagttgaatcttcaatgaaagccttgttgacagacaaggaaagtcttaaagtaggaccactggacagtgtaacgtatctggacaaaattaaaaaattcatagcatccatagaaaaagagaaagattctttaggcaacttgaaaatcaaatgggagaatttatcaaaccacgtgactgacatggataagaaattgttggaaagccagattaagcaacttgaacatggttgggaacaagtggaacagcagattcaaaagaagtattctcagcaggtagtggaatatgatgaatttacaaccctcatgaataaggtacaggacactgagatttctctgcaacagcagcagcaacatctacagtt

SEQ ID NO: 160839 - DNA, 398 bp, Homo sapiens
cccagagctgtcaagcactgaggcagggatataaacctaagtagtctagtcctgcacagttttaactattccctgaggacctgaccatttttctgaacatatgtactggggacgttgagtgatgtaaccacgcaaaagactgcagcataggtgtctgcattttggggattgaggcaaggcttctacacacaaaattataaatgtaataaacatacagcattgtccattcctgcgtgcttgcttatgaattggcgatggatttcagaaggagaagaaatctcctacagaagggactggtgtcagctgtgcctttacaatgggttaaagataatttgaattcattgccaacattcaaaaatgaagagattcctcattgaaattttgatagatggtttctt

SEQ ID NO: 160840 - DNA, 671 bp, Homo sapiens
taagcaagcagggagttgatacagttcatctttcaaaatgtcatgttgagatacttcttaaatactcttctgtttctagtccctaagttgagatgataggaatggaaactctcaatagtaacatgtcaaaacaactagaacactgcagtatctgttctcgttgtttaaaacgtttctttatagacaccatactcatcagtatgctgttagaaggtgtatattgcactctgcctgggagttcaggcccccgtgccttggacacacaggtagctttctcagccatgtgtggagcaagcatggctgatttgggcctttagggtatcctggtgatgctgtgtcatctgtagcattggggaccactaggagcatgctgtcccgtcttctctccagttcacatgttccttcctcagtctcactctccctgagtgttttgcttatacctctaaaagttaagctccagaatgatttgtttaagactcgttctagttctgtcttcattttaaacttgttataatggagaatttcactatatgcaaggtaaacagaaaggtgtgaggaaccttattatacccattacccagcttcttcaagtatcagctaccattctttttcatctctacctccatctattcactgctcccacttgattttgttaaggtaaaaaattttaa

SEQ ID NO: 160841 - DNA, 155 bp, Homo sapiens
aagcaatctgtaaatatctggaattacatatactggtttgtaatatcccactaaacttccttatgtatataaattatataatattaaacctagctataatggaaattagctatataaaaataagtaactttttttaggaggttgttcactggttt

SEQ ID NO: 160842 - DNA, 777 bp, Homo sapiens
ggaggctgaggagggaggatcacttgaggctatgaattcaagactagcccaaccaacatagtgagaccttgtctcttaaaagaaagaaagaaaatttatgtaaaaaaagaagctcataagtgtaatcattccttggtatccatgaaggatagattccaggaccctcgcagacaccagcatccacagatgctcaagtcccttaaataaaatggcataatatttgcatgtaacctgcacacattctgctatgtatgataaatcatacttagattacttataatatctaatacaatgaaaatgctatgtaaatagttgttatactgtattgtttagggaataatgacaataaaggtctgtacatgttcattacaggtgcaaaaccatccattttttttccctcatatttttgatctgcagttggttgaatcctcaatgaggaaccgatggatataggggccaactgtattcggttactctgaggtatagaaaaggcaaaataaatgatcagttatttttctttaccagtttttaatgacttggtttcataccaatttccaatggtgactaattttgtttttagtaccattatgaattcatggaatgaaatattgttgatgtgtgtcagttgaagcttgttgtcctattgttgaagttctagttgtcctaatctgtgaacctttccatttggcctctgtgtccttttgatacaggcttgatagtctttgcttcattgctttctggtatgacaagaggattcatacatttttcctgcaccag

SEQ ID NO: 160843 - DNA, 286 bp, Homo sapiens
ttgggttgattccatatcttggctattgtgatgtagtgatgcagtaaacacgagggtgcagatatctcttggatatactgattttttttcctttggataaataaatggctagtagtgggattgctggatcatatggtagtcctatttttagttttctgagaaacctccatactgttgtccacagtggttgtactggtttacagtgctgctaacaggactcacatttgcttctgagttaagtggagacaggaatgggaattcttttgtgtttgtttttctttccaac

SEQ ID NO: 160844 - DNA, 643 bp, Homo sapiens
tgaggatctgccagctcggcggctgccgtcttccagcctccccatcagcgtttggatgccttcctctaggtcctttaggaggtgatagtcatcgctgtccgaggtgtcatacaccaggttgttggcgaacatactcctgaggaaccgcacgggctccagccacgactcgatgggcagcagggagatgcggagcagctctagattggatttctgttgcgtttcctccatgttggagggtgtcggaatagagtctgagcagaaaagcagaggtgctgggacaagcaggggcagggactcagtctgaggtctcccagcggtctcaatgtagtagctccctcctgtcctcatagatatgccgatattagccagactttgggttctgcctttaaccctctacacttgaggaaagtgcatgaatttaagggtgggagattgtccacttttgagggaatgaagactcttacagaaggattgggacaggctggtaatcatggttttcaaatttaatgcttacaaggaacctgggaaataaactagcccgacctctttgcattccagataagaagagtccagagaagtcttaggacttgctcaaggccacatcattagtggcaaagtgggaacagaacccactgtcctaggc

SEQ ID NO: 160845 - DNA, 620 bp, Homo sapiens
cctctgaggccctgaggaactctacagggggctaggaaaattgcccagagcccctgcagggctgggttggggtgagaagaaagacattcgtgagaatccagaggggaggcctaggaattgttcccagcatgactttgcttgtttggtttcctcacctataaccaaagaaggttttgctcaatggtggctgtttccttccggctctaaggtgtagtactttattttcttttgagcagaaaagcagaggtgctgggacaagcaggggcagggactcagtctgaggtctcccagcggtctcaatgtagtagctccctcctgtcctcatagatatgccgatattagccagactttgggttctgcctttaaccctctacacttgaggaaagtgcatgaatttaagggtgggagattgtccacttttgagggaatgaagactcttacagaaggattgggacaggctggtaatcatggttttcaaatttaatgcttacaaggaacctgggaaataaactagcccgacctctttgcattccagataagaagagtccagagaagtcttaggacttgctcaaggccacatcattagtggcaaagtgggaacagaacccactgtcctaggc

SEQ ID NO: 160846 - DNA, 283 bp, Homo sapiens
aagcctgggccatcggtttagaaaaggaaggaaagtcaattcaattttattataatctaactttctctgagtcctccacgtgttcagtaagcagatggacatatgggtctgaagcttgagggaaaacaaggatggaaccctggggaatatctatatgtgtgatctgggcggaataaatgtaacaaacaacctgaaccatgaggaaacagttggagaggtagcaagaggaccaagagtaagtgagagagagcatctaaatcatgggagaagggaatttcaataa

SEQ ID NO: 160847 - DNA, 384 bp, Homo sapiens
aagtgtcattgttgaacaaattgacatacaacacgaaccaaaaaatcagtgaactaaagctaccatttttcatatggatagagtcattaacctaatattgaggaagaaatgaaaagacaggttgcggaaagatatatatgacataccataaataaaagtttaataattacaaaaaagtaagatcaaactaaaaattgtataaggaaatgatagataccaaattcagaatactggttgcttccagagatgaacagaagggaatgtaacaagaagggttcatttgtatctataacgtttgttttctaccagaaatatcttgaaaatgtggcaaaacattaagctaagtagagggcacatgggtgttcacttgtaattatttccttt

SEQ ID NO: 160848 - DNA, 239 bp, Homo sapiens
catgagccactgcgcctggcctcaattgcattttgtatataaataaaataaaaatctcaatggaatggttaaaatgcactaaataaaataataccaaaaatcgtataaatattttgcaaagaaagaaaaaaataccaaaaatatctttaaaagatccaatagaaaatatcacatatggcaaactggaaggttgcaaagtagaccccaggggctgctggatgtacaagtgaagctaggta

SEQ ID NO: 160849 - DNA, 410 bp, Homo sapiens
aagcaaaacagactttctgcctcgggggcagagtgaggccaagcccacagatttatatggctttatttgtttctgattttagaaattttccatcaatgaatgcatttcccttcaccgacaactccccgagatgcacgttggcaccatcacacccatcttacagatgaggagaacaagactcaggaaatccatggattgagacaggggaatgatcagaagccaagcctccctgctttcagtatcacccgctttcccctacacagcactgttcctcactctcaaacacttccaagatggtagaagggaggggatcagggttggacctatccctttgctaccagaaatgtgtgatgtcttgaccacagctagcagccaagaggcaatggaatcgggtttttgtttttggggtt

SEQ ID NO: 160850 - DNA, 414 bp, Homo sapiens
ggccaacgtatggtcctcagctggtggcttgtcctcagccatttgcctgccagaacctcacaggctgctgggctggcagagagctcagcagaaaatctggccagcagagaactttgttgagcccctggaatccaagcattctgcccaagatggtagtagcaaaaggtgctcagtgaagaaaacaaatgttgacaagcatattttaaaaatagctctgtgaacagggtggggcctccaggggacatcgttctacttcctgagttgggtgctaattttattattggttaaatcttctttcttttcacatacatgttatatactttttttttttttttaaagagacagaacctcactgtcacccaggctggagtgcagtggcacaaaccatggctcactgcagcctcaaccccctga

SEQ ID NO: 160851 - DNA, 249 bp, Homo sapiens
caattctgagctaacctggtaccaagctcacaggctcagcacaaaccactttgcaaaggagtgatcattcccatttcacagttgggaaaactaactctggaagacttgtgaaatttccacatcccacaagggattcagccagatttggaccctgcgccttgaacaccttcccaagaatttcaaggcaggaaacctaggctggggggtgtgcggggaggtcctcaatcacatgctggctcagggagggtg

SEQ ID NO: 160852 - DNA, 392 bp, Homo sapiens
gagccgagatcgtgctactgcactccagcctgggcgacagagcaagattccgtctcaaaaaaaaagaaaaaaaaccaaaagactgacttaattactatctcagaatttgaacctgtttccaaagctaaacataacataaactttgttatcctgtatgattaggaacattaattttggaaataataacctaaaagttaataaaatattctagtcaacatttactattcatatatacattaacaaacataaacaaatttttatacatatgtgattatatacacatcacatactaacattgtccagtaagtaatctaaaattctttttgtgattcagacgttactctaaaatcactgtgcttcaacatctttactgtcattcactcactcaccaa

SEQ ID NO: 160853 - DNA, 239 bp, Homo sapiens
tcgcgcacacatccttcgcgcacacatcctcgcgcacactcctggttttgtcatgggcacttggaattgctttccactatccatctcctccacaccctgggctgagatggagtagggcctactggctttgttcttaaatatgatcaggacggtgttgcccacctcagcatgaatcattgggcccaggagttctaagtgctcctctcgaggtgatcgggctttgatctccaggatgtgtg

SEQ ID NO: 160854 - DNA, 510 bp, Homo sapiens
gattgcgagctcggtaccccacaccacctgagtcatactatgagtcaaataaaccatctattctcaagtgtcaaatttagagacagccgaaacaaaaatcaagaaaagcttgaataagaagtggctatttttctattgtgttctctccaatgcagcaaagtagttgcattatgggagtagcatttttttatacatcagtcaaagcagcaagtataaaaattatctcacctcaccgggcgcagtggctcacacctgtaatcccagcactttaggaggacgaggtgcgtggatcacaaggtcaggagttcgagaccagcctggccaatacggtgaaaccccacctctactaaaaatacaaaaattagccaggcgtggtggcgcgcgcctgtagacccagctactcaggaggctgaagcagaatcacttgaacccgggaggcaggggttgcagtgagccaagattgtgccactgcactccagcctgggcgacagagggagaattccatctcgg

SEQ ID NO: 160855 - DNA, 295 bp, Homo sapiens
tccacatccctggttcaagggattctcatgcctcagcatccagagtagctgagattacaggtgtgcaccaccatgcccagttaattttttgttgtatttttagtaaagatggggtttcttcatgttgcccaggctggtttcaaactcctgggctcatgcaatgcaccttggccttccagaatgctgggattacaggtgtgagccaccacacctggcctttaaaaaaaaattcattatttttaatcacatggattaagctggagaacattaattgagataaggttaatagttcatg

SEQ ID NO: 160856 - DNA, 472 bp, Homo sapiens
tgacatttgttttataaaatgcaaattaaaaatactaaccctatgtactttgctaagttttggtaacataatgagttaatatgcaagctctgtggaatatgaaagcactctgtcaaaaaaagaaaaacgttattattctactacttcatgtatatgtgattggacctttatgtttatgatataccactgaggcaggaaaaatgcacaagagattaagagacgatgatttctgaaaggaataacataatcatattgtaaaggaaggatataaagtgaatgaagtttaggaaaaatgaggttcctttcttgaccagactacaaggaaatggaaagcaagtcaacataaagtaacagttgccttcaaaccagtgaatcgaatttggggtagtcccagaatcctacggtatttagcacattgtgtcataatctatttagcatataatcttctaaatataacaacacactggagaag

SEQ ID NO: 160857 - DNA, 140 bp, Homo sapiens
gtgaggcccaactcgcatgagttttgaagataaaacaagagatttcaaagaaacccccagcttgcagcgggccactggaggatgcatccccagacgccaggagagctgggattctgaggaggagtcgggaattatggatg

SEQ ID NO: 160858 - DNA, 424 bp, Homo sapiens
ttgtcttgaaccccagtgatagacatcttacgctggttttaggtatacacatataacagcaaatacagattgttctcagataaagttgttaaccaaacatgcttcattttatgttaaccataaaatgaagatcattcagtgacttgaacatatgttttaagacacatgagagaaaattgagatcaagtttcaaatactattgatatgggaaggggacagggaagtgctgggtagagaagggcagagtccctgtcaagggctccacctttgacctgtacctatggacctaagtgagaacaggcatgcctgtttttgcatccaaatgcttcattttccaagaccactctggcctgcaacacccccaatcctgtgcccaaataaacccgagaccacagcaggcacagacacaagtgattgaacatca

SEQ ID NO: 160859 - DNA, 569 bp, Homo sapiens
aaaacatgagagtgactgggcgcagtggctcatgcttataatcccagtactttgggagactgaggtaggtggatcacttgaggccagcggttcaagaccagcctggacaaaatggcaaaaccccatctctactaaaattacaagaattagccaggcattgtggcagctacctgtaatcccagctaatcggggggctgaggcaggacaatcacaatcgcttgaacccgggaggcagaggttgcagtgaactgagatcgcgccactgcactccagccagcgtgacagagtgagactccatgtcaataaaaaagaaaacatgagagtggacacccctttgccgagtcacaatatttattacacgttccacatggcagcatctacccattccttctgcgggccacgtactgacaacaagtttctcaggcagccaagagaggtgaaatttcaacctgagttcgagggcaacatcctggggtgcttgctttgcttcaaaatgagtcatcaaaaccctataagccttttggccaggaagttccagagattttaaacaagcaaatgtgccccagcta

SEQ ID NO: 160860 - DNA, 608 bp, Homo sapiens
ctagattaaatgttggagttatgagtggagagaagtggatttgagatgtttaggatatacgagttaagattttaggactgaccaaatctgagaagagggatttgacgcaggtttctgattttgatgactggatggggaacaatgccaagaattgtgaggatcaacatggtagctgaaaagatgacagcatctggacatagctttaaaataaaaaccgaagaaaaacattctgccaggattaagctaacacagcttaggaagtgatcaagttttctagtgatcttactgacataaggacagaatttcgaatacctggaggagtagttgatggacttcagtcagacttttgatgaaagttgaagtagttgacgttaaatggtggaacattgttctgtgttgccgttatcctggcacagtcctgatatgtggaccagacttgagtctacctgtggagtcatctgttctttcagggttttgttatccttcagcttccctgtggctcttacacctcctcttgatatgaaaagtctgtgccattgaaatatatccttagttaataggccttcattagtaagacctctcatccagttctacttctttcttggtgg

SEQ ID NO: 160861 - DNA, 345 bp, Homo sapiens
tgatcagcttagtgggcctcagacacagtttatgtttcatggtactggggataaaaaatatcttgatgaagcccttacaaagagccctgagtggaggtgctgaataaacctaaactaatagggaggaagggaaaaggagttacaggtgctaacacttttaatttttttattttttatttataaatagagacaggatctcactatgttgcccaggctgttttcgaactcctggcctcaagcaatcctcctgcctcagcccctcaaagtactgggattataggcatgagtcactgtaccgggccaggtgctaacactttttaaacactttgcatgtatcatttcatt

SEQ ID NO: 160862 - DNA, 1865 bp, Homo sapiens
  misc_feature (1600)..(1601): n is a, c, g, or t
  misc_feature (1676)..(1676): n is a, c, g, or t
  misc_feature (1861)..(1861): n is a, c, g, or t
gggaagtaacaaattagctcctaagcagaagactgcactatattcattccagatggcctcctgggccggtcatggttgcaggtgctggggacactccctcatcagctccagtgaggtgatgctcctgcagcggccttccagcaggaggacaggtagtgcacacatactgaactcgcctaactgacggtaaatgctttgcagagtattacagcagaatcccatgagaaaggatgatcaaaaaagcctactgaggaggtagcattgaccctgagatctggataatgagaaggaggtaggtggtggacagtggcggagaaagcatcctcgcagaggagatggctgttgccaccctaaaggctggatgagcggaaggagagtttgaagccaaaaacaagaaagaggacccaagagagcccagcagcgcgacctgtggaggtcaagccaccagaagaggttgcagaggtgttgccagggagatgggagaaaaatcaggaaggcgtagtatcaggaatgaagggaagagatttgcagagggtgtgagtgccatgtgaggtcaaggaggatgagagctgtgggggagcgctggattttgcagtagacactctagaatgtgccgtctcagggagtggtggggatagaagcccgagtagggtgggccgaggccgaggcagggaggggacagtgaggccgtggggctggactgcaggccgcgctgcagagtttcagtgtgtgctgcagagtctcagtgcatgtggggaagagcagacagatggcaggtaggtgagcaggaacgcgggctcaagggaaggttttgtttaatgtaaagattttgttgaaatataagtctagaaaagtacacagttttttattctaataaagatagattctagcacatgctagctggtgcgcagagaaggcctggagggtcccagaaggcctggtgccagccacccagtgggaaggccacctccgctgagcgagtgcggtgaggacagggtgctgatgtgggagctgagggaatacctgcctgaggggctctcttttcccagggaagcgtgaggcatcagctggagtcaggatggtggaggggaagcctagggggaaagaggagggaaaggagtagtcctttttggagacaagaatccaaagttcattccaaggcagaatgggcgtgggagccagtgttgagtgctgctttgagatcagtggtcctgaatttgaagggagatccggcagcattcatgtcgggttccctccggtgtgggtatggcagagagtcggtgagaggacagtggtcacaggagggaacataatggcggacttcggaatctgattcaatagcaatgttcatgttgctttcctctaggctaccttgaggagtatgttcttcttatagtttagtctagtgccatacttaggaagtgggaacaaaggtctcttcagtttcactcctttcagttagtctattccatcctaagccttctcctctcctgtatacactaagctaactctggaaaaattacctcactaggagtgaaccattacagtgtaatattttgtcaaaataaaaatagatttttaggccgggcgaggtggctcnngcctgtaatcccagcactttgggaggccgagaccggcagatcacaaggtcaggagatcgagagcatcctggctancacggtgaaaccctgtctctactaaaaatacaaaaacaaaattagctgggcgcggtggggggcacctgtagtaccagctactcgggaggctgaggcaggagaatggcatgaacctgggaggcagagcttgcagtgagctgagatcgcgccactgcactccagcctgggtgacagagcgagactcngtct

SEQ ID NO: 160863 - DNA, 518 bp, Homo sapiens
gtgtctactaatgagataaattgacacaaatggttgggttatttgctgaattatcaaatacctactattacctgacttttctttttgatcataaatcttctgtattaaaaaatgtttcaaaactccattcttctaatcagatccagtgtaaagatgtgaagagttcaagatctcagcataacgtgagatcttcaacactaccatcaaccaaaaaaagggaagggggaaattaacgttattgagaaaagacagaggagacacagaggtcagcaaggatgcaagaaaccaaggatgaagaggtcaaagaattagattttaagatacgaactgaataacaagagctacctcttaaccatttctacgttggtgactttggtagtagacacccagtacgtgctattgagtgaacagtggtaactgtctaccaaccacttgcactagcagactccagtgcctccacctccctcacccctcacgtcctgtaagttgcacttgactctacacctgaaccatgtcat

SEQ ID NO: 160864 - DNA, 192 bp, Homo sapiens
gcctggcatgaaacaccctcagatgggaaactggccagagcaggttcactccctttctccaacttacttctcacctctcactgtgactggaagtctgaggtgtggtcctggggaagtgagaaatgtccgccagtctcagttactgacggctaagggagctgggattcgtgtgcacctcccagaggtgccgac

SEQ ID NO: 160865 - DNA, 847 bp, Homo sapiens
ctcccaggttcaagtgattctcctatcccagctactctggaggctgagggagtatggggcaggagaattgctcgagcctgggagacaggttgcactgagctgatattgcgccactgcgctagagcccaggcaacatgagtgaaaccctgtctcaataaaaagtattgggctttggttttatatgaggtcttcagagaaaccaccgtccaagttttgcactatgtctctcttaaaaacaattaaaataatagtatatgatttttttcctcacatggaaaaagctgattttacagttagacaaatgtatttactaaacatattttgcaaacaggacataacacatacctcaattatttgaaaaaaatcacaaaagtatcatttcagtccatataagtataattgcttttaataaagttaaactcctagagaatcattaaagaagaaaagccaggggccatgagctaattaatcagcaccagtaattaggttttaaaattggctttgttaagggctagctttaagcaaataacttgttcttaattgcctttgttccttatatataaaatagaaataataataatacttatccatactttgtcacagaattaacgtgatgataatgaggtaatagatgggaaagaactccaaatagttaacagtaccataaggtagagttttagtgtcagatatagtattttacaatgacatatatggaaaattccttcttttataatgatggaaatatcctaacagttttaaacataacccaagaagtagcagagaagaaagtatactgaagtatactgaacttttatgttcaaattacaatagctctactagatatgtg

SEQ ID NO: 160866 - DNA, 334 bp, Homo sapiens
gatgcctatccctcaaggttggccatactcctctaggagactttaagcttcaggtgactgtcagacctggacaaagcagtgtagttttgcccattagccagggccacatggttctgagggccatctgtctgcttgcctctcctggggctgcaacctgaccatgtctgcttgcaatacagtcttagatgcctaaacagactgtctcctcagagctatcatcatagctccttcactggtagaccatgccagaccacaaaagaactccagcagattggttcccactgacaggcaacagccaacccacaacctcaccccagagccttcccacaatgct

SEQ ID NO: 160867 - DNA, 331 bp, Homo sapiens
cagctcgtacccctcataatgtgtgcccattggcttgtaacttttcttgtgttttccatgtcattttttggtaataatgtgctggctgggaaagtgttacattccacccaatttttctttcactgaaagtttatgtaagattggtgtgatttctgtcttcccttttttaaagacagggtcttatttatgtcacctagcacagtagtataatcatagcacacttttacttcgaacatctgggctcaagtgatcttcctgcctcagcctcccaagtaactgagactataggtgtatgccccatgcccagcaccatgctgggctacttttgtaa

SEQ ID NO: 160868 - DNA, 552 bp, Homo sapiens
aacgcgctgatagcctcctctcaaaatctcctctctcagttcacacccaacagctaagtcacactcacgggaacacctgcatgatcatggtgtagtgggaagcggttctgccaattatcagcattagatctgggccaagttgagccagtttcctgcaaagggaagctctttccttcctcatggacataatgcatgaaggcacccaacaatggcaggatcctcggaaatgttccttggctctgggtttggctgtagattgactgtttttgttttgtttgagacagagtcttgctctgtcacccagagtgcagtggcgcaatctcagctcactgctacctcagcctcccgggttcaagcaatcttcctgcctcagcctccccagtagctgggaccacagtcacgcaccaccatgcctggctaatttttgtattttggtagagaggggtttcaccatgtaggccaggctggtttcaaacttctgacctcaaatgatgcaccccactcaggcctcccaaagtgccgggattacaggcgtatcagccgctgcgccca

SEQ ID NO: 160869 - DNA, 659 bp, Homo sapiens
cgacactctgagtgaggatattttcttttgtttttttgtttttcgagacaaagtctcgctcttgtcgcccaggctggagcgcaacagcacgatgtctgctcactgcaacctccgcctcccgggttcaagtgattctcctctctcagttcacacccaacagctaagtcacactcacgggaacacctgcatgatcatggtgtagtgggaagcggttctgccaattatcagcattagatctgggccaagttgagccagtttcctgcaaagggaagctctttccttcctcatggacataatgcatgaaggcacccaacaatggcaggatcctcggaaatgttccttggctctgggtttggctgtagattgactgtttttgttttgtttgagacagagtcttgctctgtcacccagagtgcagtggcgcaatctcagctcactgctacctcagcctcccgggttcaagcaatcttcctgcctcagcctccccagtagctgggaccacagtcacgcaccaccatgcctggctaatttttgtattttggtagagaggggtttcaccatgtaggccaggctggtttcaaacttctgacctcaaatgatgcaccccactcaggcctcccaaagtgccgggattacaggcgtatcagccgctgcgccca

SEQ ID NO: 160870 - DNA, 186 bp, Homo sapiens
taggagttggaaactttccatctaatatgggtttctattgttgaaaaaaattattctgatacttgttaaaatggtaaggaaaactttactcaagactattgcacctagtgcaatagcggagggctcaactctaactacaacaaggagaagggggtggatttatgggtgaggggaatcagtggatgg

SEQ ID NO: 160871 - DNA, 328 bp, Homo sapiens
aggaagggttttaaatgacgcatgactttatcagaattattgagaaagatcactgaatagaaataaagaatggctgtgggcaggaaattgggctactgcacttatttggatgagtattatggttgcctggatttgaatggcaacagtttttattgttgttgctgttgtttgtttgtttgtttgttttgagacagggtctcactctgtcacccaggctggagttcaatggcacaatcacagctcactgtagcctcaacttccccagactcaggcgatcctcccacctcagcctcctgagtagctgggattacaggcatgcaccaccaca

SEQ ID NO: 160872 - DNA, 200 bp, Homo sapiens
tggcatagagtaagtgattgtgttagaaatggtgaggtattctgctccatctcaagcacagtgctctcttgttcgcagtggttgcaattagatatttgggtgttaatttgttttctgggccagcagatggtgcccttatataggaaccagctaatatgatggaatattttgagtgatcaggcatttaggcccatcatcag

SEQ ID NO: 160873 - DNA, 468 bp, Homo sapiens
caaagcttttcttagatatttccccagtcaaatattcatcttcacctctgaaaagctctaccttccccaaaacactaaaacaaaaacacaatccagccaagttttttgccactttataacagggatggcctttcctccattgcctaataacatgttcttcatttccacctgaggcctcatcagaatggtctttactgtctgtgtttctaccaacattctgtctatgtttacgtaggtaatctctaaaaggaagttttctgtacaactctcctcctctccttctgagctttcaccagaatagcccttaatagtctgctcttggtaatgcagggtttttctagcatgcacctcaaaactctttcagcatctactcattacacagttccaaaaccacttttacattttaaggtatttgctgcaacagcactccattctcagtaccaattttctgtcttagcctttccagga

SEQ ID NO: 160874 - DNA, 356 bp, Homo sapiens
aaaacaagtagcagaggtcagttctgcaaaggatagaaagtaagtaatcaagactgaaaggccgcaactcagcagcaaacacttctatgttaatttgagaaataatttcaactggctctccaaaagatgttggtttaaagcagtaacatgggagttgagctgtgtgctataatcacccgaaagctttaagtcacactgttgcctaggtctcactccagagattctgacttaattaccccattgcaacttgggtttgaagactttaaacactcctctacaaggttattgaaatatgcagccaagggtgagaagcattgattcagggtgaggaatacattggctgtatgtgattttca

SEQ ID NO: 160875 - DNA, 180 bp, Homo sapiens
ccctggtagttctgtggcactctatatacttctgtcaaaagacttaaaaccacagtgtaattgttttcgtctgtctttaactcttcaaaaagaggaaaatggctctaaaaccattgagaattagcactatcttttatcttcctttatcaagagaaggcaacccgggcacgggtaccgagc

SEQ ID NO: 160876 - DNA, 152 bp, Homo sapiens
atagctggatcctgtactctgtcataaccagcaactgctcctcccgttcaatcttcaattccactatccagtcttgaacaccaaccacttcatgtcccagcagccaccttctggtttcatttgttccctattcagcctagactcaatggccc

SEQ ID NO: 160877 - DNA, 401 bp, Homo sapiens
gaagtgagatgtgggggtattgggggatgtcagtcttctaggcaggggaagcagccagggaatggttacactgtctgacatgaaatatcagctgtgcaacgaggaaagtgaagacctgagggggcagaggaaagacaaaaggagaggtatcatgagtcaaggtcccagtgagactgacgactgttagattagagatgtgaaggggaacaagcaggcagaactgtagattgtactctgagagcaggatctataacatggctgttaaggaggtattgcagatattgtcattacatggactcagaaggaccaaggagagcagaagaccagacaggttgagaacaaggacccaggagggtgttggcaggtcgcttgtctgggcattgatatgaccaagaataaca

SEQ ID NO: 160878 - DNA, 240 bp, Homo sapiens
aaagctgaggctcacgggagttggtacttgaaatcacatagcattgaacctatgctctgaccctaaatcctggacttcctccccttgcttgaggaaggcctctggcttggccccactggatctcggaaattgccttctaccttctagtctttgttgagggtactgaactttgatgaaatctcttctacagttctagccctaccttctctattataatcatctgggtgatctgggactcag

SEQ ID NO: 160879 - DNA, 311 bp, Homo sapiens
agctggagcctcgaggggcttgggtcatctgggcaagagaacataaggcccccagctaagaggcctggccaaggtctggcagtgagaaagggggcagccaggactctgctccaggacctctggttccaagctggcgctctgaggcacgggcctcttcagccttttggcagatgaggaaacaggtttgccaagcttgcctacaccacagttggtacttaggggtacaacaggtggaagccagggctttgttttggattctgaatcccagaaccttttagcttcactgcttaaaaagtggacgatggagcagg

SEQ ID NO: 160880 - DNA, 279 bp, Homo sapiens
aaggttttttttgtttccttctccttccaaattatttttatagttagtgaaaaaggatatgctttcctgttcttccaatttccaaatgatatttaggtaagtccaaaagaagagaacattctttctacatctggtaaagacatgactgctgttaaacacagattgccagtgctctgagatgaatccagatgttgaagagagccccagtttgctattatgactttaaaacataagcaaatgtctgtttttttcagatgattgtcgtcttagcagtgaaat

SEQ ID NO: 160881 - DNA, 577 bp, Homo sapiens
aggtcgtgaaaatagaatataatggctgtttgtattaaaggaaaaaaaaagagaaaatgatgtaatcctaatgcttagaaatgtttggaatgccacatgggttacaaagagtgaaaatctagtttaaactggttggattctttctctctcagaatgattaaagttgagcccagaagctcacccaaacacacatatttgcctaaatataaatccctgtggaatgttggagctataatgtgaaaaacagtttctgtgtttttgtattttctctaagactgacctacagctttcttatcacaagttttgaagcaatacttataacatagatgataatttagagttattttttactttgctttttgtgggcaatggggatggggactgcagtgaagatgggagagaatgaggtgtggccctcagacatagtgctgtgcaggaagcctactacttcagaggctgcccacagcctcacatacaacaggtaataatagaattacatgtttgaaaactagaaaatgagaagtagaagccagatgaaattgttaaaacaagtttttcttttttccctagggccagt

SEQ ID NO: 160882 - DNA, 133 bp, Homo sapiens
tcccctagaagccaaccctgacacaaagattcatgtacatgtgattcattaagtgttcccaggaagacccattaagagcatggggaaaacaggcatggaagaggctgaagaaagcaaaggtgcagttttgggt

SEQ ID NO: 160883 - DNA, 314 bp, Homo sapiens
tcacgccattgcactccagcctgggcaacaagagcaaaactccatctcaaaaaaacaaacaaacaaacaaaaaaaaacaaataaataaatagtgcatagaagaccattcacccactgaaaatctatcagcagttttaacatttcattcaggagaaaatccaaacttgttataaggcacttcctgttctggcgccaacttttctctccacatgttgtctactctctccccatcttattgtctactctctccccatcttcctgtgctttgtcatactgtgctgtctgctcttcaggcacaaagctgggtcccacat

SEQ ID NO: 160884 - DNA, 240 bp, Homo sapiens
taatttggtatttttagtagagacagggtttctccatgttggccaggctggtcttgaactcccgacctcaggtgatcttcctgcctcggcctcccaaagtgctgggattacaggcgtgagccaccgcgcccgtatgcattatcctttttttacttcctgtattgtttcgatttgtttttaccgccatatttttcttcgactgttacttcttcttttccattcggtccttttttttttttt

SEQ ID NO: 160885 - DNA, 571 bp, Homo sapiens
ggtttccctgcacccaatctgacatagaagagaagcaagagaggtggggctaacagaaaaagcgtatgacaactccatatttgtaggaagcagcctgttattgaggcagaatcagagaatagaaatgcattgtgagtagccctaaagctgctaatctctggtggcaagggagagttaaggccaaaataattcactcaaatacataatcctgtgtcataaacaacgtatgtctctgtgaacaataagaattcctgccagcctagaatatggacagatgtagcatttattccacacaaacctcttgccagtacctggtccagaaaaaaacttatttcattaaaaaatgagcatctatgcaaaactactccaagaaaataagaaagaaaataaataagggggaaaatagaagacaaagaatactcaccaagaaaaatgtttccataaagtagataaaaatgtgggccaaacatattgccaaagtcttaaaaacaaacaactgaaacaaagctactatatctataaaacaagtgttcacatcaaatatacaagagctcaggaacaataataccag

SEQ ID NO: 160886 - DNA, 351 bp, Homo sapiens
caaattagtaaactatttctgttgacacctttattctctacccagtaattcaaccggcagctactattttcactaagtactgttaaataagcttgacaaaatgagatactcttacatgaattcctggtcctaaagaatttagtcctttcttcagcatacaaattaatgcatgaattcatttgctttataaaactataaaaatacagaagtatacaaaaagcaaatgtctccttttatcttctctgttcccacatccctcggggacataactactgtctccttatttagggtatttttccagtcttactctgcctttacagggacctatgtacaaaacaatgtattttttcc

SEQ ID NO: 160887 - DNA, 535 bp, Homo sapiens
ctttgaataccccacatatatagccagtgttttttggcgtttgtcattttggggcaacttcacacatcaaaggcgagcaccgttttcttttcagctccctggttccagccacccagtgaagcagatacaatttctataaattggccttcttctccaggtttcgattgatcatcaccatatgagattactgaaagtctaatgtcttatttcactttctccaaggagtgaggaggggaacagtttattgaaagtcaggccacgtgaagactctggtgttgtgcaatagtaatttccattagcctggatttatcagcctcctgatactgccacgtgtctcctgcaggttccttgtaccaccttccctcttcccctccaggtctcagcatctgtccccatgaacaggtagagttcaaaccggagccttcctattggtaaggagaaaatggctgatgaccaaaaattaggaaacaaaagatttgttgttgtttctcaggacggagtcttgctcttttgcccaggctggagtgcaatggcc

SEQ ID NO: 160888 - DNA, 129 bp, Homo sapiens
caaactggtacatcagctccccggccctcaaactggaacatgagctccccgcggtgtctccagctgcacggccctgaaactggaacatcagctccctcctgggtctccagctgcatggacctcaaactg

SEQ ID NO: 160889 - DNA, 264 bp, Homo sapiens
aaactcatggttatataaaggattggtgtcaaagtcagacattttgtatacaatttttgcatgaatatggttctaatgaaaacagagatggctttctatggttacttttagcctttagattttgaactaaatttattttacttgtgattaaagagttcttgaattgtgtgctcagataatactccatattgtatcattagcctaataaagtaacactttgtgtttcctatacaataaaatgaaaattatctatatggtattaag

SEQ ID NO: 160890 - DNA, 215 bp, Homo sapiens
ttaagtcctatgaatagaatcacagagtatatacccttgagtctggcttcttttgctcaatattatgtttgtgagattcatttatgccattgtcccagctttatttatttattttttctcaagacccagtctggctctgttgcccagggtagagtgcagtggtgtgatctcagctcactgcaacctccgcctcccaggttcaagcaattctcctg

SEQ ID NO: 160891 - DNA, 354 bp, Homo sapiens
gtgctatttgcccaaaagatacagaaatttcatagaaaataaaaaatgaaacaaagaaaatccagaatattcataaagattcagatatttataccacatgtgaagaaatcaaatggcttcacttactcttccctgcaaagagaagtccactgataacatcgcacattttagtcaactaattttcccaccaattatccagttgtcctgctttgagcccagacagttgatgactgtttcagagtcaaattcacaaaagcatcacttgtgtatctcacattgtttgctacacatttcttcaaatggattcactaatgagacacactggaaaaagttatgtaactgcggatcaggcaa

SEQ ID NO: 160892 - DNA, 297 bp, Homo sapiens
gttgttgttgataacatcagaggattgtggttttactgttctagttttccttttattgagagatttggggaaactaaaaaataaaatataggcagtgttacaagcaaacaaatgagcttactatatttcaaatgaataaaataactacacttgaggaaggaagctggctgaggctggtggatcacccaggatcaggagttcgacaccagcctgggcaacatggtgaaaccccatctccacaaaaaatgcaaaaaattaactgggtggtggcacacacctgtcatcccagctactgag

SEQ ID NO: 160893 - DNA, 463 bp, Homo sapiens
ggcctgctgccggcgtgggaaacgggggatcacagccctcagtcctaaggctctcttttctcttttaattttctttttttcccagtctttgattatgtcacttatgtcattttcctgtgaatcttatctcagttcctttgtgtgaacaggcagagcacaagaatagataaatcaataattttcaggaatggatcataacattgttatttctgagaaacattcaaagtgactaattttcatgggcagatctccaggcacttttttggattggaccagagtttctcaacccactgttgatacttgggaccagaacattctctcttgtggggggaccatcctgtgtgttgtgggatcctgtcctctacccactaggtgccagtagtgacctccagaaaaatgcctccagacatcttccaatgtctcctgttgagagaacttgctccgcaatgagaaccactgggtt

SEQ ID NO: 160894 - DNA, 395 bp, Homo sapiens
cagctgggaacactatcaacctaggactgtatttctacttatttcttgaattggggtttatcagactctgagtatggtgtacattcaaatgctggaactgcatgagactagggctatgattataaatgattagggaaaatgattaatgttattagtcctttccaccccattttgccatttttgtctatttctcaaatgtttctctcctccctattcttactattaccagggacagactggttttcttgttggttcacgttaccagtatgcagatttttctcttcacctcatcaacaggtgatatagcccttttgggtgcttggctttaagtacagttcttagattcagctcctctactttgtcaagtctaaatactattcctcagtgatgctgat

SEQ ID NO: 160895 - DNA, 378 bp, Homo sapiens
acctatgttcccacactcagtgaatggcactgcccagttgcccaaagtagaaacctcatccttgaatcttgcctcttcatcatattgcacatctcatcaccaaagaccttcgtctacgtttccactgccactgactcaagctcaagctcccaccatctcctgcaccattctcctaactgatctccctgatgttaccccctccaccactgataaacagcaatcttcccatcatgtcactcccctgcctaaaagatttcaacaacattcctgttacccctagattctaagcatggcacacaaggcccttcatgatccaacaaaactccaacccactttcctactctcttctccacccatcccttaactactagtgctcta

SEQ ID NO: 160896 - DNA, 187 bp, Homo sapiens
aacacaaagcaggacacagaagggtggacttgagaaacaattggtggaaccatcacagtccttgcctttgacgaatcagcttccatatatatctactacacacttttaaacttcccttcacaacaaggcaactctgtgtttccacctaaggagatgcagttatcccttgtacacataaggaagttcc

SEQ ID NO: 160897 - DNA, 545 bp, Homo sapiens
taacagcaccgagaagaaatggacatgaagccacgggtggtggcccacacccataattccagctatttaggaggccgaggcaggaggatggctttggctcaggagttcaagacaagcctggacaacatagtgataccctgtctatacaaaaagaaaaaaaatagcaggtgtggtggcatgcacctgtagtcttagctactagaggaactgaggcaagacgattgcttgacctaggagtttgaggtctcagtgtgttgtgatcatgccatggcaccccagcctgagtgacacagtgagattttgtctaaaaaaaaaaaaaagaaaaagaaaaattagggcgtacctgggtcttaaaggggagagtaggaatggcttgaaaattctgtcagaaacctgtgggttgggtgatcctgcagtcctcttgggtcactgccaggtgtgaccatggtttactatgggtcagaggcacagtgttttttttagaagaatagagtgacgcatggtaggtagaaatctttcgggatggggcctaatcgcagaaattc

SEQ ID NO: 160898 - DNA, 557 bp, Homo sapiens
ttacaaattaagagagttgtgaataaacaattgatgaaagtaagaggtagttttctccagggattcttattagggggaaggtgccaaaaagtaatgtagcaaatctactcaagagaatagttactttagaaaggtctttagctaaggcccttgtttccttaattgattttactacttaaagtttgaaaacattgattttatttttttggaatattctggtctcctccagccaattgcccttgatctgtgtttatatctactctgctggtcttttcacattaaaaaaggaacccatgtactgaagtatcaggagaaaccagagttggaaaaaaaaataacacaactgttttatcttctttttcagtggttctactacaagcagtaaacaaagagatctgcccagatcaagcgtactatagttaggcttttccatatgtgctggtttgattatagttactttttaatgtgtcagtgaaatatactggcataagacactaagtatttactttttttctttgtgaataagagaagctagctctataaccctgtaggagagt

SEQ ID NO: 160899 - DNA, 262 bp, Homo sapiens
gtctcctcgctatcccttcactgtctcctcgccgtcccctctgtctcctcgctgtcccctcaacgtccccaggcctgtgcgctgtcaggtcccgatgggccttgaggccaccgacccgagggtgtgtgctctgaggctgtcgaaggccctggccctgggagcggccatctgaaagtgtccaggcactccctccccttctcccagagccccgcaggggctgggggattccctggacacatgaccagcagctgaactctgctgt

SEQ ID NO: 160900 - DNA, 227 bp, Homo sapiens
ctatggacagcacatcataggtccgcaggatgaaatattaatgtacaatttgtttatctgtgggctcacatctttccagcactgagctgttaattttctatcagcacagacaacggatcagtcagtcatgaactcttcacagccattacccagagacattttgattaagtatgcctaatgtagtggatagggaagaatgaaaacactctgcctgcgactagtgattg

SEQ ID NO: 160901 - DNA, 265 bp, Homo sapiens
gaccttgagtaaaatagaaattttaaagtattcagtgattgtctagagagggctactaagattgtaccttctaaactgtattgtctttccttattcgtatgagttggcatggcttcttttatcactaattccttttctggaaaggggtaaaaatagttatgacagttttgggaaggtgcgttttcagattagctgtttccagagctgaaggtaatcatttattcaaggcctgatgagctggagtttgcagcaggagtaggagtta

SEQ ID NO: 160902 - DNA, 423 bp, Homo sapiens
ttttgagggctttggtatagaaagggaaaaaagcaggcaggagggaaagaggaaagaaaaaaaaaagaaggagagtagataaaagaggcaaatgattacattcttgtgagtctttgattggcactctctgaatacacattttacatggcaaagtgcgggtagaggaacagtcaatcacgcgttcatttcatgcacagtaaatccacttttgcataagacaaagtcaacatacagaagaggaagatgtcaaacatgcatttgtctcagggtgggcggagagatcatttctagtcttatctttgtcccacacttgtgaagacaagttgttaatttacattgtcagggagaaattcaacagaactctgttttaggggaaagattttggagcccacaagaaatttccttatgagcaatttgtgagag

SEQ ID NO: 160903 - DNA, 405 bp, Homo sapiens
gtaggtcggtggagcaaagtaattggtgttgctgccccagtgcagaatggacaagggtgaaccttgggttggaggctggactatataatgtaaggatccattacacttctatggggctcttccttccgtccttcatggtaccctcctgaacaattccgtgctaaggccatcaggtgtgtcaagcaaagtgggcgtttgtgtagtatgttccacagtggcccaagcagggtgctggactggagcaggttgaggagggtggcagcacagtggggctgcccagcacaatgtcagacacaaatgggtgctggtgcagcccggcccagggtcacagcccaagcaatttgaagatgtggcacatcccggtattggagtggcccagtgtgtggtgtccagggagggcagggt

SEQ ID NO: 160904 - DNA, 313 bp, Homo sapiens
ggtcagagtctagagcatacaactccatattgtgtggccaaacaaaacacatctgtgggttagatccggcctgcagactaccatttttgacttgtgcttctatgggtcatgaattactttagtatttccagctgctgattcagtactttaagtccatgcatggattccccctttcttatgtggcagttcctgggatgtggtcctgtgctcagggttcagcgactttggagagtattttcaccactcttcaggggattgtgtgagacttggacaagaactctgaagctccaaaagctggggactccttgtgggg

SEQ ID NO: 160905 - DNA, 282 bp, Homo sapiens
gcattccagagacctgtcttctatgaatatccaaacatttaaatgtaggtttaatctcccttccattattcacaagggatgaattttgaaatattttaaataaggaatgaaaacaaaatgaaaaacacactaaaaaacagggctcagacaagtggttttgtttttattttcatttttattgcagaattttctcaaacatacacaagaatagagagactggtacaatgaacatctacatacccatcactcagcacactaacagtcatccactcttgcccatct

SEQ ID NO: 160906 - DNA, 297 bp, Homo sapiens
cagcttaaggagaacaaagacaacggggaatctcacagagaaaaaaataaggctaacaagtgacttctcgatcgccagagcagtaggtcttcaccttcattgcctggctctggaccaatggccactgtgagtttcccagtcttccactttctaaatgagagtcttttgatagtttagatacacaggacagtggattcagatatctttgagccttttggttcttaggttgctgtacaaaaggaactataaaatgatatgatggagaggactgcaagtcagctggagatcctgtatttt

SEQ ID NO: 160907 - DNA, 343 bp, Homo sapiens
atcactataacaaaatttagggaggacagtaaagagctacagtgacagaccgcatggggacttggtgcaatggcagggctatagcagctcatgaccagacaacaacccgattcatataactggtaggcagaattcacttttctcaggtttctccattgtttacaaaataggcttgctgggcactttaccaaaatgacttttttgttttcattttttttttttgccttttaacatcattttttttagctattattaattttttacttattttaacctttgtggtttttgtatgaaaacatcattgaaaattccattcgattccatgtatagatgtagatctctc

SEQ ID NO: 160908 - DNA, 165 bp, Homo sapiens
ggaggaaagcagtaatgtagcaagcctgctatcggtgcccactaagtggatgccccttcctggttattctccatctgtcccatctgtctgtcctcccctgcccccaatcgcattcttcactctcctacacactgcaccaccctgggtggctccctgcaggtggtt

SEQ ID NO: 160909 - DNA, 615 bp, Homo sapiens
taatgtaggtttgctgtctactagctaggtaaacatagatgccttacatagctgttaatttttagtttccttctatgtaaatgggtgcaataaacttataactttagaagatttttgtgagggagcttgtacaaaagtccctaaagagtagataggtataaatttgccaaataattatgaaaaagattttttaaaacgtctgtgacccgaagagtgttaaatcagtctgctggaagaacgtaccgtttagaaatagatacaaaacttgtcataaatataacctcagtataagattatttttgtgttatgtacaattatgcaaactcttttggggcatccagagggatggaatagtttttaatgctttcatggaagcatttgagttggaaattcttgaagagtgttcccaaaatatttagctgacattactttacgctggacctccatctcctgctccagatacccttcttgtggcacctatatgagtctaatgtaatggtgaattttcttatctgcttccctcataagtttgtagctcctattacttccattggaatagagttcctacatggttctactttgtatgtcttgcactgaagtgtgactcattataaa

SEQ ID NO: 160910 - DNA, 420 bp, Homo sapiens
caaaaggtttgagtcaaatctgtaagacaagtattaaaagctgaagagacaaaattatgcagggcggggggagctcaagcttactggtaataaagaaatagagatttagaaatatacaattttatgttgccaattacattagaaaatattttaaagacatgcccccaatttctctgaataacatgggacaaagtgtaaccttataaatttatctaaatcctcacacttaaaccatttttataacttccagaacattcacctcatatgtataaaatcaggaggaggaggcagattataaactttgcttattgttaccattttccatggaaggtttaagggagagacaaatgccactcctgagatgatgtcatgcaacattagatggatatttaggtggatagttaaatttcaggatagtca

SEQ ID NO: 160911 - DNA, 471 bp, Homo sapiens
cagtgtgcatctggccgtccttgtgtacctgcatgtttaaatgcagaggcttaatttgggctagaaatcttagccaggttaagattttgctactagaactgactctaggctttcatatttgtattattggcagataaggagttgtattttagttaagctcatttcctcatcgtagtggctgctaaaaagattgtgataggattctcccagtttttactgaactacttatcctattatctgtgcacttcttttctgatacagctggcactttttctgggaacttcttgaggggggataaaaaccaccaagaacaattataaaataagaatgatcacactaaagagcaataataaagtctaataggcgcaatcatgagttagagtaagctaaaggagggaaattgcaccaaagttctccaggtcttggctccagtagtatttctttggggatgttgttgcttagaaaactggg

SEQ ID NO: 160912 - DNA, 318 bp, Homo sapiens
ggctcatggaggcctcaggaagaagtcccaggctgacgtcagtggcataaagctagaaaaagctgtggacgatggaccaggtcttccttcttcactgagtttgttcatgggctttttattcatttcacaaaagcactctgattcctggatttacagcaaaaaaagctcaagggtgagtgatacagttttcttgtcaggctctggatccataaagctacctggcagacagtgaacatcccactcactcccccctctacagagtgcaaaacccctgagttgggaagtcagaagatgccacatcaagatccgccagggctc

SEQ ID NO: 160913 - DNA, 267 bp, Homo sapiens
ctgtaactcgagaggcagtgacaccccaccttctgggggcttcgttcaagtcccagccctgctagatggcctcagtgtagccttgggcacattattcggcctctctgtgtttgcatttcctcctctgtaagcttcagctgactttgttgggtcagtgtgtgtgaagtggacagcaggcccgggctcaagggtaagagtgtgcacttgcttgcacgcaggcttttcctttttttctctcgttcctctctctcccccacccctttcttg

SEQ ID NO: 160914 - DNA, 441 bp, Homo sapiens
aggtatgggtctttgctaccgttggacatatgtgatgcaggcacagtctcacattggcagataccacagtttccttctcaatatataaaataatacttgtgttaggatcatagaatagcaacaacacccattgtctgtatccattccaggaaggttaaatagttcctgaatattttttgaactgcaaaatataagctgccacttgctcctagggttgaaatcagtaatgaacacacttccgtctactaaaaaaaatgattctccgctaggctctttcttgtattctctccttcccagtaacaatttctttttttctagaatcaatttctctcactttcttgtctttggaaaatggggatctggctgctatgctgattctagctcacattgttaactacatctgaatgcataccattcaagtttataaatgacttccctgtt

SEQ ID NO: 160915 - DNA, 480 bp, Homo sapiens
tggcctcctaaagtgctgggattgtaggcaggagccgctgtgcccgtctgatgataagttttgtttctaattatttgagttcaggatattcttgggacatctaggtggagatatatgttcagcagccagttgcatactggagattaatgctggaggagaaatgaaagctgaagtcatgagagtacatcagatcatctagaagaatgaatagagtaagaagattaaatcccaggaacagcaaacatttgaagggctgatgcggaagtaaaatccttaaagaagttcggattctcagtagggaggaagcaatgaatagtgtcaaatgtaacgagaggccaaacaagtttaaaaggacagcattgtttttttgaggtttagcattctggaagtgaagagcaattatagtagattcatggtcctaattctgaaaacctgattttaattataatagttctattatgattttcactttgtttcact

SEQ ID NO: 160916 - DNA, 422 bp, Homo sapiens
aaacatcaaggctccggagtcctccatctgggttgctgcagtgtttgaaaacataccaccctcttgactttgctaaattttcttcttggggtaaaagtgaactgacctattagaagctgttgtaatcaagttcaacttcttttggccacttcaagaaagtaaataggcttactattccccattgcaaaattgaagggtccaagaagcaatcttttccctatgaaattgtagtaacataactcatctctgccctcttaacatgggaggtgacaagtgtgttgagaactctcttcaagccagttgcagtgggtgtacctgtagttctagctactctggatgctgaggtgggaggatcacctgtccagcctgggcaacatagcaagacccccccaactcaaaaataaataattgagaaagctttc

SEQ ID NO: 160917 - DNA, 436 bp, Homo sapiens
tatgtttctcttcttgtacacttttccttttttttttctctacaattaccacttgatttcagttttgtgtttatctggatgtccagtttagcttttgaatttgatcatttttgttacttcttttccagatgctcaaacatataatctataattttattatttttcctgaacacatccatcccagagccttcagctctgccctccattctagacagattgctttctcactttgctcccccatgatcatcctaggacttccttttacctcctttttgtgttgtataccctctatccatgatcccagatcttccgttttctttcctttctccttttgttggagcattctcggtagctttctggtatctctgagtcctgcacacacaggggttttgtaaagtgaatcacctctttctcatcatgagctccctctacatgg

SEQ ID NO: 160918 - DNA, 277 bp, Homo sapiens
tctgtttttaataggatgagaagagcatgaaggacaagaagcttaccataaaaaatatgagagaaggacatttcagactaaaggaacaagccagttcaactgcttagcatatttgaggaggggaaagtataaaactgtcacttaatgagcatagatagggatcaagttggacaggaaggctagatgagaatataaaaagtttttgaggtgatggcaagaatttagccccctgtttttcatattgggatcctatgcctatcaacaagactgtgggtac

SEQ ID NO: 160919 - DNA, 134 bp, Homo sapiens
gctgacgtgctgctggtcatggtgttggtgattgaagtattgctggccatggatgtatttatggtaatggtgtcagcagttgaagcattgatggtcaggaatgtatttataataacggtgttggtggttgagct

SEQ ID NO: 160920 - DNA, 316 bp, Homo sapiens
tgcattcaaaaaataaaaggagaacatgactagtgtgggttgtgagccagtgcaatgggtcaaactggggaaaggaagccacagagcacagagataaacaatcttaccaacctctgatgaagggaaaagtagttgctccccaaaagaataagtagggtactttatcagacagtggggatggctgctagatgatgagtaacgttagttattgtaacaagcaaatcccaacatttctatgtctgaacacattaaaatgctatttcctgctcacataatttttcttttttgagacagggtcttgctgtgtcacccaggc

SEQ ID NO: 160921 - DNA, 220 bp, Homo sapiens
atgcttaaaagtggaattttggaagtattccgttacaaattagcgtggttgtgttccaataacgttttacttaaaaataaaacaggtggcagaccagatttagaacatgggccatagcttgcagactcctatattaatgggtgacatggaactctactagtctaaagtagtgttcagaagatactgctttatagttccaagttcaggccacaggtctaga

SEQ ID NO: 160922 - DNA, 530 bp, Homo sapiens
catgaaatgtgtagttcacttgcctcttaaaattaagtatattatgggctgtcagaatactaacgttacctggtgtttttgtaatgtgtctctgtccgactagacgttttttgcttgtttttacccttgttttttggagtgtgcactaaaagctgtcagtgtgatattctggctctgtcatcagttggtttaaactggctgtttccatgaatgcatgttcacagttgtggttccttcaaggaagggatgggagaagagcttttaaaacttttttgagaatgtgtcttataaagactactctgggaataatctgctcatggaaatgttcatcttctaaagtttggcctgttgatgtgggaggactctgctgaaagcgtacctgtgcgcagcaccgtggtggtgggcggtgagggctgtaggagaccaaggcctgggtctgccttgcgtgcatcacagtgtgcggacagggaaggtgagggctgtcagtcagccagtgaacaacgttgggtgaataaatgctgcccatcact

SEQ ID NO: 160923 - DNA, 386 bp, Homo sapiens
aaagactcttgcttggcacaaggaccttactttctgacactgatcacatagatgtgaactttggcatgaaattcaggcagtgtcggaaaccccaggccccactatcagagctggaattagacaacgctctccaggggagaatgagtttccagaagccttggctgtgcccccttcagtcagggaaataaagacccttctatttccctgtggccagccagggaggatgggtgagtatcacagtgaagaaccaggaattttgccccttgaggggcccagagagctctgctcatctatctgtctccagtgataggcatagtgaaggatttttctgaggcagagccagaagtctggcttagggcccagtgagtcatcttccaagagtctag

SEQ ID NO: 160924 - DNA, 258 bp, Homo sapiens
ggtgaaaacaagaatatgttagaaacgatgatgtaggaatggaaaaacgacaacgcctacctgcagaaaagtcaactagtaaaaatgtgatttttttttttgtattgatattaatgaggtgttttgtcaaacaaaaccctttatgtttttgtatggacataaatcactgttgacctgtttcatgttcctggagatatcctacttgagaaggaatattgattgatgattagttgactgactgatttacttgagatggag

SEQ ID NO: 160925 - DNA, 359 bp, Homo sapiens
gcaaatcacatgacctctttgtgtcttttgcaaaacagaaacaataatccttaagaatgttaagttggtgttgtgtagactaataaaaatgattggaaggcaggcacttggcatataaaatgaagtgtgtgatgtaattcccaaataacaacaacagaattggtatgtgacctactgttgagttacaaggtgcagtagactttttatgcagttgatattctttgctgtcattgaaacacaaaacttaaggtgcaaagtactgtttgagttggggataagagatttttggagcagttatcaaatttgaccagtaaggagggattaatttacttcaggaatccccattgctttccagaaag

SEQ ID NO: 160926 - DNA, 386 bp, Homo sapiens
ccccaggccactgcacaccctgcaacagtgggctgtgccctggagctgcgccccatggagtgtgacctgccaagtcacactgggcgcacagcagcccctgagcaggcccagcgcaaacacaggggcctcctgcagggaccttgtgtcacggccacacggagctactgactgctgacacctgcgtcttcgccgccacaccggccctgcaaatcattaatgcttattctttcaaaggcaaaaaaacggagaatgatccgccagacgccccacaggccctcccctccctgctgaggttttgggatcatcaaagagatgggaaaacaggaagtgtagggttgtgtgtgtgtgtgtgtgtgtgtgtgtgtaattgtgtgtgtgtgtctctg

SEQ ID NO: 160927 - DNA, 705 bp, Homo sapiens
catcaaatgaaagaactcatggggttcttccaagtaatgcccaccctgcactgtaaaagtcacaaataactaaatgctctggccccaagcccaggatactttaacttcatgaaagactatttttaagagtccactcctctctatacttcaagctaaacgggaagctcagagatagcagaggtctgtggaatccccatcacagaggactatcttggaggaggtactccagaagaatttgttaagatgaaagaacacacacacactcttggcatgtggaacatatagatcggtggttctcacactggaatgtgcatatgataacaaagattgctggaccccatatgtccagggtttctggtttaacccaggtgatgctgataatgctggtgtccagggaccaaagtttgagaaccactgacttagaggattagaattacagcctcaacaagtcttttctagccaagatatatttgagcaaacatagtaaatggaacagtgaagaatgtataactcatgatattaaaaatatatacaatatcttgcttcttatgtaacctaaatgttcccattctaagtcagaaactggtctgagcattacaaaataaaagtaaaaataacataataacaaaagctgttactatcatagttattaatacttaaagctagatcatcttttcagtaaaatcttcattaaaaatctaaatt

SEQ ID NO: 160928 - DNA, 265 bp, Homo sapiens
cagggcagcagtgatcagcgatgcccgcaggagaccaagacttccagggccaggggacctgctacttatttatcacacacttaatgacacgccagacactgttctaagtgcttgggagacattaacagagggaggccccgaggggcccacaggtggcctgctagggaatggctgggcgggatttgaccccaggcagtctgggcccacaggctgcccttcagaggtgaagacggtagccctagctgggtaaccatgtcttcatgcc

SEQ ID NO: 160929 - DNA, 181 bp, Homo sapiens
ctttgcaatctggactgagctgagtgtgtgaaagagggtgcctctatttgtatttttggtttgtatcctatttttctatttctattgttctatagaaatggcttcaaactgctatcattcctttcactttaaaaatagaaaaaatagggccaggtgcggtggctcatgctcataaacccag

SEQ ID NO: 160930 - DNA, 180 bp, Homo sapiens
ttctgtgtgccaaattatattttcttggatgaaataaatagcccttaaccctgagaaaaacacaatggccagagagcattataatttgttgacactcctcattccctcatccttgtcctctgaaaacttaaataaatgagtactcagattgaagctaaccagcaaatctctcagattcca

SEQ ID NO: 160931 - DNA, 203 bp, Homo sapiens
tggctccagggctttcttgtccacccctgtccacagagccaggctgcaccttgttcatgcccatggggttgccactcaactttcagaggatttgacggccccatcctggcatctcccgatgctgagtgccggcaggttctggttaatgttcagtcttatacctgctactccatttgaagtctctttgcttgacatcactagag

SEQ ID NO: 160932 - DNA, 707 bp, Homo sapiens
ttatgtgatttacatgttaaagtgcccctgtggtttgatttgcatagcaaagactttgggggcatggaaacaaagcatcagtgtgcatgatgagagtactattagcatagtgcgttcagattttcagacagcctggctaggcaaacaatcctgcaccttcaccacaagcgtagagtttatacgatttgacaatttctcatccacaatcaggaaagaggttagggagttggtgtatggaatgaggtttactagaaaggctgtcttcttaagtacaataatctttccttaaaagacttccctcctcccatcacttttcttttacttcttcttatattcatttcaaggcagaaatattctacctgataattctggaagagcccagccacagccatttctgaatgctggaaactcaggcagtagctccatcattgtcagcccaccctctgtctaaccacacacacagatgcacacacacaccactgtaaccttactaaaacctcctgggacgcattaagatctcccaactagaacactttgggctcaaactattgggctggcctctggcaaaattacaaaattacttgaacccagccagacgtggtggctcacgcctgtaatcccagcactttgggaagccgaggcaggtggatcacaaggtcatgagatcgagaccatcctggctaacacagtgaaaccccatctctact

SEQ ID NO: 160933 - DNA, 279 bp, Homo sapiens
gcacaagtccacacagctagtaagagggcatacctgagattcaaactcaggtctcactctaagcaaattgttcttttcatttcaacatgctccttgtcaagatgtttgctctcgctggagaaggaatgggatggagatctccttaccatccactagaggaacagagtttttttttgttgtcgctatcatacccgttaattatgatgtagcaatagaaaacttttggaagctcttcttcttggacatcctttcttttcttttttttttttttttttgaga

SEQ ID NO: 160934 - DNA, 320 bp, Homo sapiens
ctttctgagtgtggatttgaactttgaattatttgattccagagcccaggttctcagaagtgcaaaaaacatggtattgcttcattcttcctgtaagaagctggattttgcaaaaacactttgatttgtacagcggtggttctcaaacttcagcatgtatcagactcacttggaagacctgatgaaacacaagttagggatgccctagctacagtatttctgattcagtaggtaagaagggcccacccttgagaaccactgatttagaacattatcctgtcttgattccttccccttctgcggagtgtgatagcttctga

SEQ ID NO: 160935 - DNA, 174 bp, Homo sapiens
tacatatatgttcccaagataaacaataactagtcctcaaatcaaaggacttcacagcaccactgtgacatatgtgacaacacatagttcatcctggattcttggtcattgggctggccatctgtgtttcctttggctttatccaaaggaaaaacaaacttctcatatctttat

SEQ ID NO: 160936 - DNA, 421 bp, Homo sapiens
ctccatttgcatttaaaatccttcagtcagtcaacaaatgttatttaatacctactatgtgctggaagtacatatatcaataatatataactcttgacttagaggaatctgaaattattcaagtctaggtcaacctactaattcctctatgaaaccttcccagagttctccaattgggaatgatcttttccattactgattttggatagtattttatcaacatctttattggaaagttataaccctctactttatgatttagttgtttataaacatgtcttgtctccagcactaaacaataatcttcttgtgggcaggatctatgtacaagtaaccttcctgacccctagatcaccctgtatatgaccacaataaattttagtttagtgaataaactttttaaaaaaatcaaatttaggaa

SEQ ID NO: 160937 - DNA, 314 bp, Homo sapiens
cctttctgcagagcagtgcctgggccccctcctgtatcatcagtggctctgtccaccttcctgcccgaggtcctggggtcaatgcagtgccaacacgccatccatgaccaatgcgagcaacctcactgctgtccacaaatgctcctgtgccaagccctgggcacaacgttgtccaaactctgctggctctgacatgcctgtggttccatggcatcaccaaaaacatcctgacttccttcctcctgagcatgggatggaggcaaaggcctgagcagcctcccgtgggtcacccaccacgcctgctgcgcccaccg

SEQ ID NO: 160938 - DNA, 530 bp, Homo sapiens
  misc_feature (12)..(12): n is a, c, g, or t
tatacatatacnactcgagtctcggtacctgtggtgtagcacaacacatatgaaatgtccatcagggaagctcattagagattcaatgctcagggttttgttgggtgctggtaggcaccctctgcctagtgggtgccaatgctatgcagtcccagaaggaaagcataaaccaaattgactgcacacattgcaaggcacagtgagctaccctgattgtttagggaaagtttcatgtggctgtagggaacagcttaccagtcaatgcccaaccttgcaggcctaccttctaaagatagtcatctctggcctgccatgtttactgttttctgcacagtcagccaccaaccttatgatgactgactatgcagaaaagaataagcagcatcatagctgatgccacaaaactctattcttttaaaggcaggtggttcagtgaatattgtggcaccgaggcatctgagaggaaggtgtgctcaggatatgaccattcatttctctggagcattaattctccctttgtgctacccaca

SEQ ID NO: 160939 - DNA, 333 bp, Homo sapiens
agaacgcgcaaatgtgaaattggcaagtcatattatacaattaatattttctgaaaggacttcaaagaccaagcaatgagcaaggtactaattagtatttgctttaaaccatctcccctcttcctagaaggcaaaatgcaaattctatgcatttttgtatccctaaccacgaaaattatttgcagaaattaaatacataaaatccactacagtcctttctctaatctttcaaaaataatttggccatacattccattcttcccttgtgtttttcaatctgttctggaagtcagataatttgacaaatgtaattcaaatgacagtttcctatgc

SEQ ID NO: 160940 - DNA, 339 bp, Homo sapiens
acctgagagaccgtgttgcaatggaaaggcatttcatgttcatgttgaagacatgatagtgttaagatggcagtattccccaaagcgatctatggatttaatgcaatccctatcagaattttaatgtcttttcttcagaaatggaaaagctgactcctctaattcatagggaactgtaagagggcctgaacagccaaaagaatcttgaaaaagcaaaacaaaactggaggactcaaacattcctaatttccaaatgtattgcaaagctatagtaatcgaaacagtgtggtattgctgtagagtagtaaacatatagaccactagtatagaatcaagagt

SEQ ID NO: 160941 - DNA, 480 bp, Homo sapiens
acctgagagaccgtgttgcaatggaaaggcatttcatgttcatgttgaagacatgatagtgttaagatggcagtattccccaaagcgatctatggatttaatgcaatccctatcagaattttaatgtcttttcttcagaaatggaaaagctgactcctctaattcatagggaactgtaagagggcctgaacagccaaaagaatcttgaaaaagcaaaacaaaactggaggactcaaacattcctaatttccaaatgtattgcaatggaacagaacagagacctcagaaataacaccacacatctacaaccatctgatcttcgacaaacctgacaaaaacaagcaatggggaaaggatactctatttaatggagctgggacgactggctagccatatacagagaacagaaactggaccccttccttaccaccttataaaaaattaactcaagatggattaaagacttaactgtccaatcca

SEQ ID NO: 160942 - DNA, 470 bp, Homo sapiens
ctagccacccacccatccacctgcccgtcatccatccatttacccatccatccactctatcagggcctgtaatggcatgtgccgaggggaaggaatgcatcatctcatccaggtcaacctcctgcctgagcaatgtccgcagctcctgaccggcctcccttaccctctcaggccctcctagcctgctccctctggcttcctgggtgacacttctgaacacacctgatccctgccaccctgcaccccagctcaaccctgcctatcatatatccatccacctgctcctctccccatcccattcatccatccttccacccactcaccctgttatctatccatccatccatcataaaccaatgtttggggggttctcttgtggacagttgtaggcagtgggacttacagttcagtttgggggatccaaaaaaccccagtgtggtttacacctaggctcttgggaaatgtttctg

SEQ ID NO: 160943 - DNA, 354 bp, Homo sapiens
catggaaacagcgatgacagcaaataaaaatcatgaagatttcaaaagatacaagaacaggtggttaagtagtaacttacgttgccaagaacactgaaatctaacagtatgcaatgaggcagaccccaataagcaggaagcgcactctagtcacagaatcttggaagactcagagactaagggcaccaggtgtccctaaaggctaaagtgctgatgggactaaaatagaatatattaatttctaagaagttaggcccctccaaaagttcacagatggaatttctaagtgtgagtagaacagcctgggttttacagccataaggcactgaaccagagacagagtcagagacagca

SEQ ID NO: 160944 - DNA, 573 bp, Homo sapiens
cccgggcacagtttggtgtttccatcccataggctgggagggttggggtgagcccaggcccgctgcatccctgatgttgagcgctgctgccaccttctgggcagggccggtattgccttgccttgccttgtacctgtgtggatggttggcacgaagacagtcaccacctgtcctccagaacctctggggctggtaggaaaggcgcagtgacagtgacaggacaacgatgaggaggcccaggggctgctggggtctggaggaggaagaggaggaagcttttgtaggattcaggaacagacttgttcctggagcatggttgtgggggctggggaatgggaagggcggctgacccaggctgcatggctgtgtgtgtatgtgtatgtgtgtgtatctgtgtgtctgtgaatctgtgtgtgtgtctgtgaatctgtgtgtgtctgtgtctgtgtatctgtatgtctgtgtgtctgtgtatctgtgtatgtctgtgtgtgtatgtgtgtgtgtctgtgtatctgtgtgtctgtgtgtgttctgtttgtgtatctgtgtgtgtctgtgtgtctgtgcatg

SEQ ID NO: 160945 - DNA, 255 bp, Homo sapiens
agccagccagcctttctcatcccttatttcctcagagaatatttctttacaaggttctgtacaagcatcctaagactgggaaatgcctccagcaactcaacaggaggcaatgagactaggcctgcttttctgaacaccatgactgaaattccacaaaagttaactaagcagttgcttttcccatgtgtgactcacaatcagataggtcaatcatttgtttctgataaattacgaccctgtgcaatcaggtcagac

SEQ ID NO: 160946 - DNA, 247 bp, Homo sapiens
caacagaagcctcagattcatggcaggctggtaccccaaggctcagaaaagctgcccaggaactaccagtcatactggattagaaaaagaggaaaaaaagaaaaaagaaaagctgcccagggcagatggagtctcagttacatgtgccccacttgcatctcagctgagggactccaaaaagcatcctaaggctgggcatggtggctcacgcctgtaatcccagcactttaagaaactgaggcaggag

SEQ ID NO: 160947 - DNA, 225 bp, Homo sapiens
cttttttgcccaagctggtttcaaactcctgggttcaagccatgcttccacctcggcctcccaaagtgctgggattacaggtgtgagccagtgcgcccagccatcaattaaatttcttctgagacataaaggcaacactcttcttgcttgggttggtactgtgttctgtccctgaccaggggtgtaaccctgggccatttcttaatctcattatgcttcctctcc

SEQ ID NO: 160948 - DNA, 382 bp, Homo sapiens
attcagttcaaaatcctgtcctgctcaagtgaatcctgcattccccatccacacgcactcaacaacaacaaaaggactagaaggatatgtgtcactggcaacactgatttctctgaatggtgcccttattagtggttttagctttcctttaattactttgcagttttggaattttctgcagtgtaggtattcattttataattaattcaaagttaaaaattactttatgaccaaagccagttacttttagctatggtatgcctcgctgtgtagtcttttcagtgaattcatctcaaggcaactagactgaactagactgaactaatcatagataaactgcagggattaaagtttacacaaaattgcacattgcttgtggaag

SEQ ID NO: 160949 - DNA, 468 bp, Homo sapiens
tgacagccttgcggcttcggtgatgtttatcgctgagttcattctcttcatcttacatttttgcctttgtcatgggaaatgtataatttgaaatgatacaaagtttgaaataaaaactgtgttccagtatgacttttccaaatgcttagaatgatgaaaaagagtactgtaatagtacataattactcattagtcacttattaattatgtgctgtatacctactctgtgcttggcattttgtttggttcttgtgatacaaagatttataagagaattactgctaatgagattcccctttggggatgaatagcaatgtttaaaactagctccagatgtgattagtgatataattgatgtatctggtgtgctgagattctaatcgattctgcttgggagagtgatttgaggaagactttactgagaaagtgatatttgaattaggtctaagaggatgaataaaagtttgt

SEQ ID NO: 160950 - DNA, 107 bp, Homo sapiens
atggtgaaagtcagtcaaggaaaggaagctcagcaaagaggatacaaaggatattttatttagcggagagcttctcctcctctcaagggccgtagacataaaaaagc

SEQ ID NO: 160951 - DNA, 587 bp, Homo sapiens
caaactgaggaacaaggagtttatgtaagttgcctaatgtcacatagctaggaaggagtcgagccaggactggaacccaacagtctggctttcatgtgcattcttaaccactgtgctatctggccaggtattctgaaggaagattaaaatgtatttaatagccagcagtaacagtaaccactagcagaccttctaccacgtgctgggcactgcgctgggcattttatataggtagactcatttaatcctgatgacaagtccagaaggcagatattagcctggaaaggaaactaaagttcagaaacttgcccaaggtcatacagtgagtaaggaggtacaccggcatactctaactcatgtcttcctgattcagaagaccatttgttcccactacataccactataatccaaatgtttcctatatctaaattacacagctttatagagtcttatttcattatgagcctatcagacaaatgaataaattaaaattctacatcttttgggggtttatatgcattataggaggatgttactgtgtactgttcaatagaaaagcaagaattgaaattataaagtatcatctc

SEQ ID NO: 160952 - DNA, 292 bp, Homo sapiens
gcaaaaacaacgacaacaacaaaatttaaaaaagaaaaaaagaaagacatgtgaatgaggctaaggcagatgctcctagtggaggtccacagagaaggcagcctactggagagtctgcccatgaaggagaaaagtgggcttgccctgcctgaggctgctgatggccaaagtcaaatatgcctgagcactcacctctcccttcccaagaaactgcctggtaacttcagagagcttgagatctttggaaggcagttttctcatgtgccagaaacttgtctaagcattctacagt

SEQ ID NO: 160953 - DNA, 292 bp, Homo sapiens
ctgtcttgctgattaatacatctctgatttttaataatcacattttttccttttatttctaataatcacatttttatcttttaaaagctgggatcaaggataatacaaatagaatttaattctgaacacatctcatactccaatacttgctctaaacatgactagaatagaaatcccccaaattgggtttctttgtattcttttattcctgacagccatcacaaaacttactttaaggtctcagaagggttggtcaacctcagctctaatgacattttgaggtacatattct

SEQ ID NO: 160954 - DNA, 165 bp, Homo sapiens
agaacattctacaactagcccggactccaaaaatgtcaatgtcatgaaagaaaaaaaggcaaaggagctattctggataaaaggacatcaaagagacatgccaagtgaatgaatgtggactgaatattagataatatgtttgtactgacattaaatttcgtgggt

SEQ ID NO: 160955 - DNA, 110 bp, Homo sapiens
ccaagcgctagcatgccttttgcctctgcatatctgtgcacactgtatgttgttcatgatagcttgtctacaacttgactaggttggagttctggtaatagtggcaatct

SEQ ID NO: 160956 - DNA, 152 bp, Homo sapiens
cagttaaatctgcctgagaaacgaaaccattttctcaagcagaattaaagtgtccttattagacatcatctgaaaagaaatcggagactacatcttagacaacttcccctacataaacacacacatacataatcatattggaaaacaaaata

SEQ ID NO: 160957 - DNA, 506 bp, Homo sapiens
ttggcgtgaggccaaccctacttttaactcatattgtacattgtttcctcctagaaaccaaccacaaacaaaaagggactgatcctaaatctgagactggtgaatacaccaattggcaggaaaaatacaggtgagatttttgggttttttgttggtagaaaaattactccaaccaccaagtcagatctgttaggcatgacagaagatgaaggccctattatgagatttacataccaaatcattattctacaacggcaaacaggtcatctaaatgcaactttcttagttatgagagttcccaataaccacaaacaaaataaagacaccagcaaaaatcacccagaagaactgatcctctcaatcactatatccaaagagaaataaaggtaaccagggactacattagagacagatgagatgccagatgtttggactcttctattttaacctttataataatccaaatactctgcccctcccccagatgtcatgaacctccctcctat

SEQ ID NO: 160958 - DNA, 308 bp, Homo sapiens
cctaattgccacacagaaaccgagcatcaatatgccaaccattcagccccaaaagcctagaaacaggatttatagcaaagtataaaaggctggtccacggatacctcataaatgagtctttaaccacagagcgcaactcacattgcaattgataccattagcaactgactgatcattatcgtatgctgagtactgtgcagagtagaaacaaaatataaagcgtgatcactgctattaagaacttactggccactagctgggtgtggtggtatgcacctgtagtctcagctactcgggtggctgaggcg

SEQ ID NO: 160959 - DNA, 248 bp, Homo sapiens
acttacatctttttatcaatgtgattctatctgctcagtatcttggaattcaaggacaaggtcctgtttgttttcccccgatacctatcatagtgcatcatccttaaacgtgaaacacgttttttggcgacgcacaaatctcaagagactgcagcagctcatgacagtgtccttggagcactacatcctcatgccttattgaaaaaagttttgaggtctgttaagtttagaaaaggcagcatatatta

SEQ ID NO: 160960 - DNA, 859 bp, Homo sapiens
gcctaatttggtttagatcgagtgccctttgggtcttgtgctgatcagctaacccataagggacctttctgagaccttctcccttcctctattgtcccagcctttgcctccaagggcagagctctgaaatagaagctacttaatgaccagacaataacatttgggcaggtttgagagcagagatgtttatcacatctctttccctcttctgcagctcttgtgtcttgggaaccagtaatgtctttagggtggtaatcctagcactaaataaggttagaatcaggaaaacaagcattttaaacccaatcagtcccccttggaaaaacttcctttttcaaaaacaaaagatctgaagggggctgttaaaattgtaccacatcttacctttcatgctaatgtcgaattaggccattagagggagaaagggagaactgagcatttggccctgagataaagttaaattcaattttcatcgtagaactgcattactgcattccgataaatactgaggtttatgcagcaaagtgatgggaaagccatttctcactaactctgcaatgtgtcattgaaaaaaaaccagtcccaaaagaataaaggctgctcatgttgtaaaggcttttcagaaggcttgctgcttaatctgaagggaaccagcctaaaccacaagtggccacttttctaaataccaaggaaatcacagccattaaactaatcttagggcaagaactatgtcttaattagctttgtatcttggtacctggccctgaccctcacatgtagtaaggtgttagtacctgtttggaagaataagtggatggaactgccaaccctggaaagatgaagaacggatatgactttc

SEQ ID NO: 160961 - DNA, 285 bp, Homo sapiens
gtcaagtaaatgtataccccagggtgcttgcagcctcataggtcagagactctcaaaacttcttcccccatttatttatttatttgtttgtttgtttgagacagagtctcgctctatcacccaggctggagtgcagtggtgcaatctcggctcactgcaacttccacctcctgggttcaagggattctcctgcttcagcctcccaagtagctgagattacaggtgtctgccaccaagcccggcaaatttttgtatttttagtagagacggagtttcaccatgttg

SEQ ID NO: 160962 - DNA, 289 bp, Homo sapiens
gaaaggcgggacatcttgaagcaagggcaggaagactccaagcgggagggagcatccaggccacagataggtgagacacaaatggttacatccttttgagtctctgattagcctttccaaaggaggcaatcagatatgcatctatctcagtgagcggaggggtgactttgaatagaatgggaggcaggtttgccctaagcagtttccagcttgagttttccttagtgatttggggggcccaaaatattttcccttcacattcaaaatgagaaacctcccagaggtattg

SEQ ID NO: 160963 - DNA, 409 bp, Homo sapiens
gcagaaaaaggcacaagatgataataaggaaattgttatgacatgttaataatgtggctactggccactgtggtttacagagggcatcagttaatttggtgtggtgactaagtggagatcagttaagagagtttccactttattttgaaagcttatcttccccataaaaatataaggcagttgaaccaaaaaataaaaataaaaagtcagtcctcagaaggaacactagtgaaaagctagcattgccaacaagggttaagccttctttagagtacagacatcatcacctaatcagatgatgtctttagatctaattcagtccctataagactgtctataagaacaagtaaaacaaaaatgaggatccagtaacaattaagccttgcctcacaaagtttattgatagctt

SEQ ID NO: 160964 - DNA, 272 bp, Homo sapiens
ctaattttttttctcctcttggggtttttctaaatgactggcaaatggaaaacctgaaagttacctgagacttctctgcatcgggcttgttggggtatactgttcttcttataatcaaccccagggactgacagatggacagttgttagagacaaagtcctcaatccaaggaggtcactcagggccaactttccttagtatatatcgttcattacattagttggttatattacctgtagtacaactcaagtacaatagctgcaggaggagac

SEQ ID NO: 160965 - DNA, 436 bp, Homo sapiens
atggtcttcagctttggaactttctagcaagatacctaggcccttcattgtgccatcaaaacccacgtcctttttcagctgctagaagaggagctgattctttctgctagactctttcctattctatgtcaggtccattcgcagccctggtaattgcacacactgcttcctccacccacaatactctcccctgctcttcctggtgagccactcctctttcaggaaccacttcaaatatcgcctcctctgtaaaggcagtcctattcagccttctgcaaaattcactcaacactgttgtgaatttctcagaggtcccttggcactatagttcatctctctagctagcatgccaccttgtgtagtagttttctacttctcagtgcttttcaggctcctctaaggagttcccccagcaacagggaagagttaactcaac

SEQ ID NO: 160966 - DNA, 138 bp, Homo sapiens
tctctcctgaagacaatgtatggttttttgctgtgaagatttaagccagaagcttcagttgtgcagaagccattttgtttatttcctagtcctcaaatctcttctcaggttgagattagaaaggcagaaacttctatg

SEQ ID NO: 160967 - DNA, 403 bp, Homo sapiens
ggaagcggagcttgcagtgagccgagatcgcgccactgcactccagcctgggtgacagagcgagattccatctcaaaaacgaagggcggttggggtggatgtttcccacagccacagaagaaagatacatcagttaatttctgtgtctcaaaatgctacaccaactgttcagcaatagaattttccctgtagtcaatattttacttcttccaacaacagtttacttggaaatatatccatattcatcaaaatataatggtatttttaaaaaaccattattttatatgccagagattctcaaagtgtggttcctccctttcttttcattttcattctcttaccagtgtacattggaacttcccagaggatacatgatgtgtgatgtcattatctctccgacagc

SEQ ID NO: 160968 - DNA, 219 bp, Homo sapiens
agaattagaggtctccacttccagttatttgagctacttaagattgcaaagacccaagacacattcagactcaggtggtctcagctaatggggcctttctgtaaggacacaaagagaagtgtgggagaaacaaaaagggtttcagcagcaacaatattcaggccttgagctggtaggttggttagctgggatactgcggtgattctgatggcacaattt

SEQ ID NO: 160969 - DNA, 327 bp, Homo sapiens
gaaaatttgaaagatggaaagatagccagtagagcagaagcaggcacagttatgctgcttgcatatggggataaggaaaagaaggaaccaatttggcaccaggctcagaaatgcttagtaccttggaagatgggagtgagatgtgaagagaaagcaatgaaactaatggccatttgtatatggaacatacctcctcattacataaacacacactgctccccaactcctgtacgtggctgaccagaggtttaacgtccagcaagaaatgggaagtttcttctctgcagaagttgaatggccccaagggaaagacctctgtattatggg

SEQ ID NO: 160970 - DNA, 171 bp, Homo sapiens
cctgcctcattctcccaaagtgttggggttacaggcataagccactgtgccctgccccaattttggccccagtttttaaaaagagatgaaattcatatgaactttaatgttggcaggaactatgctcatttcttgataatgttttaaactaaagtgttaagttagttctga

SEQ ID NO: 160971 - DNA, 234 bp, Homo sapiens
tagatttctaaaactaccaatttaaggaaatgaaataatattttagaaaatgttttgacatcttccacagagtatgaacaaacatggcctgcaagagcaaaacatctgtaaagaaaaacaggatataaggaaaatgcatgagatgaaaagggaagatgagtagaataagaaagtgttgatagaaaattgaaaatttaatagtggaaattaacgtttccattggagacaatagta

SEQ ID NO: 160972 - DNA, 393 bp, Homo sapiens
cccaagtatctgggattacaggcgccagccaccacacccagctaattttttgtatttttagtagagacggggtttcatcatgttggccaggctggtctctaactcctgacctcaggtgatccacccacctcggcctcccaaagtgcctggcttataggcatgagccaccgcgcctggccccaactctctttctcaatgtactcatattggccttactatttctcgactatgctctggttattttgcacttaatattctctgcctgaagctcttcctccaaatatacttacggatcatttctttcacatttgtgtccatctccttcttagttcttcgtagaccatccaaaataaagttactagaagagcactcttagtaactctctatgcccct

SEQ ID NO: 160973 - DNA, 420 bp, Homo sapiens
aggataacagctagagggaggtccccttcctagatctaagaaacggggacttaagagaatcatcaagacaatcacgtttgcaagatggataaactagcacctcagaccccagggaactctcagctttggctacagtcctgaaccgctgctccgctcgcctgtgctaggacagtcgccatgctaccttttgacctggcagagacccatgagcttcctgcaagttaagtgggccccacagggtggctaggcttgagctctctctgggatctcacccaggggaactggccaccatgcaaggttactctagcaaccagaggctgtgcagcagggatcagagtggctgaaccagagccacaaatccctattgggacctgtgaggtggagaggtctccacagaatttcagcaggaatctgcacgta

SEQ ID NO: 160974 - DNA, 242 bp, Homo sapiens
ataaatgggggcggaatagaggcaaatctactttaggtagataagagtggtcagggaagaactttctggggagacgacatttaaattaagaactgaagtacaagagccaaccacgaaaagacaaagatagaggatgggaatgcggggaaatccatccaggcagtgggaagggcaaaaggcctaaaagcaatgaaagagaaagtaaaggcagatctggaagagcataataaaaaaggggaatg

SEQ ID NO: 160975 - DNA, 142 bp, Homo sapiens
tatgagccactgcgcccggcctgaatctaataatttctaaaacttgacttgtatttatatattgtttgtttattttactttcctagtaattcatttttacggaatttttttcaaacatcaggttgtgacagatttaaacttt

SEQ ID NO: 160976 - DNA, 459 bp, Homo sapiens
gaattcatcacgcctatacatacgcaagggtgcatcaaggacctgtagcccgcgtacgtgtctttctgcagctccaccatcctgaggaagtggtggtcttcctgggccagtgtggttgagagcacagttcagttgacctgtgttcctcagctctaggctctgcaattctctcctgtgcggtccatcctgctttggtccattctatcagtgcaaggaggtctgatttcttttggctaagtcttggtttctttctacacacttgtccagagctcaagctttgaggtctgactcttcatcagttcgtatatatgaaagattcacaaattccagtttgtcttagtggaccaaaccacagggcagatcatcttgtgcttctaactggaagccctgtatctgcagcatctcacaccctcgtctccctggggggaaggaggagcctttctgtggaaggtttccatt

SEQ ID NO: 160977 - DNA, 125 bp, Homo sapiens
acatggcactggaggaggatggtagtgcccatggagtgctcctgctaaatagcaatgccatggatgtgacattacagcccactcctgctctgacataccgcaccacaggagggattttggacttc

SEQ ID NO: 160978 - DNA, 433 bp, Homo sapiens
atgaaaaattcatttacttgattgtggtgatggtttcaagggtgtataaacatgtcaaaacttatcacattaggtacacttgaaatatgtgcagtttatcataagtcaagtatacctcaataaagctgttaaaaaataactgattgcttttgtaaggcagaaatatgagactaaggatattgtattacatcatgcattgtaatatttcattactgtgtggccctgcttaattattcatatactagttagaaaattttgtgatgtacagattatgggtgtacccttgatagctgcctgagtttgattttgtggtcagttctataaaattttgtatatcagttccatggccaggaacataatcctttattaatatattgtttctgtgggaaatcagaattggcttatgtgatatttacatagttccctccttctg

SEQ ID NO: 160979 - DNA, 691 bp, Homo sapiens
catctgaccatgacaaggtagcttgtaccaactaactgtcactaaaaatgattataaggctggtttgagatatataaaaacaactgcttgaaggcattgaagggcaactaaaacagtccttaaaagaacagaagggcacagccaaaccatatcaagtacatatttgcattcagagagactctctcaggaaaaagagaacagaacaaaagggtaaaaagaaaaagggtatagctctcctactgaagcctcataggcttaagataactgaaattaagagagaggcatagaagcaagaaagcaaagaaatatagaaaatttaagaagtatctagaaaagaactccatgttgtagctattgctacttgtagctgattgaaatcaaacagattagaaaccaactaagttcttgaaagaactcaacatcaagagaaatctcagtctggattaaaagagactgttgctgcttaagacttaaaacaacccttgggccctcaactatctacaggcaggaagtgggtgagaaagttttaaaattgctaaggatggcttgtgcctgtaatcctagctgctcacgaggttgaggcaggaggaccgctcacttgaggccaggagttcaagaccagcctgggcaacatggcaagatcccatctcttaaaaaattgctgaggaaaatataatctctaatatccact

SEQ ID NO: 160980 - DNA, 356 bp, Homo sapiens
agaagaggcatttcttgtgggttgtattctcttggtggggctactctattcaaggtcaaaaactagatttcgtcagaacattcaagcctctgtagcaggccaaaaagtgtcctcccaaaattcacgttcacccagaatctcagaacaagaccttgtttggaaacagggtctttgcaggctctcagaaacagactcgtatggactgaattcagaagagattgcaggtggcagacactggcaggacatgagacccacttcctgcttctttactaacagacccagtttttttcaacatggtcataagtcaagcacaaacaatggctcacgattggtttaggtcattcatgatcattctg

SEQ ID NO: 160981 - DNA, 682 bp, Homo sapiens
ggtatgttgccattgtgggaggggtgttctgcggtgtagatgagattttctcagctttccctgacctttcgtgggtcagtaaaatcagctaccatttgtccatttgttttgcggtttccacatttctgttgctgttgactcttttacccttgtcaatttctttgttcttgtccattgatatttcttttttatttatttattttttgagacggagtctcgctctgttgcccaggctggagggcaatggcaagatctcgcctcactgcaacttctgcctcccaggttgaagcgattctcccacctcagcctcctgagtacctgggattacaggtgctcaccactacgcccacctaatttttgtgtttttgtagaaatgggtttcatcatgttagctaggctggtcttgaactcctgacctcaagtgatccacccacctcagcctcccagcgtgctgggattacaggcatgagccgccacgcccagctcattgatatcttttaagaaaacacaaacctttctgtgacttgaggtgcggtttcgggagagcgtggtggtaaatgtgtgtctgctatctgtgcccaaaacagatgagcagaggaaaataaagtgtccttttgtaaaattaggtcatgacacaggacagccagactcagtcacccttagtgtccctctcaccattcta

SEQ ID NO: 160982 - DNA, 228 bp, Homo sapiens
aagttaattgttgctcaagatctgattccacagcaacatctttggtagctttgccctccttgccatccctgatcccattgctatggttgaggaactcatcatgccttacacctacattcactccagagactttcagatgctctttcaacaccaatttttcctgacaccacataattatgcttattactactaaatctgtcctaaaaaactgatataatcatgagtcga

SEQ ID NO: 160983 - DNA, 558 bp, Homo sapiens
ctagctgactctagaggatacaactccataatgtgagcccagcagagtgattaaagctgagtcacaggggcagctgtgagggagacagaacgatgctcatgctttggattggcaggaaagagaactatggcgcaaaccagcattatctttgaccattggcttaattttcagtgttttatagtgataacaaccatgatttagttcagaaaacagaaaccacactacatacttcaagaggaaggaagttaagtataagaattaggtatttgtgaaatcattgtcagggctgaagaagcaagctggaggttgggctttaaggactgactctggggtcactgcagaactgacccatctgaggagttactgtgtctgcctctatctggaagaggtgcaagcaggggggagtccactgcacaacagttgcgctctgtagttggtgctgaagtgctaagtttggccatcattacaatagctctagatacctacgagggagaagcatggatacggttgttaccatgactttgcttatcattagaaaatagtactaggaggaggatg

SEQ ID NO: 160984 - DNA, 277 bp, Homo sapiens
gcatctctctatcattatctctctatccttattctctctatccttatctctctattcttaatctaatagtactagaagacaaattttttgcttcaaatgcttctcagttaactggtcctttataggttcagtttacctacagacatgaaactgtggtctcaaaaacgaagtctcaaaatacaaattaaaaagcaaaaccaaaaacctgcaaaaccattcctaactattgaaattgggtaatggatgcatggaagcttgttaaaatatttcattacat

SEQ ID NO: 160985 - DNA, 289 bp, Homo sapiens
gccaacttacacctagcttggctgaagtagtaggacttgtttacaactactctggaggttgggctccatactctggagtttaccatagacagagaaactcaggctcacgagataacaaccgtgttataagggcagcccaagctccgttcctctacctttgggtcctctaccttctccagcttctccaggatgtgacagctgtctcagtcctttaccaaccatcttgctctctaaggaggcaccatggcccagtgttccccctcattctttctcccttcacaagagatgg

SEQ ID NO: 160986 - DNA, 255 bp, Homo sapiens
agtgagaccctgtctctaaacaaaaacgaagcatgtccatagaaagaaactgaaaaatgttagcattaagaacccagatggagacctttcttttggtcaagattataatttagaaattttgagatggggtgtggtgaggaaagtgaggaagcttaactgcttggttctttcatctctgaaatttaggcagtgacattatttatttagagtgagataaattgtgatggctcaaagagaatgaaaaatccctataat

SEQ ID NO: 160987 - DNA, 429 bp, Homo sapiens
ggcgttcagaggtccccttatgtcgacccaccagattgaagttgttttagattatacagtagttaggctatactactacttaataaatttgttttccccaacttggcttcttgcctgttcttaaagcagccttcttttctttgaacttaggaagaaaactgaataaaataaaattattattaaccaacattatatattaagctcataagtttaacattctagtttacagttcctaaaatgatagaatatgaatcatatgggccttaaataagttatctggtctacttaagttttgtaaatatttatttctgcataaaataggatagtatgttgtcatgtctgaatttatcctaagtttcttgatagtagagcagactctatccagtgaagggaggaggggcagaacataaggggtagcgaggacgaata

SEQ ID NO: 160988 - DNA, 659 bp, Homo sapiens
ttctgcacggtgcctcagcactccccaaaacatcccattttgcaggtgtggaaacccacgtcccgcagaggctgggtgtttgctccactcagttctggggacttagcttgaggctctctgatctgttctcctgctgagcaccccaggaagggctccaggtctcccagccacttagtgagagtggcaagtcctgtctcacttgatctttgggagcataagacgagatcacagaaaatgtcatcaatgtgaaagtgttttgtaaacgaaggcgctgctcaaacgtagtgttatcttcagcctggctactggcttcctacaaagtgtgaagggatgaaggtaaaagctctttcttgaataatgttatccatcaagacagatgaaaccacactggtcagctcctcctgccctccccccaacgccccacctccccttcattcccacatgtttaaagacattcgtaggctgagaaatgattcctgctgctcctctgacacccggaatgtgccttgtgattggcagagtgtccctccagaatagcttaattttttccccatttcttgactaatgtcctctactccttggccctgtaattgagaattgggcttgcaatggccagcacacgagcatcttccctgaaagctcagaaatgatggctctcc

SEQ ID NO: 160989 - DNA, 422 bp, Homo sapiens
cgccttcgtttacaaaacactttcacattgggcgctgctcaaacgtagtgttatcttcagcctggctactggcttcctacaaagtgtgaagggatgaaggtaaaagctctttcttgaataatgttatccatcaagacagatgaaaccacactggtcagctcctcctgccctccccccaacgccccacctccccttcattcccacatgtttaaagacattcgtaggctgagaaatgattcctgctgctcctctgacacccggaatgtgccttgtgattggcagagtgtccctccagaatagcttaattttttccccatttcttgactaatgtcctctactccttggccctgtaattgagaattgggcttgcaatggccagcacacgagcatcttccctgaaagctcagaaatgatggctctcc

SEQ ID NO: 160990 - DNA, 633 bp, Homo sapiens
tgcttctcttaccatactcctgtggcctaccgctcacaagaagtaaaaacttgtcacctagccaaggtgttcttaaattataaaggcaaacatttttaagctttacaaattgaggcaatacaactcttctgagttcttcttaaaaacgaacaaacagaactgctatacaataaaagccagccattctagagacggaagaaacagaaagggttgaaaaacaaacatgcaaaagaaggattaaagaaatttggactattgtgcgccaaataaaagaaaacacttctactgtaaaagatttccacatactacactgatattgatgcaacacactgcctatgtataaagtctacagtaaaatattacatgaaaagagatgcttggtgataattaaatcaaataaatgtggttaacacgatactcttatcactaacatgtcataatactatgtaaatgtctactctatatagttatcatacaccttcactgcctgaggatttggcaacaacctaactgaaaatcccagagttggtgtttgaaccaccagccagctctgtcctgagaccactggattaatgtttatgcagatgttaggcccaggaacatcacaatgatgactagagcaaggaggagaaa

SEQ ID NO: 160991 - DNA, 534 bp, Homo sapiens
atgggggtgagaagaactaggtggggcgtcttggagctggaatttggttaaagatgagggtgtggtctatgcttagtatgtgaataagggattttccttctttttcaggagtgtaaagatagtatgtgttctaagcacgagcgtggtggctcacgcctataatcccagcactttggaaggcagaggtgggtggatcacttgaggctacgagttggagatcagcttggccaacatggtgaaaccccatctctactaaaaatactaaaattagccagacatggtggtgcagacctggaatcccagctactcgggaggccaaggcatgagaatcgcttgaacctgggaggtggaggttgcagtgagccaagatcgcaccactgcactctagcctggggcgacagagtgagactctgtcaaaaaaaaaaaaaagatagtatctgttctaagttggaatttgaatgtggaatgtctattttagatttgtatttcaatgagggatgctggctctaaatttggatccaatcttatgtgggt

SEQ ID NO: 160992 - DNA, 279 bp, Homo sapiens
tctggtgacattttcttttcacttaccaattcctcccaaattttcttttcattcttagccaattttgtcttttggagccactaattggtctctgtgctacattttccaagatgattttctatttatttacctgttctttctacataaagctcaattatttctgataattcctattttaatatttgctgagtacaaacagagctcaagacaccaataacttggctgtctcctaagtctccattttatttaaaaatgagttcctgtgtggcccttatccca

SEQ ID NO: 160993 - DNA, 772 bp, Homo sapiens
aatcccagcactttgggaggtcaaggcgggtggatcacttgaagcctggagttcgagaccagcctggccaacatggtgaaaccctgtctctagtaaaaatacaaatattagccaggtgtgggggtgggtgcctgtaatccccactacttgggaggctgaggcaggagaattgcttgaacatagcaggcagaggttgcagtgagtcgacattctgccactgcactccagcctgagcgacaaagcaatattccatctcaaaaagcaaaacaaaacaaaaataatacaccacaataaagtgagatttatcccacttatgcaaggatggttcaacatacagaaatcaataaatgtgatacatcacattaatagaatgaaggacaaaaaccatatgatcagatataagcaattagtaaactgatgcagaaaaagcatttgataaaacacgacattccttcctgaaaaaaaactgtcaacaaaccagacagaagggacatacctcaacataatcaagaccatatatgacaaacccacagctgacatcatcctgaatggggaaaagctgaaagcctttcctctaagaactggaacaagacaaggatgcccacttttaccactcctatgcaacataatattggaagtcctggccagagcaatcaggcaagagaaagaaataaaaagcatcccaactggcaaagaggaactcaaattgtccctttttgctgatgatatgatcctgtatctagaaagactccatcaaaaaactattagatct

SEQ ID NO: 160994 - DNA, 203 bp, Homo sapiens
taaaaagcccatctccttccttcactggtctgtaggcctttaggagagaaccatgctgtgtttttgccaaacatcaattagggacccagcacaaggtcccttgtgaccaggagaagaggtgacttttggaggctgccctcagaacatctttacacttggtagaatgtactcatcaaatgcccccggagggtgccattcaggct

SEQ ID NO: 160995 - DNA, 643 bp, Homo sapiens
gctgcctgggttactttccagcatcactaccaatataaggattgggaatcagggtgtggagagagatcttctctattcactcacctaacaagtatttactaaacaactataggttggcacaaaagtaattgaggcttttgtcattgcttttaatggcaaaagctgcaattatttttgcaccaacataatactattgtgttaggtcctgtgctaggtactagatacacctatgatctctgctcacataaagctttcagtccagtgggacaacagagatcaaatcaatgacaacaaacaaataaattcaagttgtgatcaatattttacagaaaaagaaaaaaggatatgagagagccctgaactctccagtatttccttctttaatgttatatgataataaacttttcacattgctctttatattaatatacagtcaattgtttacgatgctaaaactctttgaaaagtagagatttcaggggaagtcataaaaacaagtaagttaaggcacacagtgtcatttactcactttactctcacttgcttggatgctctagagttcatgtactagttggtcagcacatatacttacctcacatccatgccttattcagttcttccttagctccttgtcccaacctct

SEQ ID NO: 160996 - DNA, 152 bp, Homo sapiens
tttcagtcattcaagtgcgacaaagacttttaactctattttttcttttgtgggcctgtctttctataatgctcttcagtccaatccctacaactttatggcaaaattctgttcaccatccaatatatttcagttaagattcttagcttgta

SEQ ID NO: 160997 - DNA, 556 bp, Homo sapiens
agaatcccggtcaaacacgtcaaacatgtgattatagttcagcaggcatcagccccaaaggcctaagacctgtgacatatcaggaaagtgagttaaacaaaaatgttcctcaagtacaaaatacaaggagaggcactcgggaggttaggtgcacccggaggtagaagactctcaggcctgggatgagaatccgccaaggaaggaggtgagatgtatgatgctagcctccagccagtgctcaagacatcctcagcatctccatcactaccacttaccactatttcctcagaccagcgatatcagctccaccaagcactcctttctcaaatgtttttttcctggagtacctctcatatgccaggtattgaatcaagcacagagggcacaatgacaaacaagagtggttggttcttgctatcaagtgggaggcagagcagtgaacacttaaacattgtatgcagcaggcagtctgtggtgagggccagattcacgggtgtgtgaactctttagtcacccagagccctgcactcagagggcccgtgtttggtttgatggg

SEQ ID NO: 160998 - DNA, 678 bp, Homo sapiens
gcctcagcctctgaatagctgggattataggtgcccaccaccaggctgggctaatttttgtatttttagctgaaacccagtctctactaaaatacgaaaattagctgggtgtggtggtgtgtgcctgtagtcccagctacttgggaggcagaggtgagagaatcgcttgaacctggaggcagaggttgcagtgagcagagattgcaccattgcactccagcctgggcaacagagcgagactccgtcttaaaaaacaaaacaaaaactttcccatcttaaaataaatgagattgtgtttactttgcagtaattcatcaagctctactcttaggatggtcacttttctgtgttacttggattttaaaatgctttaaagaattgaatggtttgggcaaaatagtttaggctctatctttaactctgaatctatttatctttctaattttgaactccttttaatgtttttcttctgggacttaccacgattaaaagttagcatttttgttttgttttactttttggtttttcagctaggcttctgacagtattgcacatttacataaaagtgtaattatgcctttgcttaagatttgtttttatttcagttaattcgtcagtgaagaaaaatacattttatgctctactcccaactaagatgaactgtcttacagatggctt

SEQ ID NO: 160999 - DNA, 371 bp, Homo sapiens
atataccctaaagtatcccatggttatgaggtaccaagataggaactgactcttaaatgcctcaggaaaagaagaattctttgtacttgtaacttttctataagtttgagattgtttacaaaaaggaaggatgagaatagctgaaggttctagaatcctaatccctgggttaaaatcatggctctaccacttattacttccttgtgtctcagtttccccatctgtaaaattaggataacagtagtactgtacaagcttgtgtgaagtttaagtaagttaaaaaaaaatgctaagagcactgcctgcaatagatattcgctattatgtcatttgagtttgatacttttacctttctgggataaagtggccaa

SEQ ID NO: 161000 - DNA, 240 bp, Homo sapiens
gacctccccaccaccaggactggaggaaggggtggctctaggggactatgggagtaggccagtgtcccagcaaaggggacaaagatgggagaggggctaggggcacaaggctggaacccagtcatctgttcatagctgtgtgggctgatgagggaggccccagtcagcaggaggggaggggagaccttggggccacaggacggggcctggcccatcccagcttccagacctcagcaatct

SEQ ID NO: 161001 - DNA, 422 bp, Homo sapiens
taattccagcactttgggagaccaaggcgggtggatcaacttgaggccaggagctcaagccagcctggccaacatggcgaaaccccgtctctacaaaaattagccaggtgtggtggcgcacacctgtaatcacttgaatctaggatgtgaaggctgcagtgacctgagattgtgccactgcactccagcctgagcgacacagtgagtctcaaaaaaataaaataaaaaataaaaaataaaaagattatctaatacgtagaagacttcagctttgcagcaatacagtaggaaccctttaaagtaaacaggtgtttttttgatattatgaatattatttctcttttctacggttttactattttttaaattgagcattttaaaggcaagtaaaaccattttatttttttaaaggagagactctg

SEQ ID NO: 161002 - DNA, 3533 bp, Homo sapiens
  misc_feature (167)..(167): n is a, c, g, or t
  misc_feature (190)..(190): n is a, c, g, or t
  misc_feature (264)..(264): n is a, c, g, or t
  misc_feature (903)..(903): n is a, c, g, or t
  misc_feature (919)..(919): n is a, c, g, or t
  misc_feature (991)..(991): n is a, c, g, or t
  misc_feature (994)..(994): n is a, c, g, or t
  misc_feature (1336)..(1336): n is a, c, g, or t
  misc_feature (1582)..(1582): n is a, c, g, or t
  misc_feature (1595)..(1595): n is a, c, g, or t
  misc_feature (1633)..(1633): n is a, c, g, or t
  misc_feature (1650)..(1650): n is a, c, g, or t
  misc_feature (1843)..(1843): n is a, c, g, or t
  misc_feature (1939)..(1939): n is a, c, g, or t
  misc_feature (2121)..(2121): n is a, c, g, or t
  misc_feature (2168)..(2168): n is a, c, g, or t
  misc_feature (2188)..(2188): n is a, c, g, or t
  misc_feature (2419)..(2419): n is a, c, g, or t
  misc_feature (2536)..(2536): n is a, c, g, or t
  misc_feature (2679)..(2679): n is a, c, g, or t
  misc_feature (3173)..(3173): n is a, c, g, or t
  misc_feature (3221)..(3221): n is a, c, g, or t
  misc_feature (3228)..(3228): n is a, c, g, or t
  misc_feature (3243)..(3243): n is a, c, g, or t
  misc_feature (3273)..(3273): n is a, c, g, or t
  misc_feature (3374)..(3374): n is a, c, g, or t
  misc_feature (3391)..(3391): n is a, c, g, or t
gacagagtctggctctgtcacccaggctggatttcggtggcacgatctcggctcactgcaagctccgcctcccgggttcacgccattctcctgcctcagcctctacgagtggctgggactacaggcgcccgccactacgccccgctaattttttgtatttttggtanagaggggtttcatcgtggtctanatcgcctgacctcgtgatccacccacctcggcctcccaaagtgctgggattacaagcgttagccaccgcacctngcctctggacagtgtttttcacaggtcagattaatttttatataaatcatttattttatttttattatgtaaaattttataatttttaattttatttttaatttcctttttaaaagttaaataaaattttaagtgtaatgatgcaaaattttgtttaaaagtaaatgtatataaaaatgttgatatagactaaaaaattgaataagtaagaaggtagttagttgtcacagtaggagtgaagtgaaaagcttcccctttcaccctctgaagattaccggaaatgaactgaccatacacagattaataaaagaaagggtatacaaacttacataacctgcaaaaacatgagagctatacacaaagtataagacttgaagatggctcagatcttaaacgctctcctcataggcaatagatatatagacccaggatgcagacattattttgtaaataatttcctttggaagctggatgggacagacaaattacaggaaggtgagagatggaactgcacaggaaaaaagtttgtctttgtcactttaatcttatcattactagagaatatttatgaatattttagaataatatatttttaagcccaaatctcaccaaatgttttttctaaaacaaatacttttngttgttgtttgttttngttactgtgtctcactctgtcacccaggtatggagtgcagtggtgcaaccatggctcactgcagccttcacntcntgggctcaagtgattctcctacctcagccttccaagtagctgggctacaggcatgcaccctcatgccctggtaattaaagaaaaaaatttcgttagagaccaagtctcattatgtcaccctggctagtcttgaactcctggaatcaactgatcctcatgccttggcttcccaaattattgggattataggtgtgagccacagtgactgaccacatatttctatacttcactgaggaaaggaaggtgctaggaaaattggttaagaactattttttaaaaagctattagtagtgttttattttattttttaatgattgatttttgagattgggatctcactangttgcccaggctggtttcacattcccaagtttaagcaatacccctgcctcagtctcccaagtagctgggatgacaggtgtgtgtcaccatacccagctccattagtagcgtttttaacaattgtgggccactgagtaagaataattttttttaaattaaaggttattttttaaaaagcacatttgtagaaaattactagcataatctgcctaaaataaatatacatattgaaaaaatctttgctcngaacaaaaagaantatattcaccacacatacatacatacacacacacacangcacacacgcacacacncacacacacacacacattatggaagatttcaagaccaggcaataatttccactcaatccaaaaacaatgcaatcccagagctgaatatttaggtgaaaatatatcaggaatgggaggcattcaggtttaattttcatgttttggtagagttaggatgtgagttttcatttaaaaatattctttattttttttntactattgtggtttctgtattgttactatacaatctgtaaactaaatagtaaaggagagaaaagtgattttcaaagaagctggcttgggaacaggnactattctgggaagatgaaaggtttcacttaatgactggtacctgtgccactctggttattttaactgttaaccttttagcaagaggtttttcttttaaaagacatcctttaatatttgggaagctagtgcaatagtacacattgaggcccacataccacatgccaaatatttaaaaggcanatttctagctaaccactgtacatacatatattttttcttattttctnattttagtttttttccttgncaacaatttatgtccacacatatcttctatcatcccactttgacaagtaatattataccttcaaaatgatgtggaagactagattggaatttagaaccgtagaaccttgtaattgtacaggcaagtttcttcctgggaaaaaataaaacaggaagaaaaggctgggcagcctctggttcaggaaggaaattcaggagtcccttatagcagcatctctagtacttgggaacngaacagacttctcggcctgtgaggctggaatgggcccttctggagaacacgacagagaagttatctactgcctttgcccccagggcccaggcaacacttttaccctccattgtttcngaagttaaggggaggagacaatgttttgtttagtgacctcgacagaaaaagtgtcctcctgcaaccactcatttgttactttccttcttcctgaattgcctggacccactcctcctccatttgactggctctgtgcactgatnttatagtcaggagatttttgggaattgtggcttctaaaaatgtacacccgactctacccatagctggccctgtgaacctacacacctgctccactgtgtatccttctcaaagagacactcttcctgctgagtctctgccctctgctcctagatccaaatggcatctcctaccctatccctgtatggtttaacctagggaaactctttcccagaggagtcaggtaaggagacagtggctgagcttcttacagacttaaaggagacatcctggaatttaggagtcagtccttcctttctgtaatccctggcagctcctgctgctgctcaaagtttagctttgtctctcatccagctcagacttttgctggtcctgatggcctctgcttagctgtattagtacgctcttgcattcctataaagaaatacatgagaaatacctttagttggctcacagttccataggctatacaggaagcatggtggtttctgcttcnggggaggcctcaggaaacttttactcaaggtgcagggcaaaaaaaaanaaaaaanaacaaaaaaaaaaanctaccagcactgcactgtgaggccctgatncctgagctaacttcatattattacctctacagcaagtgtccgtgagaacatagatatatttcttatgtgagtacacaatttacagaagaggaactaccctnccaaaccaaaacaaaangtcaaaaattagcttggtgtagtggtgtgcacctgcggtcctagctactcgggaggctgagggaggaggatcgattaagcccaggaacttgaggttgaagtgagctctgattgtgccactgcactcagccaaggtgacaaaa

SEQ ID NO: 161003 - DNA, 212 bp, Homo sapiens
gcaagcggcctaacacctctcaggagaccacagtggaccaaagttgggaagcagaccagactagatggagacgaacaaccactccgaccttttcaatctccaactatattgacctgacgcctcacctcctcacatgcagactcaccaaacatctattaggctatggtttactgtcacctgtgcaacccccacccttcccaggctgtgtcctt

SEQ ID NO: 161004 - DNA, 623 bp, Homo sapiens
tccacaggggataatgaaaacatacatcactcgtaaccttttaggccaactgggctattgaacttaacaggagcataatggctttcctggtgtcagaaattctccacccctgcctacaggtagttcatcaaattgctccgtgcttattgcttcaatctgcattgagctttaatacgccctaaaagcctgaatcccttccctcagaactttcaagcctcagaaaattgttgtgcctgtctgctgtactcactaaatgacaaagaccctgaaagttgaaaataaagcctgttacactatagaaggaaaaaaaaaaaaaagacagaagggaaggcatgttaaaaataaacagtttcaaagatttcatgaaaaaaaagtcaatgcaatttgcaacttcatttgttccagtgacaagctgataaaatgttggtggtacaaatgcatcagaaaatttgacacaaattgaaagtgactacacattctattatccccaattcccttggtcatggaaaatgattgttaaagacagtttctaatatgtcttagaagcatgaggctgtctatgggaaataataccctcgattatcaggaaagataagcattctaaaggaagcaagggctacagt

SEQ ID NO: 161005 - DNA, 642 bp, Homo sapiens
ctacctggataaagtgaggatctcatttaacttgcagcataattacagtatacctttaaatttctcttttcacatactttcacataatatgtaataaatgtgaacaagtgaacaaataactgttttctatacagttaatggcatcaaaatctacccagtcactcagtaaaaaaccagtaactacacagaaaaatgttgcaagatctcatttatagagatagagatgggaggagatgtagatcaaaggatacaaagtagcaaatatacaggcagaacaagtcaaaagatccaatgtactctacatacactatgaggactatagttaataacaatgtgttgtattcagagtttttgctaaactagtaaattatagctgttcttgccatgaggagtaaaaacgtaaaaatgggtaactacatgagataaagaatatgttaattttttccacaatagtaaccattttactatatatatttatatcttataacatcatgttatataccttaaatacacataaaatatattaaaacaaaacaaaaggaaatccaagagttatctttcattccttcttcctccataataacgtaccacactcttgattgtacttctaaaatttctgtcatatttgtcctttttcatccc

SEQ ID NO: 161006 - DNA, 592 bp, Homo sapiens
gttcaagcgattctctcctgcctcagcctcctgagtagctgggattatgggcgtgtgccagtacccctggctaatttttgtatttttagtagagatggtgtttctccatgttggacaggctggtcttgaactgctgacctcaggtgatccgcccacctcggcctcccaaagtgttaggattacaggcgtgagccaccgcacccagcctcatcctcttactgatggatgtttgggttatttctactatgtggcttttgtaagcagtgttgctatcttatacatgtttttaactacacatgtacacaccatttctcttggatatacagttggcccttcatatgtgtgggtttcacctccatggattcaacctattttggatcaaaaatattgggaaaaaaatgaaaggttgcatctgtactgagcatgtacattttttgtcattattccctaaacaatacagtataacaactatttacatagcttttacattgcattagatattataagtaatctagagaggattcaaagtatataggagaatgtgtgtagattacatgctaatactacactattttatgtaaatgacttgagc

SEQ ID NO: 161007 - DNA, 695 bp, Homo sapiens
cggttagtagagtgtctgacacaataaatgtttgttgaactaagatgaacggccacagaaaaattattcccccaggtgaaaaccagaaggtgtgcccaatttaccagtgatcccttttgttgaaatcatttgatttattaaataagattcttctttatcccattatacttttcctcatctctctgctatcttttccctacacagtgggtgaacagtaggtattcattcagtaattcttgaataaaccagcaacaaactaaaagcaaatagaaaactactagtagaacacataggtatagttcagtttttggttttgggttttttttctgtgtgtagtacatgtctggactttcaatcctctatccccactccatcattcgattagaataaaatcactcctctagaactgtatagttctttctggctgggtctcttatcaaggtgggaaatttgtggtgaaaatgctctttccaacactctaagcctatttcctgactccccttagttttatatgcaaaataatctgaaattctctttgttagatctttaattttggtcagctatacaggattcaaatcctagctgttcatatgaatcacctctaaaactttgcaaaagtacaaatccaaagcctcaccccaacttcactcagttatctgaggagatggagactaagaatccgtatttttcataag

SEQ ID NO: 161008 - DNA, 538 bp, Homo sapiens
gaggccacggcagccatggagaagtgcgggcctggctccaggtggcacagaggcactggagaggccccggggaagcctggcgcgatctggctggtcctgcgctctgcttccaggttctggccctgtaacctgggggacagggccggccaaaacagggccactgggtgctagccagcacctgggccaggcgccaggtggaagggctctggcggatcagcctcgcacccccaacagccccacaggggggcccatccagggccacacacttgcccccaggagcaggatatccctgaggctagagtccagctggaccggtggaagggtctcaccctttgccctttgactcctcttgtaggcaccctctccgcttctgacccttagtttcgtctgtgcacaactcactcaaaatgggcaactcgctaagcgtattttgttcctggttctgccgcaggtcctggccatgccatcggcaacctgctcgtcttgtccgtgaggccttcccagctggccgggctcaccctgcagctcctgcacctgt

SEQ ID NO: 161009 - DNA, 540 bp, Homo sapiens
tgagactaatcctgagttcggcagccccaggcacttgccctcagacaggctctgagtatgtttgtagcaaagtgaccctcgggtcaccatcacctttttcattcttccttatgctcggagatagtcatctgactttgcatgtgcctaaaatcagtttagcctgatgcatttcatttcaagaaggcacaaagataggaaacctgaagccatagtattttgcttctttcctggcttagagaatgcgtcaagggaaggggccttctggtctaccaattctgcccttgttctttttttctaaaacatttcctttctcacagtgggagacagtctttgaaaacccaggtttccagacatggaagagagaaaccaagtattggaaatcatttcctactgcccagtttccccaattctcctccttcatgtttttttattcagagtcaagactgctggacttcctggtgctgttttgatctggtggaagagagagttgcaatatgactgtttgcttgttaaggagttggcagtagtcataccactcag

SEQ ID NO: 161010 - DNA, 481 bp, Homo sapiens
gtagaatctcagggcttaaagtctttaggtcaatcctcttatttaaagattaagcccagagaggtcagctggcttggagaaggtcacccagagagttggtgccagagccaggaacagcatctcgtgtcctgaggccccgtccccttctttccagtgcctccctcgcggttgttctccagtcattttgtggaggtcaatcttctgagtctcgtaggaccagttagcggagcatttgaatccccacacagtactcagcagagcattagagacataggcattattaagaaatatgtgaagtgatgggtgaccgagtgagtgattgattggttgacttacgaccttggcacccatctttccacctaagtggttactggttgaatggtgagttctttgggattgtgtgtactttataggatatcttttggagaggagaggattataacaagaacaatagctaacattaaattggacaagatatttt

SEQ ID NO: 161011 - DNA, 221 bp, Homo sapiens
aatgcagcgggcatctgagtcttgggcagtcattgagggtaagcccttggggctagctagtgaggacctggcttgttgtagtaactcgtatcaagagcagtatttgtgtgtgtgtgtgtgtctatatgtatctagctgttctccccaaatactcccgacccttcctcccactggggccttcggtaaggggcctctacttacaggaagagctgaccagggca

SEQ ID NO: 161012 - DNA, 372 bp, Homo sapiens
ccgttcccctccccagcctcaaaaaagactgccaggaaattatgccagtaagctatcagggactggattaaggtagtggaattatgaaggatttttttcctatttaccaaatttggtaataggattacatttcttcaacaatgggggtaggaggaataagccattattaagtcagggaccagacccctggtctctcagaacctgggatacggcctagtacatgctgtctccctgactcatttatggcgaaattcacatcacactccttttatctgaatcagtgagggttgtgtcagcagctgagtccctggcatggatgtgctggaatccaggcctcccatcccccatccccggctcgcaggggcctcccct

SEQ ID NO: 161013 - DNA, 252 bp, Homo sapiens
cctgttccccctaaaaatccctgttcctcccaaagtgctaggattataggcatgagccactgcacctggcctattttgcctttgaaataactaattatcaaaccataagccaacctttcctgcttgaatgcaggttactcctttctgtttatatgaagccttttttcagcttaacacgtgttaaaagattttgctgccatgagaattgacagatttacaggagacaaaggttagatttgtactgggggaagg

SEQ ID NO: 161014 - DNA, 297 bp, Homo sapiens
cagtgattatatatgaagctgctttgtaaaccacagaatcctaatgtatcaagcacaaagccaaaaataattctggagtaagcagggcaggatgggaatgactgacagacactatcctaacaactctctgtacactggaaaagacatcagaagtttgatgttaaagaagtggactacatctgtagcagctaaaagaaataattccaagttgcaatttggagtcccaaggagcattagggtggtcagtaaaaagtctaaaaacaaactgttatatacaaatacaagttttggaaggtt

SEQ ID NO: 161015 - DNA, 504 bp, Homo sapiens
tatgtagtggaggattgtgagacctcacaagattgataaagtatcaaacaatgcctgtattttttaaaaggagctgtttttcaacatatagagaaataatgtcaattcctggattaatactcttttagaaaaggccaattttcattgatttcaagtagctcatgttattcagtaacaatctcagccttcaaaagtagccaaaagaaaagcagaataaatggtctcctaaataaaatgacctgtggggcccatcattgactaagtagcctttttactcatctcatacagcctcttcctaataaaaatgaagcagcatcgtgagaacggtagggagaaagggtgaacagacagaggtttacgggtcaggacagagtaccagggttaggacagataccaggaaagaggaaaagaacacactgtggaagaaacagggcaccagcttcacacttgtgcctcaggccagctttgtcaaagtgttctgagtacataacgtatcctctaaac

SEQ ID NO: 161016 - DNA, 424 bp, Homo sapiens
atacgcctagactgtggctatagaatcccctgaaaataacccacaagcaaacatgcttttgtctatgtgtgaactctctgtgtgagcaaagtactgtgcatgttctgcacagagatatgaattcttgcttcattctttcagcctgtgctgtatctgattttcctcacttcactgggcacccagcagtccagttacactgcacttgcactctacaatttgtctctaagagattccccaaatcacaaaatgtcttgtctgctgtccaacgtgctccctatatgcagaaaagatggtctgaaaaattgggttgtgcttagagccctgtggcttggcccacctctgccattgtgcaggagtggttttaaagataaatggctgcatgttaaccagatttgacatgctgtacaaaggcaggcacctttgg

SEQ ID NO: 161017 - DNA, 489 bp, Homo sapiens
ttcagaatattacaatggtgctgtttctgcgaatactgctttttcaagacgccttattcctaacatcatgttttatatccatccttttaaacaaatatttaatagcttgggaatgctggcgagagcagcggctcctgtcagcaaggactgagctcacaatttgaaagatgaaaggagatgcgttctacccacaaagaaaacggtctccagcatcataaactccacatccatcaaaccgggcaggggctgggaatagaaagcctttctggaaagaaaacaccagctaccctttgcaccctggggaacattaaaaatcaaaacaaaacatgccacatcaaccaaaacataaaccagttctcaaaccaatctaaggttccaccccaccaaggccggccgcgcagtggcctgtggagaggagggcccggctcacgtcggaacccgaaccacgcggggtcgcaggaacctgaaaagcgccagagtagcccggcg

SEQ ID NO: 161018 - DNA, 440 bp, Homo sapiens
aaatacacttctctgtgacactcgcaacattttcatccttgaatttctgatttcctttcctttttttctcctattctctcataccttgatggagtcactgaaagccaagatactcctcaatcctgcttaaagacgctaagatctatagagattactgatctccaatgaggcattttttcctagataatatgtaactgctggacagtaaaaattaacatcatattcaacagggaagaaacctgcaaaaataatttcctattaaaggcaggataaagcaaaaagaaaccgacctctctcctacagaagtacggtaaaatctaaactggtcacactaacaaatacagcatttatactctgaatgatataaatttggctttacgatgaaatttatctttccaaaaatctacatttttaaataggttttacacaggtaatataaa

SEQ ID NO: 161019 - DNA, 121 bp, Homo sapiens
ccattctccttcctaaggttggagtggggtggtgaggagccagccacctgctctgctggacaggtccacacttttagaggacctgcttgatgcagtgggtttaatatttatggtcattaag

SEQ ID NO: 161020 - DNA, 195 bp, Homo sapiens
cataaccaatcccaaagataatttcaaagaacaatgacagcaaaggttaggtgggagtagtatttgacaatgcttatttgatattgtctctcagagctgcaaactagattatacaagtcattagcgtcagatagctttaaagttgtgaccttcctttacatgaattttctagccagtttcctatcctttgcaaga

SEQ ID NO: 161021 - DNA, 765 bp, Homo sapiens
gtgtggccacagcagccactaggatggctcaaccttggaaggtaaacagtagtagagagggtgacgcagtgtagaaacttcccacacacttcccagatggggtggggggagcaagaggccctgtcgtccaggttttcctggtttccaccgttgctgtagggctgcaggatccactgagtgcacctgcctttgtgctggaagccagggctcctctctgaccctgagggtccctggctctggggagggagctcgcagggctcctctctgaccctgagggtccctggctctggggagggagctcgcagggctcctctctgacactgagggtccctggctctggggagggagcactgtgttttcagtgcccacatgttgccaaaccgcgctccagaaagctgcccagtttctgtccctgccgaacgcaggagaatgcagggaaggatgttgtactttttctccagagctgcttcccttgaggggggcccctgcctacaggtcagaaggaagctgaggttccaagtcaccccccaggcgggcctggcctgtgtaacacgcaggcgtgcaaggcagaggagatactgatgcccagggcacagtgccgtgccctggaagaccactccgtgcctcggactctgcagcagcttctgatgccgcggaggtggctgttctgttgcagacgggaaactgaggcttagcggcttgccccaggccaccgagcagctggttggcagagcaggcacacgccaggagagctgcctccctgag

SEQ ID NO: 161022 - DNA, 351 bp, Homo sapiens
tattcctaggcttactacttttaaaggatactgattgattcttcttttcataaagaaatcttctgcactgtatgggtatttgttttgtcagaaacattagcagtcatttatctactacctttccacttaggaaaacttcaaatgtcagttgctttagtttttcataatattgatgacaaaattcagtgattttatgtttaagtactgtagtttgtattctatgctgggctgttatcaaaggctatttctttgaatatttcagttaagaaatgttcttataaagttacaagcatgtattattttgtaataaggtgcaatgcgcagtgtgctccggggtccgacacgatcgtc

SEQ ID NO: 161023 - DNA, 624 bp, Homo sapiens
tcgtgaatggctgcatgagtcgactcctagaggtatcccgcgatggatcactacgcccaggactggtaagtgaccagggcgtagtgaatgaatcgacattgtcctcaggccttatgtgtgaccacaggcaagttgcttatcttttttaagcctcagtttcatcgtctgtaaaatagggctattgtcacagtggcctcatcagtttgtggaccacatgaaatgttcagtgcaggagtagagggcccaggccacgcctgcggcagccccttcctcatcccacgttggcgtgggtttggtgatgaacatttgctgggggcataaagttgattgaacaaggctcagtgctggccaatggtgaactgcagccagcttggactggctcataccagctcttgagagctgatagttacattttcagggccagcgtagtggctcacacctgtaatcccaacacttttggaggctgaggtgggaggatcacttaagctcgggagttcgagggtggcctgggcaacatagtgaaaccccttttctactataaatacaaaattagctgtgcctggtgttgcacacctgtagtcccagcaacttgggaggctgaggtagtgaggttcaatcgcagcc

SEQ ID NO: 161024 - DNA, 478 bp, Homo sapiens
ggcggcccccagtcgccctaacaattgtcggggagcctgcaggccctgccagaaagagagaggattggcacgttacctttgggcgtctggcaccccggcgtgtggctgagggcggcaaagtctaaacgaagttgacagatggagtcagtatcggccctggggagggcggccagggaggctccgagcagccgcacccgcagcagcaccactcggcccggcgggccaggaggaggaagggggcgcggaggggcggggctgggtcctgggatgggacgcggggcttgctgcggggggcaaacagaaagaatatttcatgaagtcagaggtggtcgagttttgcgaggggtgggggtcgtccccctggcagaaccggagtgagtctgtgatccctcaattggaaagagggtgagtgagggaaaggggaggaggccgcgagaggaatgaagagcgaggagaccctggagagcggggagcgaga

SEQ ID NO: 161025 - DNA, 296 bp, Homo sapiens
ggctgagccccagtttgggggttcacctgcatcaatactataataaaatggtgaaacttcaggcctgtgagtttccttaagactagaacccattgttttgctccagagcatttttcagtctgctaacttatctctctgactttgatcctatccttatcacttcccaaataatcatgtatactaccctcagggtaagatgtgtggaatggaggtgggggcagagagagagaaagaaaaagagaaaatgggcaaggatgctagataatgttgaaaataactgtaaaagcctataattt

SEQ ID NO: 161026 - DNA, 364 bp, Homo sapiens
ttatttgtaaatgtcaaaaagtccctcttacatataattgaaagctgactacatggtagacaatatgatcacaaacttttaaacaattttttaagctgaagaaatactttttctttttataagtatcaaatcaaaatgtaattcagcatccacccataaagcgcaactaaaaacttttcacaatgccattaacaacttgtggttaccatcataagcctacagacctacacactaattatctttaaaacccttattaggctgggcgtggcggctcacgcctgtaatcacagcactttggggggccaaggcgggcagatcacttgaggtcaggagtttgagcccatcttgtccaacatagtgaaac

SEQ ID NO: 161027 - DNA, 544 bp, Homo sapiens
tagcgtgtacaggagcatcttcagttcccagtgtctgtgtgtccttccaggagtagcttaggaacacacaagcagaaatgcacagatagaaatacatattcctcaaaagatcagcgggaggggccttcatgggtctcctgcacccacttggcttgaaaaattctctcaaaccgtcaccccagtctcatcatgagaaaaacatcagaccaatcccaatgcaggcgcatcctgcagctccgtgaccagcaagcctcgaaactgtcaagggtcacctgcctcgaaactgtcaagggtcatcaaatcaaaaccaaggtgagtctgagaaactatccagcccagaggctcggaggagcctcgagaaggccaaagacagatgccacctggggtcctgggattgggctgatagcccagtcccaggaggcaagtaagaaaaaaggagacttaaattgtacacagcaagtctgcttacacctttgcccagaatttaatctcagtactatatgtagctgcaggggaacctgggaaatgtagttttatttcccat

SEQ ID NO: 161028 - DNA, 496 bp, Homo sapiens
tctgggtcaaactaagtgaagagcagaatattgttaaatgatgctgcagaggaagactaggtgttaaagggccccttgggagccactgtgatatgtatggactttatcctcagtcacaggtaacaccagtgggaggttttgagcagggttttgtctatgatcttaggtccaggctggaggtttttcctctgtctcatcagctttctgattagaacaattatgtttctatgggtctagctgcttttagatggttgccatcccatggccatcactcttgaagggatgattccagaagcatctacatgactgggcggggtggtttatgcatataatcccagcactttgggaggctgaggcagaggatctcgaggccaggagtttgagaccaacctggtcaacagagggagaccctgtctctatatttttaaaaaaagaagcatcttcatatattatgggctaatgttaatagataagattttcttctgaggtaggtgga

SEQ ID NO: 161029 - DNA, 447 bp, Homo sapiens
tcattcatgtgtcaatggagtagcacttttaattttcttcaagaacttttcctttgcattcacaatttggctaacttagctaacttaacttggctaatttggcatatgcttaatcatttcttcctttccttgaaagtacgattctttcacttggacactttgaggccactgtggggttactaattggcctaatttcaatattgtcttatgtcagggaataggaaggcccaaggagaaagagatggggaatggctggtcagtggagtagtcagaacacacatgtttatgggttaagtttgctgtcttatatggatgtggttcatgtcaatataacagataaaataataatgaaaaagcttgaaatattgcaagaattaccaaaatgtgacacagacacacaaagtgagcacatttaatgtatccagtaaaaaccaaagtgtttcttac

SEQ ID NO: 161030 - DNA, 325 bp, Homo sapiens
ctagccactagagtccttccacttcagcctcccgggtagctgaaactataggtgcatgcaccatgcatggcggcatgcacctgtagtcccagctacttgggaggctgaggcatgagaatcgcttgagccctgaggcagacattgcagtgagccgagattgtgtcactgcactccagcctggggcacagagtgagactctgtctcaaacactaataataataataaatttttttaaaaaaagaaaccagacacaaaatacacattgtatgatcctatttacatgcaatgcccagaatggataaatccatagacacagaaagcagat

SEQ ID NO: 161031 - DNA, 145 bp, Homo sapiens
gtatgtaacaatgaggcccagagcctgagctttggtgtctagcagacctgggtttgaatgttagctctttgtcttcctgtgtgaccttgttggttactcgtctctctgtgtctcctccactcctataaaccaggaggtacaaatg

SEQ ID NO: 161032 - DNA, 242 bp, Homo sapiens
cctccaacccaaaagaacctccaatattagaatctgccccccaccaactcctcaaccaggatcccatttttcttctttgttgtctgtctccccgactagggcagatgtctaaggagcagggctttcatctgccttgtagaccctggtgatctcagggtcaggcccagatgaccaacaaatattcattgaatgaaacttggatagcagtgaggtgttcacatcatctctacagaaacaaacag

SEQ ID NO: 161033 - DNA, 230 bp, Homo sapiens
  misc_feature (36)..(36): n is a, c, g, or t
aatactatgactttgcttgcctcagatgaagtaaanaatgagagataacataacattatgtaataatattctccaatgcccataaggactagaccactccccttcctttggagaatattattacataatgatctgtacctctcatgttgtacctagtgaggtgaccctcattttagaatactttctaactaggcaatatcgatatctttactgtagcccttgccattctt

SEQ ID NO: 161034 - DNA, 261 bp, Homo sapiens
aaggtggtgatgaatgcagtcaccatattcactggatacagataggatatgtggtctgaccaaggattttcctacttatactttcaggaaacaaactgaatacctaatttggtatgaaaatatttgaatttctggaatatgtgtgtaatttatgaagacaacatatggactttttgaaactggaaaaattccagaaaatttcatctatctcgtcatatctttacctcaaatatctgataaccagtattccatcaccaaagg

SEQ ID NO: 161035 - DNA, 1083 bp, Homo sapiens
agttgaacagcaactgaggggagcccactgtgtgagcaaatgctgagaagcagaaatggacaagctaggtttgggggagaagaaataactggtttggctatagtgggaggtttccataggggtagaggaacaaggtggcagacgagaccatgtagagagaccgtggagagcctcagatccagagccaaggactgtgggctgtgcactctagggcagccatccccaacctttttggcaccagggaccaggttcacagaagacaatttttccacggcctggaggggaagggggagatggttttcgggatgaaactgtttcatctcagatcatcgggcattagagtctcataagaagcacacaacctacatccctcggatgtgcagttcacaatagggtttgcgctcctatatctaatgctgccactgatctgacaggaggcggagctcaggtggtaatgctcgctcaaccaccgctcacctgctgctgtgcggcccagttcctaaaaggccacagaccggtaccagtcctggcccaggggttggggacccctgctccagagccaggttggagctctccaaggtttacactaacaagggcctggcaagataagagtagtgtttcaggatgatccagtggggggcccttcagagaatggtgacagagaaaatgcaaagggagagccctaagcgtgcaagacatgctatggcctgaggggcagtaggcactggaggaggagaaagagctccacataggaaaggaattgtccagccagagctacgggaagaacagtggtgccaaacacaaataccggtgtgggctggcttcttgtctgggtttcaagtgtgtgtggcgcgtgtgtttatgatagtggggtgaggggttgcaaatgatgaatttggtttaaactttttgagtgccaggaaatgacagggagatcaagagacagatgtgcagataaaagtgcaaatggccgggcgcggtggctcacgcctgtaatcccagcactttgggacacctgaggtgggcagagcatgaggtcaggagttcaagactagcctgaccaatatggtgaaaccccgtctg

SEQ ID NO: 161036 - DNA, 154 bp, Homo sapiens
cagatctggttgagatctttaaacagaatttaagaatctttgtcagaatcttaaacctttcctgctggactcttcagagacccctgagaagactgctccagtgtcttgcctgtctggatgctggaggctgagccatggaggatctgggagctga

SEQ ID NO: 161037 - DNA, 377 bp, Homo sapiens
gccctgctttcagcatggcaccgtttacaactctgcttggtgctctatggccagaaaacctctgtgtttcttgtttgtttttgttttttgagacagagtcttgctccgtcacccaggctggagaatgcagtggcgtgatctcggctctctgcaacctccggctcctgggttcaagtgattctcttgcctcagcctctaaagtagctgagattacaggcacctgccaccatgcctggctaatttttgtatttttagtagagacagggttttgccaagttggccaggctgctcttgaactcctgacctcaaatgatccacccacctcaacctcctaaagtgcttgaattacaggcgtgagccaccgcacctggccaaaa

SEQ ID NO: 161038 - DNA, 392 bp, Homo sapiens
taatgtaagtgacccatcatcagcaatgcttttgattgtttttctggggtggtgatgaacttgtgatccatccacccctcactgatatcctttgtacatcattcacagatggccagccagagttcagtgtttaagaggccacatccagaaaaactaaaactctctaatctactctgatttccaacttattcatttaatcaagcacttaatgagtacttcccatgtgggaggcactgtgtctgtcactgtgtgatggggatacaaaagtgagactcagtccttgttgttcgttgacaaatgcttaaacaaataaggcaatgcagtgtaatgcatgctctagtagagttacaaccaagtttctgctctgcgtaggtgaggtacaggaagtttca

SEQ ID NO: 161039 - DNA, 748 bp, Homo sapiens
gcattgcttgtgagaatgtaaaatggtgctgtcgctgttcggcatagaattaccttgtgacccagcaattccgctcccaactgttcgtccaaaagaattgaaagcagggactcgaacagatatttgtacacccaggctcatcacagcattattcacaagagctaaaaggtggaaacagctccgtgtccatcagtggatgaatggaggaacaaaagatggtatacatgatggaatattattcagccataaaaaggaatggaattttgggtagaaagctatcatgtggatggtcttgaaaacattatgcttagtgaaatcagccagacacagaaggagaaatcctctatgattccacttgtacgaaggacctagagtaggcaaatacaaagagacagaaagcatgcatggagtcccagctattcgggggcaggaggatcacctgagcctaagaggttgagttcagcctggacaacatagtgagacccggtctcttttaaaatatatgtatataggccaggcgcggtggctcacgcctgtaatcccagcactttgggaggccgaggctggcagatcaagaggtcaggagatcgagaccatcctggctaacacgatgaaaccctgtctctactaaaaatataaaaaattagctgggcgtggtggtgggcgcctgtagtcccagctacatggaaggctgaggcatgagaatggctagaacccgggaggcggaggttgcagtgagctgagattg

SEQ ID NO: 161040 - DNA, 307 bp, Homo sapiens
cggaaagaagagtatactcagcatttacaaggattacagccaatgtcaatgcagaagagaggctgggtaaacttagatggtgcctaaatggaagtatttcctataccctctagcttgtctgacacctgacttgacacatcaaaagctatgcaaccagggttcatttacagggaggaagaatcaaagttgcttggttttatagaacgtatttagtgtgaaagatgggagcttttcttctggtcctaacttctcattcttaaggaagatggaagtcaaattgtagaaaaaaaaaatctacccaaatgcc

SEQ ID NO: 161041 - DNA, 728 bp, Homo sapiens
atttattaaagttaaaattattaaaaattgagaaaattattttagtaaaacttgtttcagctgggtgtggtggctcatgcctgtaatcccagcactttgggaggctaaggctggaggatcacttgaggtcatgagttcgagaccagcctggccaacatggtgaaatcccgtctctaccaaaaatattaaaaattagctgggtgtagtggcatgcacctgtaatccgagctactcgggaggctgaggcaggagaattgcttgaacccaggaggtggaggttgcagttagccaagatcgcgccactgcactctagcctgggcgacagagtaagactctgtctcaaaacaaaaacaaaaacaaaaacaaaacaaaaacaaaaacaaaacttgtttcagtttatctacttatttcgcttaaagtgttcactttgtaggaaagtgagaacatacttacatagtgcagtcctggaaaacatacttacacagtgcagtcctggaaaacagctctaactttttacaggaagctaacaatatacttgggggttagaattctgattaaagacattatataaaaataaatcatggtatatttatgatcatggtaaataaatagtatattataaaattagagagacaaacactatgaattcatataatcatataaaatgtaaaattatgttctgtgcattctataaaattgagagaaatatgagtatgatgattatttat

SEQ ID NO: 161042 - DNA, 364 bp, Homo sapiens
aagaggccgcttccctgtgctcccatacataataacaccgagtccagtgggactttagctctgggcacaaacgctacagaactgcaagaactgcagacagctggggcccacaaaacatgggcaagtgattgtgtcctgaccccaggacctctgagttcaggtaagcattttacaggggacatgagctgtgcccagtgccttctgaatacccacggcagggcagcatcgctctgcattcacttctgtgtctcctgcatcaggcgcccattccacaagaaatgcggtcacgtctctgtctctctatccactgtacctagcatggtgcttggttctgtacaagtattcaataaagtgttttttgaat

SEQ ID NO: 161043 - DNA, 493 bp, Homo sapiens
tccgcgctccgcactgcccgccccgggtccaccgcatccaccgacaacgcaggcagcgatggcttcaaatgcatgccgccgttccgagtgtgctgtccaggccgtgaggtccggggagaaacccggcagcggggtcgccagcagcctgcaaggcgccgaacccggtgcgtccgcgcagggagcggcccgtctggggtgggtggcgcgatcgcctctgcaaggctgggatgctgcagccctgggccgggcaatcgggggacgtgtgacccggggatggagcgaccctccggactgggcgacccctgggacaggcaactctggggccgtgtgacctccaggacggttcgacccccgagaccctgcacggcccgcgctcctgccggggagggtcggctgggcggggagggggcgggcggcgccggccaatccggaccccgggccgcgtcaccctccggggtcaccgctgcctccccacgtggtcccacccggaggg

SEQ ID NO: 161044 - DNA, 718 bp, Homo sapiens
  misc_feature (671)..(671): n is a, c, g, or t
  misc_feature (673)..(673): n is a, c, g, or t
  misc_feature (694)..(694): n is a, c, g, or t
aaaatgaaaactcaaaatctctggtgtgtagtaggtgcttcataaatgttgtttccttatcgtcaatattttcatagtagtttaaaagaactttaatttgagactattaaagtgatgttcccaacattattcctggagctatttagctttgcttttgaaatctaaagtttccacattttcatcaatatctttgttattaggaatattaaatctttaataaaatatattggttctttatagttaacactgaggaattaaaaacttttgtctatattgtgaatactttttaaatattttcattatcctatttatttttctttattcaaggcatttagaaaagcacatttttctttttgcaattaaaataacctaaattcagttttggggagaaaatttgatccttttgctattggattattaaggactttatcagagttaagcaaatatttggtaaacagctacatttagcactgtgaaatcatgtagtttattttaatcattttttggagatatttaagggatacaaattataagtgtacatcctagtgtaattatttgcattaataattacttagtgcattttattttattttattttattttgtttgtttttgagacagaatttcgctcttgttgcctactgcacctcatcctgggcaacagaacagggncntgtcccccacccccacccagnacagcctgagataagaggagatat

SEQ ID NO: 161045 - DNA, 516 bp, Homo sapiens
tggaggactccttaaaaatgcaaattattgggccctaccctggacctactgaataaaaagctcagaaacccttggtgtggggcacggcgctttgtgttttttggttttgggttttttgtttgtttgtttttttgagacggagtttccctcttgttgcccaggctggcgtgcaatggcatgatctcagctcactgcaatcttcgcctcccaggttcaagcgattctcctgcctcagcctcccaagtagctgagattataggcgtgtgccaccatgcccggctaatttttaatagagatggggtgtctccatgttggttaggctggtctcaaactcccgacctcaggtgatctgcccgtctcggccttccaaagtgctgggattataggtggtgatctgtgttttaacatattctccaggtgactctgatgcccctgaagcttgaaggccactgctctggagcaaactttccccaagcatgagccacaaatgcatatgggctcctcttagcccctgtg

SEQ ID NO: 161046 - DNA, 350 bp, Homo sapiens
gccaacctggcaaaaaggcctgaggggatttctcagcacagaagtttcagatattcaacattcacattactgtgatgtcagctccatcttcccaaaaacttgagtgcaggctgaaccaaaaaccgtgagagggagggagggggtgtgtgtgtgcgcgcccatgtgcgtgcatgtgtgtgtgtgtgtctgtgcctgagtgtgtatgtgtgtgcctgtatgtgtgagtgcgtgtatatgtgtgaacgtatgtgtgtgaatacatgtgtgcgtgcgtgtacacgtgtgcctgtgagtacatgtgtgcgtgtatgagtgtccatgtgtaggtgtgtgcctgtgtgagaccatgt

SEQ ID NO: 161047 - DNA, 364 bp, Homo sapiens
actgaacatttaggatttctactgcaagcccttgaagagttagcctcggacacagggtggagaatagcagacactgcatccaatctatttggaaaatgtgggggaaaccagtccccaaggcgagtgctaaaaaatttaaataggccgggcgcggtgtctcacgcctgtaatcccagcactttgggaggccgaggtggttggatcacttgaggtcaggagttcttgaccagcctggggtgacagagcgagactgcatctaaaaaaacaaaaaagaaagttatatatctccacaggaaactgtgtatctcaaagtaaactgttgatttactgggtgagacacaaatacctaactgactattctctt

SEQ ID NO: 161048 - DNA, 374 bp, Homo sapiens
tggagcctcaggtacatgtgaagcctgagttttcaggggccagcttagggcctggagctactggggctgacctggctctgggatcggtctggggtgtgaagctctgggtccagcttggtgctggggcagcccagaagactgagtctatggggcaagctcagtgttgaggcagtgttggtttgcaggtggtggcctggactctagggctgcaaattccagcctagtgctgaggtgggcctgaaggctgggatcactggagcttgcctggaagtggagcaagactagaggctgaatctgtgggagctggactggtgccagaatgggcctgaaggctccatctgtagggtcagcctggagaggccttcaggggcagg

SEQ ID NO: 161049 - DNA, 149 bp, Homo sapiens
tccactgccgcgaccaagaggagacccttcccaaggcaaaagaacagcttccctcttctccagcatctctggctcctcatcaccttgcaatcaactcgttcctgtgaggggacaaggccctgcgcacccaccctgaccccctgcccatc

SEQ ID NO: 161050 - DNA, 402 bp, Homo sapiens
taaacaacatccagggaccattcatggctatgtaaattgagtgagtccaaactccccaatttgacagtaaggcattttacgtaaggtctctatctgactttcttaatgtatccctacagcagagctcacaaactggcaatctgtaagttgtatccagtcctcataagtgtttttgtgtagtgaatacagtgtttttactaaaatttgaattatctgtcagtatttactaaatgactctccacttcatattggcacatgctttctgctttaccaaaaaccccccaccactctctattgccttgctctggtctacttcacttgcctgcatgacttgctgtagtcattgagacattgacttgattgactcaccaagtttacaaatgaccccctacatattccaac

SEQ ID NO: 161051 - DNA, 907 bp, Homo sapiens
gggctgggaatttagcgaaacaggatggtaggaaacactggcaatgcaggggccagtgccaaagtgggaggattttgagctagattctcgtctagtaacacatatttgtaggacaactttgctgttctgttttggtgcctggccaccccttggtagctgtaagattaagctttttgaacctataataggaccaagaatggatatgtctttgtgtctgtgtgcatatttctatcagccagtgaatcttagaaaagaatacatgtgtcatagtattaactgtagtgctagtctgtacaggaccaagaagtggaagaaaggattatttctctctgagggaattgaacacttctcagaggaggtgccctttaaacagaactttgagcaggagtttgccaagtaggaaagtggggaggaacttttattctgtgtgcacaggaacagggtggcatagaaacgttaagtgctcagaccatgtgaaggaatagtggtgatttggagggtggccggagtcattaaggtagaaatatagaggaaaatgaaatgtacaattaaatgcttgattagtgctttgcaatgttgacatgaggggttattcatcaagtactgattgtgtacagtgctctgctagacctacaaaatgtctggcactgttggggaaataaataccttatttctgttccaaacagaaatgggaacattttaagataatcttgctgccttggtgctaggtcatcagactgaaatgcaagtccttattttactctagtaattttatcttttgctttcttttctttccaatatttgtagtcaccttcctttttaagcacatatttctaaggggtttgcttctgctttcaagctaatccattatttcagctgttgattatatgattacatgatttgtcca

SEQ ID NO: 161052 - DNA, 300 bp, Homo sapiens
ccagacaccccgggctggggctccgtgtcacaaagatttggaacaaggagcacatcttataaaacagcagcggagacaggggaacggtgagggcctccatcgctactggcagacaaagcgccccccaggggagggtcagaggcccgtgcttgaatattctggctctcgcctgtggggagattgccagtgaaccctgcaggccgggggcccgcgtggaatgcgccatcttagtcaggggtgtgcaccgtggatgtgtgtatgcttctctgaaacccaggattctcccccttggcttgcaat

SEQ ID NO: 161053 - DNA, 327 bp, Homo sapiens
tgctgggattataggtgtgagccacctcgcccagcctccatcttgtttttattatttatagggtggccatgactgatcgtaaagccctactggtttttccattataagtaacacgtttgtattagtcctttctcacactgctataaaaacacacttaagactgggtaatttataaagaaaagaggtttaattggctcatggttctgcaggctgtataggcttctgcttctagggaggcctcaggaaacttacaatcatggtggaaagtgaaggggaagcctgcatgtcttacatggtggaaggagaactaagagagaaccaaggaga

SEQ ID NO: 161054 - DNA, 211 bp, Homo sapiens
acgctctccacccaccccacactgcttctaaggaggcatagagtttttaagcagaggaatggtgtagtccatttcatctcttagaaagctaactctagaagcagtgtggggatggattggagagggcgcagcagagtcaggactcagcacaaaatgagaaatgaggatctgaacagaggccatgaggggtgggtgagaagaggagcaggat

SEQ ID NO: 161055 - DNA, 524 bp, Homo sapiens
tctccctactgtatcctagtcactacatgagccactgcgcccagcctataatcagaaatattttatagtaagagaattagcacgatgactgaaagctcaggtagtgactaggagaacatgtttattcattcgaaaaacatttagggagcccttggagaagcagtaatagttaaggcaagacatagtccttaacagtttagttgttctaagcagaagcagtaagctcgacgtcatgaagaaaaatgatttggagaatggcacgttgtgagtgtggctgcagctggagtgtggagggccttgcatacaatttgaggtttgtactttatttcgaggtaggcttctaaggaggcatagagtttttaagcagaggaatggtgtagtccatttcatctcttagaaagctaactctagaagcagtgtggggatggattggagagggcgcagcagagtcaggactcagcacaaaatgagaaatgaggatctgaacagaggccatgaggggtgggtgagaagaggagcaggat

SEQ ID NO: 161056 - DNA, 206 bp, Homo sapiens
tgtgtgaaccatcagtaacataacacagtaaggatatgacatagaagagaggtgaaaggagataagtactggctgtttgggaacagcggaacagtgataaagcttgggaagttgcattcagggagggcttcctgaaagaggaacatttatactgaatggtatctacagtgaaaaagcccatgtgacttgaggaaattatttaaact

SEQ ID NO: 161057 - DNA, 559 bp, Homo sapiens
gatttttatatttaaagcttatcccaaggcatttttacaaaatatttttcctatcctttataagtacattacatgcagcatcactcaccactgataattctccattttgaagatcaatactcaatcacgaggacagcttattcttacaaatacattgagaaaattcacataatttttaacatgttctagaagcaactcaaatccaataagcagctcccttttgacttttaggattcattcaacaaatatgtatggaaactgcgacaaaaaattataaaatattatggtctctattttctaggagtctaacaagggagacttctcagcggacaaatttcttcctagttaattataatttctttcattcttccctaatttgcaatgtggaccaggaatataatctcaaaagtccacctaaagacatgtccagttcactgatttattctgatgctgaaatgattatttactataaacaaagcaaagagcaccaagctggggcagaaatttggagagttgggactgacagaggcctccattaaatccagtcattttagaaagt

SEQ ID NO: 161058 - DNA, 434 bp, Homo sapiens
cgtaccataaaggttagttgaggagataaaagttaaggaggtagaccgggcgtggtggcttatgcctgtaatcccagcactttgggaggctgaggcagatagatcacaaggtcaagagattgagaccatcctggccaacaaggtgaaaaccccatctctactaaaaatataaaattagctgggcgtggtggcgtgtgcctgtagtcccagatacttgggaggctgaggcaggagaatcgcttgaacctgagaggcggaggttgcagtgaagccaagattgcaccactgcactccagcctggtgaaggagtgagattctgtaaaaaaaaaaaaaagttgaggaggtaaaagtcttatggttgtaagacttctacaatttacataaaatggtagcataggaactctgtctagaatatgatatatgatatatatacc

SEQ ID NO: 161059 - DNA, 457 bp, Homo sapiens
acaaggtgcattctttctccctcatcgtactcacccaggcacaagaaaaatgactacctttgttcagccacttcatagagcttttgaaaaaagagttcctggaataatgacagtcagtcccacgttctcctttaggtgtctatttttaagttgcttttcaaaagaactcatttaggagagctaggggcaaggttggaaggcataaggacaaacatctgagcgtgaatttaaaaacgtgacgcccttgccctgtttagggtgcgggttggagacgttccaggtcacgtaatcaaatgacagctattaattggacttgagacccctttgggaaaagcctcttcgtaaccccgagtttcacggtcatgggctgggcttttttcttgctttggcgtggatgggaaagtgcaactcagtacaagggctgtggctctttctttcgtctagacattggccgcag

SEQ ID NO: 161060 - DNA, 148 bp, Homo sapiens
caattttgaaagaagttctatggcaggtaaaatgctatcaaacagcatcacatgctacagagaaagcttttgtgagaggccaagtcaatcagtatgacaaactttattgtcgtggtctcatccagcccaaccttcagcaaccaccacc

SEQ ID NO: 161061 - DNA, 354 bp, Homo sapiens
actgatggatcaccggagagaaattcgccacgtggtgccatgtgactctgatgaagtctcggggaggggctataaattgtaaagcccagctcctcttcaaaagttcatttggggccaggtgcagtggctcatacccataatcccagcatgaaccactgagcccaggaggctgaggtgggaggattgcctgaggtcaggagttcaagaccagcctggccaacatgacaaaaccctgcctcgcctaaaaatacaaaaaaaaaaaattagccaagtatggaggcacatgcctgcaatcccagctactcaggaggctgaggcaggagaattgtttgaaccttggaggcggaagttgct

SEQ ID NO: 161062 - DNA, 328 bp, Homo sapiens
tcattctgggtccaagcattcatcctgtatttattttccaagttcctgtatttagaattagagaagaccttactcagcaagtggcagaattcctacattggctccctgactgtactgtgtcataacctagtattcagggaccttgatcatttcaccatttcacaggacatagaccatggccatgtaattgatggcaaccagtcaatgaatctgctgagcataaattagcaaatacacaaaatgccttggcaagacatatatgtgactaaggataagagaaaaattccataaaagttcagagatctactaactcattgatgtttctggg

SEQ ID NO: 161063 - DNA, 309 bp, Homo sapiens
agaggcaacttcccacccaaagagaggggagtggttcccacccagaaaggaggggctgagctgaaggaccgcgaggcttcagcatttcttcacatggaggtgatcattcccctgccagcctcccctggtcattctgaggacctggcagctctggaggaagcttctccaagcccaacctcccatgggtcaggggagccttcggagctcagggagccctttcttagacatgtccatctttcgaaagccagcccagagcccaaggaccaagtagggtttgtggtgtcccctgccacaggaggtgagcgcagg

SEQ ID NO: 161064 - DNA, 369 bp, Homo sapiens
cagatatctacactgctgcatgctaagtgtgtcatcctgggattcaaacgtgagtaatagaaaacctgactaagcagcgacttgaactgaataggaggctcgctctcctcatttaacaaaatgtccagaacagggcagtccaaagctgatacagcagctccatgtttctgtgcgggacccggcctcctccagcgtttagtttagctgtcttgtcttgtaggcttctttctttcattctcatctttgttacccggtaggtgtgagatgcctgcttcattagcatcctacccgtgctccaagcaggaggtgagccaaaggtgaactcaaatcacagatgcttgttaaggccgttcccattcaaagaactcc

SEQ ID NO: 161065 - DNA, 352 bp, Homo sapiens
atctcctatttccctgcctcctgtctcatttcttctcaaatactcacttcgctctcaatccttcttttatatactgcaacccagaataattcacaactttgaatggcaagtcatttcatcagaggataatggtccaattcttcatgctaagttttagcacatatatgctatagatacacacacacccatacatatatgataaacttattttacaattttaatttcattttcacattttagataaggtcccaattaagccttctttttctccatttgattccctcttttaagtagtcactgcacattaccactctccaatttcaatttgtcctcacctaacaaagacttcttg

SEQ ID NO: 161066 - DNA, 342 bp, Homo sapiens
cggaaatcaccagcgaaaaataaaatccctccaagttagcacaatccacaaaggaagagatgaaggtagaattttctggaggcttttgaacattagcaagtgggaataaatactgagccagaagagagcagagagggggcttaccaggcttgacaaatgacaccgtgattcacacccactgctgggctgtctctaataagccacagaggaagcagccaatctcagctaattaccagataaaaaatgtatggtaaggactctaattaggagacgcggatggaggtgatctaatgattaaatgctgcattcgactgaccccaccatcaatcgctgtgtattccg

SEQ ID NO: 161067 - DNA, 414 bp, Homo sapiens
atgatctagaggatccctttctaatctatcagcataatagataaggtagataggatggtttctatatgtagctttggctaatggagacttctacttaatgtgaagatgagctgactgatagtgatgtgctgcaggttagatagttgggggtgcttacaaacctggtactgattgataagagttagaacaatactcagcttgacgtttctcaattcatattaaaggctaaaggtacgggcttatccatttttttccctagccagcatatatcccgtgttcttggcactgtcctcatagtattgggaatgacatctattcttcagttctaaggaaagagttgtgccagtaagatgtgtcttactttatatttgcatttcagtctttcttttttttttttgcacactcttccctcag

SEQ ID NO: 161068 - DNA, 445 bp, Homo sapiens
aagaaagaagcagtaaacttgaagaggacaatggaaattatcaagcctgaggaacagaaagaaaaaagattgaagaaaagtgaagaatcctcagggatctgtgggacgccatcaaacagaccaacatatacattgtgtgagttccagagggaggaaagagagagagaagggggcagaaagaatatttgaggaagcaatggctaataacttcctgaatatgttgatgttaatataaacatccaagaagctcaatgatgaactcaaagaaactcacaccaagacacactataaacaaacttacaaaggacaatgagagagttttgaaagtgacagagaaaggtggctagtcacaaaaaggggatcatgaataagattttcagaaaatttctcatcagaaactctggaggctagaagatagtgggtcatatagtcaaagtgctaaaag

SEQ ID NO: 161069 - DNA, 222 bp, Homo sapiens
tgcatattttaacatctctgaactttaaaggtgtctcatgattgaagatgtgttagagtttagatggcatcagttttttttctttgttagtggtatataaaataatggtgcttcttacaacgggatcttagattttatgaggtatcatatgggtgttatccctgccctctgagataataaagttgttcatactgccaagggcagcttccaggattactttct

SEQ ID NO: 161070 - DNA, 498 bp, Homo sapiens
tagcattatgcaaaagtaatggcaaaaactgcaattacttttgcatcaaccaaataatatagagtgagatgaatcacaattgtttttttggatgctttttgaataaattgacagctctatttccatttccatgaccgtgttggaaacctccttgttctcagagagaatcaattttaagtcctctctgcactttatatgcctgttgctacatagaccggctgactctgaagtatagatagagctctatgtctgaggatttttttttttttttgagacggagtctcactctgtcacccaggctggagtgcagtagcgcaatctcggctcactgcaacctccacctcccggcttcatgtgattctcctgcttcagcctcccaagtagctgggactacaggcgcccgccaccatgcctggctaatttttgtatttttcgtagagaaaagatttcacactggccaggctggtctcaagctcctgacctcaagtgatccgcccg

SEQ ID NO: 161071 - DNA, 306 bp, Homo sapiens
tgtcaagatcttttttttctcaaaaaaattatgacagcaagttgcttacatgatagtctgtaccccaaaatgtattaatacatatttcctactatcaggacattcagctacatcatcatcactcttgaagtcaagaaatgaatactaatacattaccaccatataatcctcagagtccattcaagatgttgcccattgtcacaataatgttctttatggcagagggatacaatgcagaatcatacatttcatttaattatcatgctttttaattgtccttcaatctgggctacttcttcattcatt

SEQ ID NO: 161072 - DNA, 323 bp, Homo sapiens
gtctgagaccaaccagcttgcaattcattggcctgcctactccctgtgaattcaccaagtgggtcaggattcctccaactacccgcgtagttcaggggagagccctgtgaggtcagggactgcagaaacagagcctgaggtgagggtcacgtgctagtgattcactcaggacactgtcccagggcagggcaggccagtgaggcagtggaggaagcaggacagacaagaggaagaagccaagcacaggtgccatttcaggcaaagtcttggcttcagtctgaccctctgggggagctctggggtataaattatgcttctgagtt

SEQ ID NO: 161073 - DNA, 658 bp, Homo sapiens
attcttcttcaggggttcagtcctacctggcccatattttgcttgtttagcaattcagacatataaatattgcttggattactatggatctgataaagctttacttgaacagtgaattcaataattttgactcttcacgtactgcagattttatttaatggcagcttgttaatggttggtaggaggggacagatggttggatgtgttggcataagtcatacataatatagcatagtcaaattcagataagtatcacacaaattaataaaagcttttattgttgtgttgtttattttgctttttttccccatagatagattctgtttgtaagcagtttttgtaggtaaaaaaaagaaacatatactacagacacagactcaaaagaaaaatataatgtaacttgatacatgctcattctgaaatgtaaaatattatggaaattcaaaggtttacttgcaggaaatgtacaaaatttattaagtccatcaaacataaaataattttatagctaaagaattcttagttttgtgaatgaatgagtgtattcaatgcagcaaattattaggtagaaattgctttatccagattcatccagacagtcctctctcccagttaactgcaatacagccaaaagagtttgctcattgtccctgaagtg

SEQ ID NO: 161074 - DNA, 364 bp, Homo sapiens
agtggcaggcacagacaatggcactccggtctcttgacacatgctggagggcaagatggtctcccctagcttagtgtctaacgtggccaggccttccctgtgtaaacgatttatttctatcctaggcctgatctgaggcccaagggacttagagggtcaaggaaaggggccactctttggtatttctgtatttatttatgtgattgcactaacttcagacaagaaactgacaaaagaggagttttttaaaaactccttgagtcacttgcagtttcaggttatttatttaggagaaatgtttttctgataaaaattgtctcacctaggaaacataaagtccagagtgtaatcagcacagatctgt

SEQ ID NO: 161075 - DNA, 242 bp, Homo sapiens
ccccagccatcttttctcccacccttcaaaccctccagaaaaacccacctcaaaatacttcctccctgtccagtaagatgacccatttgcacttctgtttgcaacagatattcaaggaaagagaaaagtgaaagcaatcagaaaatgtcttgaaaatccacttaggtcagaaccttagcagtggcttctggcacagaagacagatctctgatctcaaggagagttctctacaaaatataatg

SEQ ID NO: 161076 - DNA, 285 bp, Homo sapiens
cacacccacacacacacagagaaacagagatagagaaaatatccatattggcttattaaagacacttagcatccttagagaaaataagcctaaaatattttttaaaccccatgtttccaaattttgctggactttatgtccctgtcctctcacccagatatgttagtttaccctcccaaagtcttgggtaaagttggtttagtgaattctaaataaagaaatgtctctagagtagataagaacatttcttccagctgtagtagtttgaaataaacttttcattag

SEQ ID NO: 161077 - DNA, 267 bp, Homo sapiens
cagatacttaggcccttaggtgatgcaaccatgtctaatggctctgtatgtttctaaatgccttctcaccatttttgtacttacctcatgggcaactggtaataaacagttggcagactagcacccacctagaccacacattgagtagtcttgtgctcaggtagagtctcctactagttatgagctgctagcgtgctcaaacatcagtcatgttctgatgtaggatgcgccggttaatttggcagggtggttaagcagagatgagtt

SEQ ID NO: 161078 - DNA, 309 bp, Homo sapiens
ttctccatcttcatccttgatgagaggagagcttgttatgtatgtaccattgctgggtacaggaggcagaagagctagcgccagaacaaggagctcagctttttctggtctctgcttttacgtggctcgttataaaccaggacccaattagttctttaggcatgcctgcctgttctctttccatgtaattactttgtggagcttgggttcatgcacatagttacctcgattaaaaaataagtttttggagctataaattttcaaacactgctttgagagggtctgtcaggcattaacattcaaggtttc

SEQ ID NO: 161079 - DNA, 393 bp, Homo sapiens
agtaggtaatgtggtaagtgttatggaaggggtatgagtgaagcactgggggacaatgacaaaggcaactagtaatgctgcagtgggaagataaggtcagtttatcctaatgatcagtgcatataattcaataagtagaacaaatacactaccttaaggcaatgctgcttaattcaggactcttaacagggacacaaaatacagaaggtatagaaattcagacaacatatatttcatccaacatttttctcttaatccaattacttttgacaagttactgacctgcttggatgggttccaagaaaaggcctctttacgatggatgttactctattacaaaccatgttccagtctattttatcataaaacatattttctctgctagatactact

SEQ ID NO: 161080 - DNA, 342 bp, Homo sapiens
ccggtctggttatggttgagtgggcttagggaaaaaataatacatcgtgagtgaaagtaaagtgtcacttcctagaggaatctgccactgtgagaattttcagatctctaagttactatttgaaattgtgactgctccttctacctgggtccttgagtaactatgatgagagaaacacaacactggtttgtatacctgtgataaataggcctttttcattttaaatccctgtgctttggagtttgtcattccaacctgtatagcttatcctgatacatacaagtaaaaatacatatgaataaaagatattttatgcccatgaaattaaatgatgtttgactc

SEQ ID NO: 161081 - DNA, 369 bp, Homo sapiens
tattgcttctaaaaaagtaaacattcaaaatattcaacaattagagaatggataagcaatgatacatatattgcaataatgtggcattttcagagacataataataattgaaaacgagatatgcagctattatttcaactatataaaaatttggtttaaaagttagtgtgatacttcagaatattaactgggtttcctagatagtagaactatagatggctttttcttcttttttacaaatttgtttccaaattttcagtaatgagatttcttacttttattattagagaaaaacttgtttgaaactgttaattgttgttgcggtagacagcctctaaggtggcatccagtgaatccattgatacacat

SEQ ID NO: 161082 - DNA, 921 bp, Homo sapiens
  misc_feature (327)..(327): n is a, c, g, or t
  misc_feature (337)..(337): n is a, c, g, or t
  misc_feature (341)..(341): n is a, c, g, or t
  misc_feature (346)..(346): n is a, c, g, or t
  misc_feature (352)..(354): n is a, c, g, or t
  misc_feature (357)..(357): n is a, c, g, or t
  misc_feature (364)..(364): n is a, c, g, or t
  misc_feature (756)..(756): n is a, c, g, or t
  misc_feature (862)..(862): n is a, c, g, or t
cttgaaacacagtgggcacatgagcaatggctcaaacgaaaagtggatctaatgtgggtttctcaaccgatgaaccacaaaagcttccagctactattacaatgtgaaaattccaatgatccgtttaccagagcaattagactatgttaaaaattcatatcatttgtaacttcttttaattactgaattgatattaaaaacaaaatatggctagggcatgtcctattcttctgggcaaatgtggatgaaaaggtcacttgctacctttgacaactatgaacatgatggttaatcttctttcttttttttttttttttttttgagaangggagttttnactntgggntcgccnnnggngtggaanttacagggtgggccacaactcttgggcttccaccgtggcaaacctctcgcgccttcccccttcgcgacctctccccgagaaatgtcaagagcactgtatccatcgccgtgggccatcaaggccttccccagagttgaggcgtggagaaattttattgagggcgtgtgtatacccaccacagacgcgtgcggctaaaatcttgtgaggtactcttatgagtctgagaagaagagcggtgtttccaccaagtgttgtgagaccaagaggctgtggggcgtccaacaagaaacctctcggtgtaaacccactccagaaatggtgtagttccacgaacacgcccgagatatgcgaaggtcctctccccccgaaaagagatggtggtcagtcggggnagaatatataattatgaggagcccatttgttagtgcgacaagattgtggtgcaacctgttgtggggcacgaagggggtataacaatctcctgttttccgctattantcacaaaagaagaagaaaggtttctagtggggacatctattgtgtgtgtatgaaactcg

SEQ ID NO: 161083 - DNA, 665 bp, Homo sapiens
gttaactctttctctaccaaggtgtttttaaatttcaagtctaaatgctttgtatacttaagaattttctacaagtcataggctaattcataatatctgcatacgtatctcctccaacaaagctgtcaattatatcaactccaaatatgctactaaaatgtatattcaaagactctggttcaattccaagtgaaacagctgttctagaataacagaagtatgaaactattatttatattcatgaatctgatttcagtcaaaattcagaagatattgaaatctacagaacttcaattgttatgtaaaaattcattcaaaataattgtgctttcacttaggactcagtaatacacagaatttagaaactggagaaatcatagcaacattttgtaaagcctataacaaagttccaaaatttagaaatttatcagaaccatgaagagtatttgaaattagtgaaaaaatcaagaaatgtaagtcatggttctatttttatctcctcctggaactgtcaattatatcaaattccaaatatgctactaaaatgtatactcaaagactctggttcaattacaagtgaaatacagaagtattaaactaatattaaatgagtattaaactaatattagaaatattattttcatcagtattgaaaataaagacct

SEQ ID NO: 161084 - DNA, 299 bp, Homo sapiens
gttctatctcagaggtttaaaaacaaaaacttgagatagaacttaaaggacatagaacaatctgttgaaagaacgatcttcgggaaagttatttatggaatacgaactcaaatcaaattcattggtcattcatccccttgaaatcagattctgcagccacctggctttcctccaaaagtcttccattgtttcataagccatcctcgtttccaattcatttttctttatccactgtgtaaattaggtggacctgaatatttagaaaagattgaaagcatttggttgttattagagtaaag

SEQ ID NO: 161085 - DNA, 308 bp, Homo sapiens
gctacttggaggctgaggcaagaggattccttaagcctgagagtatgaggctgcagtgaactataatctcaccactacactccagcttaggagatagaatgaggcctcatctctaaaaaaataaataaataaaaaatgaaagaaacaacatattttgcaggttgccaccctggggtgaccccttttcactaattaggtgccatgatgtgccatcccaaacttacccctctctctggcaaaactatgagtgttgctaacctgggcgggggcaggggctgcagcctcccagacgctgacctttgcaggat

SEQ ID NO: 161086 - DNA, 628 bp, Homo sapiens
cgcagtccttttgtttggaactgacagcctctgcttcctgtggtggctgctcttctcctccccagcgtaggcagctctcaaggggtcgtctctcatctcctattacaccctctccccagatgctcactcctgggcttccaaccaccatgctcaggtaatttttaaatttttttgtagagatggagtcttaccatgttgcccaggctggtctcaaactcctaggctcaagtgatccccctgccttggcctccagaagtgctgagattacagatgtgagccaccgcgcccggcctcccgcctggagttttttaacagcacttagcacccatactgggtactttctggcatttgctcctctttccagctctttgtaggcagagtacagagaggccacaaaccccgggggcctggcatctggggtgtgcacctggccatgactcattagaaaaggcggagagagaattagaactggagaccttagcttctccaagaggagggttaagtcaagatgatgccacatgagggcagacagggttttttctcattgaggcttctttgattttgaaggcaagtgtgtggccacaggccatcctttcgctcagcaatccttgagtgttgattccatgtc

SEQ ID NO: 161087 - DNA, 282 bp, Homo sapiens
caaacatagactgaaaataaagggataaaaaagatttcaatgccaatgagaaccaaaaaagtgcaggagtagctataccaatattagacaaaatatatttcaagacaaaattataagaggcagagtgtcagttcaccaagaagacataacaattttaaatatatatgcacccaacatttgagcatccagatatgtaaagaaaacattattagagctaaagagagagcccccaatacaatagctgtaaactttaatgcccaactttcagcattagacagattt

SEQ ID NO: 161088 - DNA, 315 bp, Homo sapiens
cacactaccaaacagatgggagcattccaacttcgcattgctgataagccctctatcattattgacaaactaaaaaacattggcagtcactattgtttaggaagacacctaccctgcatctcactccatccttggctaccctccgcttgctcatctgactctcctcctgactcctcctcttgcttgcttatacccagccccatcaatagcagtgaaaggttactcatagatactatgctctttctcatataccatgagaaccaaacctttcatctacacaattgcaccatcaatccccattacaacctctaacag

SEQ ID NO: 161089 - DNA, 284 bp, Homo sapiens
ggttcattgtacacttctgtatgtttaaatactttaggtatttcataattttaaaaatcaaaactatttaaactatttcacaaactaaaaaatttaaaacatactgacaagagactttgaaaggaggagtcaaaacaataaaattatgtctggcattcatgtgcaaaaatgaaatttttaggttgggtgtggtggctcacacctgtaatcccagcactttgggaggccgaggcacgtggatcacctgagctcaggagttcgagaccagcctagccaacacggcg

SEQ ID NO: 161090 - DNA, 220 bp, Homo sapiens
tagaacaaatgaacagctccatcaccaaaaatatacataaatattttgcatttgaagagtgtgaatgttgtacctcactgcaaatgtactgtccttaaaaacctccatgcacacctcactgagggaatgtgtgttttctctgtgccagctatctaaatgaccccatgctgcaaacgcttttggaaaataaacactctcacccacccacctagtttctctt

SEQ ID NO: 161091 - DNA, 152 bp, Homo sapiens
caagctggaaatgaagtccagatctgtgtcctccacagagctctttccattggccatggaggtgtcaagaataaggctaacctagtaatagtgacaaaatagctgacctctctgccacatcatctggtatttccattctgaactgattgctg

SEQ ID NO: 161092 - DNA, 212 bp, Homo sapiens
tatgatcgtgccactgcacttcagcctgggcagcaaagtgagaccctgtctcaaaaaataaataaaaaaagtaacaaccctagtggttgtttagggatatagatacttagggtctatctctacaccccagatgatggttaaaccctggagaaagatttaatccagacgaattttagagttgtcactgagaacagtcccacccccttgcccca

SEQ ID NO: 161093 - DNA, 115 bp, Homo sapiens
atataccccttttgatatattaattctactctaaaattcttttttattttatcaagtctaatgctattatttatcaagaattagtaaaggaagataaatattaaaaaattaaaat

SEQ ID NO: 161094 - DNA, 567 bp, Homo sapiens
gagtacatcaagaggaagaggttgcttgattcttggtcctttagatttttaagactctttggccagagttttggaaaagggattgtgtcaacaagcaaagttgtggtttcaggactgccttagaaactttttcaagagaagaaacaattctctactaggcgtaaatggcacccaccttaatttttagcctttgctttttggtgcctgtagggggagcccttgatagcagattttattcccatttcactggcttggaggaaaacaccaggagttcaagctgtttaggtaattttggcgtttggcccacctgccccagctttaaagaacagtaacttgtacaagcaatgctgactgatgattgtcagtcacatgtgagaagagattagaaagatgagtggcatttattaattttttcttaaattgtaagcttggcttcaggggtgggattgattattccagcatgtggatctgtgcacaaccaggtgactcattaagcccatgagcacacacggacaaggcattgactttgtttctgtgtttgtgactttttttcttggagagaagaaa

SEQ ID NO: 161095 - DNA, 207 bp, Homo sapiens
taggctgtgcaaagatgtgctggagttcaggaaggggggtgaggacccgttacaaattttcattctggaacaggaggatccatgcccaactgggacccttcaggctcccagttgccctgccctgtctctggctgcctggacttcacagagggagaacaacacgcgggcggcagctgcagacaccggatcccggagctgctgggttca

SEQ ID NO: 161096 - DNA, 478 bp, Homo sapiens
  misc_feature (20)..(20): n is a, c, g, or t
ttacatgatacaatcgagtnggtacctgtgggtagcaacaaatcaatttctaacactgtttcaccaaagtgttatttcaaggttggagttcagggaaagaagtaacagcatttaagtctagctttgctttcacccattggtattgtatagataccaaaacaaatcctaagcctatatatttttataaaagcaaattatctcgagataatttttttgaaatttccttgctatacctagttttcaaacacaattaggtcagaatttaaacaaattttgtccttttattctctgggacagaccccaaaacagaaatgtatacagaacccctgcaatacttgatgagtaagtgataaattcaaaagaaccagtgggaagagtggaagagagaagcatgagtggcagacaacatgcaggttaattttcagctttcaaaaacaaattgtaaaaggttaaaatatttttagggttgttgcttcca

SEQ ID NO: 161097 - DNA, 405 bp, Homo sapiens
aaaatcattgagacctactgctcaggaaaaaagaatcctttcaaaatattattgctcattgacaatgcaccttgtgacccaagagctctgacggagatgtatgtaaagatgaatgttgttttcatgcctgctaatgtaacacccattctgcagcccatggagaagggataaatttgattttcaagtcttattatttaagaaatatattttataaagcagtatctgccatagttagtgattcctctaatggatctgggcaaagtaaattgaaaaccttctggaaaggattccccattctagatgccattaagaacacttgtgattcacaagaagaggttgaaatatcaacattaacaggagtttggaagaagttgattccaaccctcatggatgagcggtttaaga

SEQ ID NO: 161098 - DNA, 111 bp, Homo sapiens
tccaagcctcattgtgcaaacacacctgcttcaaggtcccaggcacagaaggctcagatccgtgcactgccttcagctctgggttgaacttacagctggactagaggatgg

SEQ ID NO: 161099 - DNA, 176 bp, Homo sapiens
tatcctggccatccatactgagacctaagaattaatcttggaagcagagatcacagactttttatgttagaaaggacttttaaatctcattcagcactgaatgtgagatacaaatgtcctccacagctttcattgacagacatttcactaagctctgccctctgtgctagtcgggg

SEQ ID NO: 161100 - DNA, 507 bp, Homo sapiens
ctgcctcctgtttgctcagaacatgttctcaggcctaggggagcctccttcttgaaccccagaatgggtgccacagtcccaggcttgccgcatcctggaagttcaccctacttcagtatgcagtcagatccaggtacgcagggacgcagtgtgcggtcagacccagttatgcagggatgcagtgtgcggtcagacccagttatgcagggatgcggtgtgcggtcagacccagttatgcagggatgcggtgtgcggtcagacccagttatgcagggatgcggtgtgcggtcagacccaggtatgcagggatgcggtgtgcggtcagacccagttagatggtccttaaacatgccatgctgatttgcccctgggggcttcacttgtgttcttccattgttcctcttttcctcacttccttcaggtttctgtacaaatgtcgcctcctcagagaggcctcatctgaccccattcaaaattagcagccacacagaggtataatatgctgag

SEQ ID NO: 161101 - DNA, 706 bp, Homo sapiens
gcaataaactctcggtcactaaagctgtctctctgagatagagaactaatcaaacctacaacacaatatactggccactgtattgctcgtcaaaggtgatagtaaatgctttctaagtagatgagaaagaacatttcagaattttcccagatttgaaagaaaagacagtccttaaattatttcatgaaaaaatcaagaaaagtcacaacaatttctgactccaggccatacacaggccttcttcagcttcaggaaaatcacaaaggatcactttctctcagaaacactagcttagcttaagtactcagtgtaatgcttcagagctgtgctatctaatacagaaagcaatagacacatgtggctatttaaattaactacaattaaataaaatggaaaatgcagttcctaagtcacactagccacacctgaagtgttcaataaccacatgtagctaccatgttggatagcacagatagagaacatttctatcattacaaaaagttgcatcagacagtgctactccacagtaaccaagtttagagaaagacagtagctttttaacaactctttagttcttcagaaactttcataagtggtgttgtaacagttttatgaatccatgctttttaaagtttaggtactgaggccacccaccaatgaaatgaaatttgcttcaaatactatcaacctagaatggagcatagaa

SEQ ID NO: 161102 - DNA, 338 bp, Homo sapiens
aaagcagttaatacagactcatagttctgcacgccaaggtggcctcaggaaatgtacaatcatgctggagggtgaaggaaaagcaaggcacgccttccatggtggcaggagagaaagagagcgagccgggaacttctacacacttttaaaccatcagatctcctgagaactcccccactatcaggagaacagcatggaaaaaactgcccccatgatccaatcacctaccagatccttcccctgacacatggggattacaatgtgagatgagatttgtgtggcaagacagagccaaattatataagaatgcaccatcctgagtctgtattaactgcttg

SEQ ID NO: 161103 - DNA, 560 bp, Homo sapiens
ctaaaggatcccccacaccacctgagtcgaaattccactgcattacacatttatgcatttatgctggagcaccataccagccccaggaaagactgtagacacttgaagatggtccaacattatcatataggcaataagaaagctctgtcaagcttatagaacaaagagacaagtattcagcactaagcaatcctctaatttgttcaagctaaaaatgagcagttaactctggatatgagtaggaaaaatttaataactgaattgagagtttctctaattacccatgcatctctaagaaatatctatttgaaggactgactggtgatgaaaattatagccatgacaaagctcatagaggtgactagcccacggctatcttctctgatgtaacctagggattctccaacagaatagctgactcaagctcagctcacacaatactacttcaatctttctcaatccacttctctgaagaacttgtttcttaagttctaatgtttaatgtgacaatgaaatctgctctacagatggaattgaattgcaggcaacgtccatctaat

SEQ ID NO: 161104 - DNA, 338 bp, Homo sapiens
gtacaccaccacgcccagctaatttttgtatttttagtagagacggggtttcaccatgttggtcaggtcggtctggaactcctgacctcgtgatccgccctcccaggcatcccgaagtgctgggattacaggcatgagccactgttacaggctctccaattctcttcttccaaaatagcaccacaatctggtttaacaagttaggttacagtttcataatacagtccctacccttgtgagtaagctctctgcctggaggtctaattcatgtctaattcatcttggattgatgtctgaagaattaacatcacctaggaaggtttatagagactattaca

SEQ ID NO: 161105 - DNA, 659 bp, Homo sapiens
aggcatccttagagatggagtccagttagaggctgctgtggcggccccagcaagagacagtaaagatggctttgtgctgcacacaatcttcagggctgtttgagtgtggggcaggggagcccacgcccaggattagaatgaggcgccctgggcccttctctcactcctctttcctttatgccttgcggatactcccagaaggagaaatgcaaagcacagcaaactatttatgttaaatagactgcaaggtttgatggcatctggttgtcgaccaccaatgctgaggttcctctttgaggggtaggttgaggccagagaaggggcaggaagggcagggggtaaagagagtttggggtcctgctctccattttgaaagcacattgtatgccaagtggaaagctaagcagttttctgtgaaaatatgtgaataaatgagcaggtacacacatacatacacacatgcacactgatgcagacatgcgcacacatacacacaggcacacgtgctcacatgcacacttccgcacacgctcaaatacacatgcacatgcacacattcacactcacatgcacacacatgctcatacatgcacacatgagcacacatgctcatatgcacacatgcgcatacacgcacactcacatgcactcatatatgc

SEQ ID NO: 161106 - DNA, 315 bp, Homo sapiens
tctcaagtctttattcatggtccgtttattaaactctccttggttgcccagattcagtgtgttatccatttcttctgggacttgattgatatttccaagccttgaaatgcctcctcgtcacccacaggagacaaataaagcctgtgcttctttgaagagcacctgaagccacttatgatctgtttcctgcttgctctttccacttcatctcccacctctccttctcttgcgctttatagtcctataatgccagattgcttatgatgcccggaaggggccctattgttttccacctccatgcctatgcctgccaaa

SEQ ID NO: 161107 - DNA, 169 bp, Homo sapiens
taagaaaactactcagctataaaaatcagccatttcttagggaaaagggtaactcagaagacaaaacaaaattctcagcagaaaccagagcctgaaacaatcattcccaggcaccagaactgagaccaaatcaaggaattggtaacgtgtgccctgctgaatttcagaa

SEQ ID NO: 161108 - DNA, 281 bp, Homo sapiens
gaagaggaaatcacggtggagagctgtagaaatcgtattagaatttcatctgtgtagttccttagaaagcttttcattgaaccacctgtttcaatttccattttttaaaaaaataaaatatacctctgtctgtaatcacgctacgatgagcagctgacattcttactcaggacttagaataataatgctttagagtcctgcacgaagcctccaaaagagtggaaaaaatacacaacccttcgaaacaggtttactcaagcacggtgagagaggctgggcgg

SEQ ID NO: 161109 - DNA, 653 bp, Homo sapiens
caggttggttcctaacccacaaaatctgtgagataataaatgttgttttaagtcaaatttgggatgtactttcttatacagcaatagctatctaataaaggcaggaggaaaagcttatttgtaataaattatttactgaaaacttggtcacataaatggaaaaaagcattcttgatgccatgcctttgcatttttatcatcaccccaacctaaaagaagggttctttatcacatgtgtttacaatgtgtcacataggagttgggtattgtcctggttctctttgcccttatcctgcattttttcaagttcctccaagaaggggtgacacagcgaacctctccaattgatcttatagattaggggcttctacttttcacgatagccactttttaaattctatcatttttagctttgccatacaatttgattacattccttagtgaaacatcaatgctcttattttgaatatatcacaaattcgttaaaatatatttacaaatacctctatgtttcctaaagttataataatccctagcagaaaacactggaaatagaaaaaaagagaaaaaaaaccttcctctatagttcaagaaaattagcgttcaaacttagatgataaaacatgaaatgaaaattcttgatgaaaataatt

SEQ ID NO: 161110 - DNA, 596 bp, Homo sapiens
aacagcctgtgcggcagtggcacatcctcactaagctggttatgaatataccagtgacttcaactttggcatttcattcatacttctgtagagaacggaaaactattgtccattaacatgatatgctaaacattctataaacattcttgtatttatgtgagacttgccgtagatggaaatggtagagacagataaagatgggagattggagataggtgggagttgggagagggaaagggagaaacagagagaaagaagacacagggaagaagataagtaaggaaagaataatcttaaagcctgtgtattacttttttgtttaaggtatacagatggtttggaaccagatcattcttaaaaaacagagtatagtggataacagtgtagttgttggagtcagaactaatgactagaattagaatgttggctccaacatgggagagggagaaagagagaagggaagaagagaaggaaggaacgaagaaccttaatacatgcgcactacttttcttaaaagtacacagccactgcactccagcctgggcaacagagtgagactctgtctcagaaaaaaaaaaaagaaaagaaaagaaaaa

SEQ ID NO: 161111 - DNA, 504 bp, Homo sapiens
attccatctaggacagctgagaaatgatagatgggagcaaactgagaagagagacatcaaattattacagtccttaacttttaaaagtttagactctagacactatataaataatatcaaaagagcatacatacacacataataggaggcagatctcaaataagtgctatatttgtactgagaagaatttagttttgcataggaagattgggaaatgattcttacaggtgactaaactttactaagccctggagtcttgacagaggaaattaatgaggcaaaaattggaggcagtagctctttagaaaatatgggaaagtggcaactacagaatatttttgagaaagttaattaatgtatttaatcattaattaaacaaataattcctgaccatccattaagaggttctggggctacattgtgggatatagcagtgaacaagaaagatgccatccctcctcattgatggcagtgctaagagatgtacttggggaaatgggggca

SEQ ID NO: 161112 - DNA, 656 bp, Homo sapiens
aggatatctgcatattctgaaaatatctctccataaaatacttattaattagtaagtaccgcctacttattgatgaattttacaatggagaaacctaatagaccccatgttaaccaagtggcaaaagttgacatcaccaacattgggacaaatgaatggggtgtgtctcctgggatgtacagagaagaacatagcgttggtcctgaggcattcctaccaaaaatgcagaaataataaggaagctcagataatcccaccttaagagacatttagcaaggtagctggactctacttctcaaaaatatcatggttgtgaaagacaagaggagactgaaggagactagagagacgcgacaaatgtatgcaacgtgatattcgatgcagacagcagaggtggaatctgaatggagtctattgattagttgtaatatcaggtcaatggtaattcctaattttgatggttgtactggggttatgtcagagagtgtccttatacttagaatatgtacagtagagtattatggggatgatgagacattattttgcaacttattctcaaatgatttagaaaagtcaacaatcagaattggagtgaaacgtttatgggagctctgtgaactgtaactacttttatttaagcttaaagtatattaaaa

SEQ ID NO: 161113 - DNA, 159 bp, Homo sapiens
acatacacagatacacactaaaatgtattaatagagtgtaaatataatctatctctcctaatagggtgatactttaaagagcaaaaatgaggacaattcttggttacaccggaatacaagagtaaactaggactactcaagataggctggatatatata

SEQ ID NO: 161114 - DNA, 270 bp, Homo sapiens
cacagcttctgtacatgtgtagtcgtctttgcagatggcatatgtggtttccagatttgccaccttatcatagtgaatgcaaagcatgagtgaacatggaggactgaatatgtcgtttaatatgtgttagaaggcaagtggctagtctcttgaggtgagagatattaattgccttttaagaaagggaatggttagagaagaaataacagtgtaaaaaaaaaagtgactacctaagttttataagtgagatgagctgttacaaaataaaat

SEQ ID NO: 161115 - DNA, 393 bp, Homo sapiens
atatgggggctcagctagaggaaagaggacagagccatttcattacaaaattccattctcagaactcaaagctatggcagacagagaagctctgaaagcagcttttcaaagtggacagagctgtaggggcgtagagtatctgaaaatccaatttcaaaaagcatctcgaaccaaaaggcaaatggcaatgattagaaaaattctggttaggaaaaactcatgaacactggtggaaaaaaaacaaagcaatataagtcatcagtcaggggtctgagacccacacagggaggtctgtgggctcaaagtggggtggagacagcaggaggcgtgcaggtgggctccaggagcctcaggacacgcctaagcttcggcccatgtggaacagagtatgcc

SEQ ID NO: 161116 - DNA, 362 bp, Homo sapiens
agtgatcaaggtcacagcacattcacttttctatgtcatactcactccaaggataaccttactgaaaggaatgatgaatagaatccctcaaacacattgaaatgtttttctttttcttttttaggtacagttcatatgactgaatgatttacataaattagtgttcaaattatgagaatctactatgtcatataagacagtcctaaagattttacaatgtagtgactaaagtgaaacaaaaatgctaaagctgttgatgaaactgagataaatactgatcccagaatatattttaagccactaaataaatggacactgatttaattaggaaaaacaattattttgtttaaaaaaaatgtaaa

SEQ ID NO: 161117 - DNA, 526 bp, Homo sapiens
tccagtcctcacctgtcaaatgaacaaattcaaagcactttgctcatggagtgaggattacattagagaacgcagataacgtgctcacttattagcacactgtctggtgcaaagaaaccgcttgggacatgacagctgtcattaacaatcccccaggctcccatgaggccccagctcagatttctcagtttctcacctttgactgccccttacagtcacctggggagcttcacctggtctgacgtcatcagtctggctgtggtctgggcctccctgccccgttaattttgcactgtgcagccaggattaggaatatggccatggactgggcgcggtggctcacgtctataatcccagcactttgggaggccgaggcgggcagatcacaaggtcaagagatcgagaccatccctggcaaacgtggtgaaaccccatttctactaaaaatacaaaaattagcggggcttggtggtgcgcgcttgtagtcccagctactcaggaggctgaggcaggagaatcgcttgaa

SEQ ID NO: 161118 - DNA, 292 bp, Homo sapiens
tagaggattagtagaaactgactcttctagtggctaatgggaacctggcctgccacagaaggccacgggttttgagaggctatagatctattcagattatatgaccagtctgggctgagcacagtgggtcacaggaggaggggaacaaaaggagaaggtgtagtccagcctttgagcagcatcagggtatagttggagtgatccaaggcacaccctaaaaacagtgagggaagtaacccttgctgaggaagctaggactgtgggaaggacactagatggcagttaacagact

SEQ ID NO: 161119 - DNA, 560 bp, Homo sapiens
aggtgatgctgggctaaactaagaaatggtggcaggtctggagaggatggaatagagatgccaagagcaagcaggattcggtaatcgattggatgtagacatgaggaagagggtagtatcgagaactgccaggtttctgccttgattcactgtatgaaatagaagagggccacagagaggtagtgggctttggaggaaaggaagaaaatgccatatttcaagtctggagcccaacagagaaagatctaggctggagattaaaattttagccaggtgcaatggcttatgcctgtaatccaagcactttgggaggctgaggcaggaggattgctcaaactcaaaagtttgagaccagcctgggcaacatagggagacctctgtctctacaaaatatcagaaaattaaccaggtgtggtggtgtgtgcctctagtcccagttacttgggatgctgaggcattgcttgagcccaggaggtcaaggctgcagtgagccgagcactgcactctgagcactgtactccgagcactgtacaacacagcaacaccctgtctcaaaaata

SEQ ID NO: 161120 - DNA, 481 bp, Homo sapiens
ttccctaaggacttagtggagggggaaagttgtttttggtactacttggtgggaagtaaggggaaggttggatcttgggtttggtctacccacccaagagaaaagactgttaactggaagaaaaaatatatatataaaattttaaaaaaaaaaaaaaaaaaaaaaaaaagatttgcggccgcaaatctttttttttttttttttaataaagcataacaaatttatttaattttaaaaatcaaagtcttgcgtgacactggaaccttcagaaatgacacagatacccaggggaaaactgctgtttttttatgcttaggtttgatgaagaatgggctgtaaaccaaaaataaaatttgaagcccttcagccatctgaatgggcacctcctctcggccaagggcattctaaagttaacctgaaaaactagttcaggtcatgatcggaaggggggagtcagacacgccttgttaccattcacgtc

SEQ ID NO: 161121 - DNA, 219 bp, Homo sapiens
gaataataaaaacattaatcccctcaaatggttcaccttagtataacttactttgcttcagtagaacaagttcctcaccagtgcaaataagataggtaggtttaggatacagaagtgcctcaaggtactctttccctgttttggtgaaccttttctagagaatgaactaccatacaaagggccattctgacaaccagttaaatcactcattattgcttt

SEQ ID NO: 161122 - DNA, 142 bp, Homo sapiens
ttccatggcaaagtgctcttagctgcagtttgaaagggatctttgaaagccttttccccaacacttccagccattggaagctgaaaccagcctcctggacgccccttgccggaatgggcagcatcactcagccagaacaacg

SEQ ID NO: 161123 - DNA, 617 bp, Homo sapiens
agtgaacttcggtgttaattcttaatataactcatgttttaatttgtttctgctcaagttaattgttctgttgactgacaggcctttcccattagagccaccaccataagggaaacttcagtaaagtgggttataggactgaacctggaaactgcagtggacacctggaattcttgtgcaattcattgaagccatcgttttatgtacttagtgaaacacacttagatttgactggcctttatccattgacttgatcatttgcttcagtttgatatagtaatggttgcagagggcaacaaaaggaaacagtcttgctaaattttgtaaaattgtttatgtatcttactatgattcattctgaattttaagaggcaaaggaattctccacttgtatttatctgtttgtttcttaatcatcacaccatatagtcttatactgtacacattgaaaacacttatataatatacctcctctaactatattttttgcttaacataaaggttattttatattagaccgtgaaatttacttttctattgattcactttgtaggcaatactttcttgttacttttctaatcattaaatgccagagcttgcctctgggaatttccata

SEQ ID NO: 161124 - DNA, 411 bp, Homo sapiens
acatatatctttaaaacataaaacagtggctggttttcttttatggttgttggtttattgatatttgctaatttttctacaatgttcacatattatttgttaatacatgaaactcttaagcatctctctaggtatcctgggaacatataaacaaatataaatgtagcttttatttttattttaaaaaataaagttaggccagccacagtagctcatgcctgtaattccatcactttgggagactgaggcgggtggatcacctggggtcaggcgttcgaaaccagcctggccaacgtggtgaaaccctgtctctaccaaaaatacaaaattagctgggcgtagtggcaggcacctgtaatctcagctatttgggaggctgaggcaggagaatcacttgaacctgggaggcag

SEQ ID NO: 161125 - DNA, 215 bp, Homo sapiens
ctttctaatctcttatgtcctgtgagtgtcacccattgagtaaacccaagtggaagtcagcaggaaagtagctgggatgatgcagtctttacaggtaagccttttggaagcacagaacaatggacagaagggcaactaatagatctacaggggtgccctgaaagtgatcagcagagagacttagctattgatttcaatctctcccgtcctctcat

SEQ ID NO: 161126 - DNA, 472 bp, Homo sapiens
tgtctcagtttcgggacgcgagtcccgggcagtagtggagctggatttgaatcccagcagctggactccagtgttctttcatttaatcactacatcgcaccgagatatagaaatgacacccggaaaaagtgaaaagtttatgcttctgtctttattgttttcctgtcaagggaggcagtgccttgtagtcgaatgaaagtgtgtttttggaatcagatacattcagcttcaactctcagccctttaccagcttatccgctgtttgcgttaagtttcctcatgtggaacatcgtgatatgaatacctacgacgcagagttgttgtgatactagatactaaagtgtttggattgtattgttacacacttgtccctaaactgaggctgaatataaactgaaaaaatggaaaatgaagtatcagggatgtatgcgtgtgtaggtatgcatttacctttttacaaaaattacggggg

SEQ ID NO: 161127 - DNA, 534 bp, Homo sapiens
cacaggagggattgtgtgtttgagatcatctctggtccagttctttgcctctccctgcatccatgccctttgccacctgagcctgcagcttcatctacttcaggactggctggactcccccacccctgcccactgagtttggctgtttctgtggctccagctagtggcctgttggggaaagaatggtgtgtcagttctgacctaggcctcaaaaggcctgcgtgtttcttttggctctcttgccattgtcataagactatgtctgcctatcccagtagctggaggacaatgaaggacacacggaacagggctgctccagccaaggccgggctagagaaggccacccaagccaacttgcagatgtaggggagcccagctgagattggtggagccggccaaacaaacgtgtattgttcagaaatgcagttttatttatttttgagatggaggtgtctcactttgtcacccagactagagtgcagtggtgtgattgtagctcactacagccttgaactcctgggctcaagtgatcct

SEQ ID NO: 161128 - DNA, 651 bp, Homo sapiens
aatatacatatatcaaaacatattgtagaccataaatacatacaatttgtatttctcaattaaaagtatttaaaaaataatctggctgggcgtggtggctcacacctgtaatcccagcactttgggaggccaaggcgggaggatcacctgaggtcaggagttcaagaccagcctggccaacatggtgaaaccccatctctactaaaaatacaaaaattagccagatgcggtggttcacgcctgtaatcccagctattcaggaggctgaggcaggagaaccgcttgaacctgggaagtggaggttgcagtgagccaagatcgcaccattgcactccagcccgggggacagagcgagactccatctcaaaacaaaacaaaaaaccaatatccattttcaagtataagaaatacatattctctgctgggattacaggcatgtgccaccgtgcctggccagaaattttatagttttacatttttcatttaagttcgtggttcattttgtgttaatttttgtaaagttgtgaaatttagatcaaggttcttttttttctatggatgcccatagcatttatttaaaagttatcccttctcaagtgaatagctttttcacctttgtcaaaacttagttgtgcaaatttgtgtggctct

SEQ ID NO: 161129 - DNA, 151 bp, Homo sapiens
gaagtctcagcaaatttaatagagaagtatgttctctatttaaaagaaaataaattagaaatcagtgtttaccagataggagaataaagtaatcctataatgctgactttatccgtgactagttgtaatcctgcttgaggtgggaccagat

SEQ ID NO: 161130 - DNA, 353 bp, Homo sapiens
cccgggctgggtgttgggatgcgctcctgccttggtgcctccacgagggctgggcattaggggcccacaggccgcagcttcagtccctctggccctctgggttagtcctggccccgcccaccaaccctctgggttagtcctgggtcctccctgctctcctgggtcagtcctgggtcctccctgccctctgggtcagccctgggtctccccactctgccctcctttcttaggtgaaggctctgctcccttagacttggggggaaacaggaaggtctggctggaacagatgactttttctaaaccctgagtccagagcggcgtggatgcctgtgggcactggcagctgacagctt

SEQ ID NO: 161131 - DNA, 333 bp, Homo sapiens
agcaggcttggtgccccagattagatgtcattcctcaggtctaacgagggtctcttattttggaatgtcatgactcccataagctcctgcgccttggttgtacggattagttatcttgctgaacttgaatataggcctcactttatctttcacttaatgacctgacatcttaatctggggcccaagcctgcagcaggcttgctgccccacattaagatgtcaattcagcaacccaactttgtagcttagggagctgtatgtagctggtcaggcaggaatatgggtagcctgggcatcagatttatggttgatatctgaagtggggcagtcctg

SEQ ID NO: 161132 - DNA, 540 bp, Homo sapiens
tctattgcactaacaagagtcccccttccaggcttgacctctcaccttaacagaactaatgaatgtatttgcctttatccctcctattttctgactctctattgcactaacaagagtcccccttccaggcttgacctctcaccttaacagaactaatgaataatttcaaaatttaaatagaaatagtcagttgtataacctatgtttaatttttcattttaagcaccgtaaaatcttaaccattgacatattaggcagtttacagttaaaatatattttgaataaatgcatgtatacttgcctaatgcaatagatacaagcttgaatatttgttccagagaattgagacttggtctattcctgggagctcatttttagacttgcctctgtgctttggtggtgcagggagacatgagcatggctgaggattctgtcaagattgctgaaatcagacactacttgaagatattaagggactttatattgtaaaaccctggaatccttcccagtccaccctcaactgactggagtgcacccatg

SEQ ID NO: 161133 - DNA, 156 bp, Homo sapiens
gaagctttttggttgtatgcaatctcatttgtctatttctatttttgttatctgcttttggtgtcatatccaaaaaatcatttcccagtccaatgccaggaagcttttcccctatgttttcttctagtagttttatggtttgaggtcttacattca

SEQ ID NO: 161134 - DNA, 314 bp, Homo sapiens
atttgctcggaccagcggaacaagcaaggaagtggatgagctgggatgcaaccccaggttgtctggctggagagaaaaacacagagaaagatgccagaaatgaaaggtgggggctattttctcacagaacttaaaatgaattgaggagaggaggccaggggttcccaggtggccgcctgcccacagtgccacgggctggtaggcggttttcttcactagtccacaaataaacgagaaggaagactaggaaatatttaccaagtgaactgtgctggtagaggaaggacagtcttggtagctgttttgcttttgct

SEQ ID NO: 161135 - DNA, 385 bp, Homo sapiens
tttttatttgcccactgtggattattcaaccacaaaaaaatgacacataaattgctgcatgattctactgtccaggaaacccagatagcgtattacagacgccaataaccgagggcccccagatgggagcgttctgagaatgcactgcttgacagacagcatccatcagagcccacttaggatgccgggtgatcgaatgcagcctagtcgccctctcatcttctcctgaagcatccaaacccaggaagttagcttcctcccatcactgccaactcctagtgaatttcagagccggccacacagcaatcaaagctttcagaaacagaaaatagagaccaagcgcagggcaaaacgtcccctagtttgaaattaagagcagaaattc

SEQ ID NO: 161136 - DNA, 281 bp, Homo sapiens
aaaattcttcctgatatctgttgaagtatgcattaagaaaataggggcattgcctggaatttaaactggctgcctagatctttgtgtagataccactctgtactgtctgcttagacatttggctttttactataccccaagtgattaagctctaggtattcaatggacatatcagaacatcatcaatttatagtagggaagaatgtctttcatactgaccaattcctatactaatggtcagttatgtgtgaaatctagttataatcaaaggctatttggtg

SEQ ID NO: 161137 - DNA, 560 bp, Homo sapiens
ataatgagcagttcttttctccaggggaataacgtttataatttcacccaatttttttggcaaagatagaagttctatttttaaaatgattttaaagcatagtcccttttttaagattaaaatgtatttgaaggtactgtcaatctctcaatctttattctaagcttgatttcttaatttgatcttgttgacttttttactagtgactcagaccttattgcattatatttattgtgttataaagcaattatatacttaaaattataataagatttgttcttgtctaaggataattcagcttctaaattaattattttcacaacagcacagcaagttagttgttattcgccattattctcattatgaggattcagaattaataaactggtaatgactggtagctcaggtcttcagaggtaaatggtttgcccgaagtcaaatatccaggaagtaataaatcaggaggaagcctggttctttcttcatcttctgccccttttccgttttgccatgggtccacaagtgttataaaataattgtgtctgtggttattttggagg

SEQ ID NO: 161138 - DNA, 418 bp, Homo sapiens
ccacacaagagtcatttttatgtgcaatattttatttctcaaacttggtaaattttaagtgtgtactatattgtcagttcattttggatgcttgaaagatttcatcattttctttaattgttcaggaatgcaactttcataccatatccaagcttttggccttgagaatcttctgctcagtcatttcttccctccttctacatattctccacagtctccctcactccacatcactaatctggaccccatgctttctttcaatcaaaagatgtcatttatttaaaatttaaaatccaaacgaccctgaaatggtttgcattttaaaagaagatttaagtagaaagggctttcaagacctaaagaagtgacattataagggtggaacaattctcatggggtcctatgtgacatctgctca

SEQ ID NO: 161139 - DNA, 354 bp, Homo sapiens
accatctcaatatatcccacgaggagcaggccacaatcgccctgcaggtaaccatttcctcagaagcagagattagaaccaatacaacatccctgagttggggctggacattcacttagtccaaacagctccccaacaaaagttttgacccttgcagtcactccctggccacagtggtaccagtgggagggcagttactgctaatcagtcagtcctaaagtgctgagggaatcagaatgtgggtatgtacttagagaatcactaaaatgagaatgaaaacttaattcacgtttggtttgcttattctagaaataatctctctctctttctttctctctctctcttttgtaaagc

SEQ ID NO: 161140 - DNA, 326 bp, Homo sapiens
tactaccagaggtcacagtcaaagaatcgtacaccgttttggagcctactccagtatagatcaaagcaaaggcaagggcaataaggctacaccaagctggggcagtttgggtggagatagaaagacagtatgagagaaacttagtaaaatattttgtctccttcctctcccagactccccaaactctgtctgtttatctcttgctaccattattctaaccttaagtgtatcacatcctgtgaaataggactactagaatggactactagggtgacaaagaattccagtttaattccagtttatgctatgtatttccatacaccaac

SEQ ID NO: 161141 - DNA, 397 bp, Homo sapiens
agggtgactgcccccatgtggtctagtggagaggatgtttggtcaggcagctgggaaggacggccttgctgtgtgacaggcatcgatgggcgtccacgccctccagggacgtcctgctccaggtggttggcactcacgttctcctcgctccccatgcagtgactagaaagcctgtgtgggattctggcaacggcatccgcccgccagcccctcccagggggtgccccagggcctctgccctctgcccgcagctcctcccccacagccacgcttccacccacccgttcggctgggctttgggtgggcaggcagacgtagaccctgcttggaggcggtggccctagagggatccacagatggggaaaaggccgagacacacgagaccactcctgccggg

SEQ ID NO: 161142 - DNA, 522 bp, Homo sapiens
gcttccttttctgttccactgggggtagagaagtggttatttgtgcccaggcagtgatgcagaagcatggaaaaccactgagaccccttttgctggggtcccgctcgtccccatgagaaggaggtgggccattctacctggcagtgctgtgcactggtttataggtagcttgtggcttccaagagtctgcactgtgtgaagaagaaactattgcagaagaaaaatgcctctacttttctcttggtgcctagctcagaaggaatggagtccattgtcattccaaatggcatttcctagaatctgggtcaccctgcaactccctgagcatgtgtggctctgagccctgcgctcgtttgccagctgctgaggctgcgattgtgatgtggttctaggcaggttcggggtgagcaaagcccagggtgcgacagggtgatgcaagccacaggaggagtcaggacctaaggccgggctaaatcttgatgccagcattgtcttggttgcttcctttgcagccctgaagac

SEQ ID NO: 161143 - DNA, 279 bp, Homo sapiens
ggtcttcctgtgttgcccgggctggccttaagtgatcctgctcagcctctcaagtacgtgggactataggtgtgtgtgcacaactgtgttcagctaacgtttttttcttacagcgtccctacccagtttgggtataaagattatgctgacctcatgaacaaactggagagtatttcctctttctattttctagaaaagtttgtataaggtaataatttctaactgagtacaatggctcacatctgtaatctcagcactttgagagaccaaagcaggagg

SEQ ID NO: 161144 - DNA, 451 bp, Homo sapiens
tgtacttctaacagagatataagagaacatgatctaacaggataattttgtctttttcaggaaccttctggttgtaatagaaaaccagaaaaccactgatactaacttaaaggaaaatttagtgtaatgttggggtagaggcggggatctcaatgccaatggtagaaaatgcaattggatctcctcatgagtaggaaagctctcaggaactaagtgagccatcactacttctctaagaatcgactttattctttgacatttctctgtatattggcatttccgctgagttgtacacacagcccatcaaaggctttcccagtgtggctttccttacttcctagttcaaatgcccagccccaccctctggactccagttctaaattcctaggaggaaacaaatcttactggctcatgagctaggcaccgtgtgccaatgaccacatcaacgatc

SEQ ID NO: 161145 - DNA, 174 bp, Homo sapiens
atcaccaggcacccagcttatcttctgaaatgccatttacacttagaatgttcttgacgaagcagtaaaagtttcttttgttaagttttaacccttgagtacactaagtgataaaatggaaatttttaatgataaaatggaaaatttccacaaagcacttctgctgtattccaa

SEQ ID NO: 161146 - DNA, 357 bp, Homo sapiens
aatctctctgggcctccctccaggggacgtagattctaaaatcgtgggcacttgggagagtggcttccgccatacccaaccagcacaaggctgagatctgagctgccaacctcaaaccaagccagcctgtgaatcacggccaagtctgggttccaatcctggctctgccacctcatcactgcatgcccctggacaggtagcttgctgtttctgagcctcagtttcctcacctgtaaaatgggctcacctgtaaaatgggctgcacttctggtttttcggcaagattgagaggtgttatacaaaataatgaaaagcttccagggtggggtctggccacagtcggtacacaaccagtga

SEQ ID NO: 161147 - DNA, 282 bp, Homo sapiens
aagttctagagatctgctgtacaacattgtacctatagtcaacaatactgtattgtacacttaaacatttgctaagagggtagatctcacttaaatgttcttactacaataaaatataattgataaagcaatagaaaaggattcctatacataggattcctatacataaaaaggtcaatacctaatttccatttaattaaaagcaatgaatagtcaatttacacacaagacaatttctgttattgaggcagctataggatatagaagagatttcccaactca

SEQ ID NO: 161148 - DNA, 431 bp, Homo sapiens
ttgttcattcattgttagatgctgggctcagagataagcaagacccacctctgttcttaagatgctctcaggctagttggaaagaaagacatcaataaacatccccacacaaaccagggacacatggagggaggaaggatgtcttgctttggttggaatgagggtaggtttgagtaagagagcgtgaaagaggcaaggaatttgaggtgtgccttgaaggatgtgtaagaggcaacgctgtggacagtgtgggaagaacattgcagatgatgagaaaagagcaaggcatttgaagtctgtccctggtaactgagtgtggctggggtaatggggatgatgggagaagctggggtcagatttcgaaagcccttttgaagcagggtttatttgatctttccctgtaagaagccactacaggattttaggtgagt

SEQ ID NO: 161149 - DNA, 311 bp, Homo sapiens
tgagatcttgaagccttcaatcatgagcctcaaacaatttacataataaatccagaacttggagatccaaaagatattgccatgtttttggttatgttgctagggaactatgcctccgttttcaaatgatacattgctgtgtgtgtgcgtgtacatgtgcatgcatgtgtgtgtatgtatggaatgaggaaaattaggtgtttcatgcttatgcattgtagtgaaggctacagtgttgttaggcttttctgatggatatcataactcaaactacagaatttgtttacagcagtgttcatgtgaccaagaaa

SEQ ID NO: 161150 - DNA, 225 bp, Homo sapiens
tcttgccagttgtatgacttgagcaaattacttaacctccatgaacctcacttttctcttctgtgaaatagaaatgataatgtctaccttacagggttgtagaaaaaactggagaaaatggtagttaagtgcttagtacctaatgagaactccacaagtagcagctatttttgttgtcattgtctgctaacagcatggcagccttggacagcctttccgtctaac

SEQ ID NO: 161151 - DNA, 496 bp, Homo sapiens
ctctagaaatgtaaccaaagtcttgcagcaacccaaggagcatttattcaagaaaaatttctgtaagaacagtgagatttgtgttaacttgccttagaccattcctcaccctctagctcagtagtcgccttggaaaacagcccacatccccaaccagagggagcagaatggagctggagctccttcaaagccttattctcagttaactgtcatgatgtcatctgtctggtggttccctggaagacctcatttgaaaggtttgtctttatttgaccagaatgaaagctgtctagtgctaaagcctctccacagagggtgtttttggaaaacaattacagacaagtgttttaacatggcaactgtattcggcaatgaataacagtttgggggaaaaaagcctaatcaaaaagcttaataggaaaagctgaggaataagatgtccacaggaatttgaaacactctgatatatgcttgggaaactagaagtccataagac

SEQ ID NO: 161152 - DNA, 269 bp, Homo sapiens
cctcagtttccccaacagcagaatgtgactgaggcccaggaaattaaggattccaagagcaacgcagacccagccccagccttatccctgtgtccaggcccagtctctgcctgtccaggctctgccccagggagtccaagtcccacccctgcattctcggacccaaaactctgcaaacaccgacctcactaaaagctgccggcggcacacctcgacacccctcgacacccctcctacagaggacaccctccctgccggcccgggcccag

SEQ ID NO: 161153 - DNA, 523 bp, Homo sapiens
ttcgctcttgtcgcccaggctggagtgcaatggcgcagtctcggctcactgcaacctccacctcctgggttcaagcgattctcctgcctcagcctcccgagtagctgggattacaggcatcaccaccacgcccttctaatttttgtatttttagtaaagacagggtttcaccatgttagccagactggtctcgaactcctgacctcagatgatccccctgccttggcctcccaaagggctgggattacaggcatgagccaccgcgcctggcctgaagctttgttgaggtatagaatgtgtgagaaaaaaatgtatagtccatgtgccaatgattctgataacacaaaatatgcttagcaacaattctataataaaatcatcattgtcatctggtcttaacttaaaaagtgttatagcattaataagctgtctttaatagttcacctgaaaataagaccaatgaagccaatggaaaagtaaatgtattttataaaagattctaattgaactattcctaactaga

SEQ ID NO: 161154 - DNA, 513 bp, Homo sapiens
  misc_feature (433)..(433): n is a, c, g, or t
ggtctgttccctgagccaggctggtaggatagaagctgtctttctatggcgctgaaaagcagtaggatgtaagcctggagttgccgcaagcaggaagaacccctcagaggaggaggccaacacagcagacggcagagccaagagaggtaaagagagaatccttgtcatcgtttgatccccttgatccagctatgcctgaaactccgaacttttcagttacatgacccactcaagtcctttttgtgcttaagtcagttggactttggtctctgtcacatacaaccccccagaaataaagggtttaaaaatgtgggagtatggtcgggcgcggtggctcatacttgtaatcccagcattttgggaggccgaggcgggtggatcacgaggtctagagatcaagaccatcctggccaacatggtgaaaccctgaaangggggcaatgcagtttagtacattttctttgtggctgaagcagcataaacttaactactgatatattcgtttacttatca

SEQ ID NO: 161155 - DNA, 167 bp, Homo sapiens
accctgggcagagacccagtgactttgcaacagtctagagcagaagttccaacatgccggctgcttttccagccaggccatcctgagacctctgcgcccatcaggaaccggcactgtctttgcagctcccagccctgcctgggccagagtctaggagggtagggagg

SEQ ID NO: 161156 - DNA, 760 bp, Homo sapiens
agtcaggccaaccacagcagcagtgacgacacacatacagcgatggcacgcagggatcccgagaggagatgcactggggagacccaggcatgccacgtgtgcacgtgaagggagacaaactgaaacggaaagggcagggagtggtttcagggcccaacatcctgattatcagaagcacgatacacctgctgtgacaacctggccctgcctctacaacacggaaacgcccactccacccagcgacacgcgggcgcccctcccagagggccatggcacacatggacatgtggacacgcacgcaccacatacacacacacacacacacgagaggacacgtgctcacacgggcaggcagggggaaggaaaggagcccgaaacagctggagaggtaaagtcaggttagaaacagagtggaagagcagggagagtgtgagattgactgctgaagatatgagaacgttagagttatttggccacgctgcagcgtcggcacagctgccaagcagcctgggaaagatagtcagcgccactgaagctgtcggaggtcacaggacagagagacagaggtgagaggcacagagagaggcagagggagaggccgaggggcccatcaccggcccagggcagccctgtgaggagcagatgggagaaaggagacagaaggagagagaggccaagaaagttagtcagagacgggcgaaggctgccgggtggacgaggggacagggaggagcgtgcggccaacaggagaggcagagag

SEQ ID NO: 161157 - DNA, 362 bp, Homo sapiens
taatctatgctgttagaaggcaagagagtggcctcttatgaagtggatgactgaaaggaagcatcaggggttgacggggttctggtaatgttctgtttcttgaattgggtggtagttacacaggtgtgtacacatatgcatactttttgtatatatgttcttcactgcaaagttaaatagaagttgatactatttttaaacatatggtctataatttttaatgattttgataaatttaacacaaagggaaacgattacattatcatcatcatctaatatttgagtcctaacaatgtggcaggtacactagtattttaaaagcttaggccgggcgtaaatggctcacgcctgtaatcccagca

SEQ ID NO: 161158 - DNA, 359 bp, Homo sapiens
gcctggcacaatgtctttatgtgttgtaggcactcagtaaattttgttttgtatgatccttaagcataatagacagggaattgttccccgaaccctttatacttctattttctattcacttatgggtcctttctgtctggtttaaaatcttccttgcttttgatataatgacttatcttttatcatattatcttaatagctaaataattcattcatgggatataggcaatatttcctcacattcaattttttcaattcaaaaattgaattcaaaaattaattcaaaattaatagaacacagaaaaaaatattttggttgcccatgacatgttttgaagtttttaaggatatgtcatgtt

SEQ ID NO: 161159 - DNA, 227 bp, Homo sapiens
tcaaaagaaggcattgtaaatggattgaattgaattagcacttttccttgatggcttttgtatccctaatgatgttgctcagcattatgagggcatgtcttaacagtaatatacttatgatcagtaaaatctttctgcttagtattttaaagttgagaagataattaattgatttttcatcctaatagtaatgactactttttatttaaagaggtgaaaataataat

SEQ ID NO: 161160 - DNA, 598 bp, Homo sapiens
ttccaccttctggacttaagcaatccttccacctcagcctctcaagtagctgggactacagctgcacacgactgcaccctgctcttttgcctatttttaaattgggttgtatgtctttttgttgttcagttttgagagtttttttgtgtgttctggatactggaaccttatcagatatataatttgcaaacattttcccattctgccatttgtcttttcactttcttgatagtcctttgatgcacaaaaatttttattttgatggtttatctgtttttttcctttcgttgctcatatttttggtgtcgtatctaagaattcattgcccaaatctaaggatgtaaagatttacccttgtgttttcttctaagagttttataattttagcacttaaatttaggtctttgattcattttgagttaatttttgtatatggtgtaaggtagggttctaacttcattttttggaggggctattcagttgtcccagcatgatttgttgaagggactatgtccctttgaatggtcttggtacctttatccaaaatcaactgatcatagatacaaggatttctctggactctcaattctatttcatt

SEQ ID NO: 161161 - DNA, 287 bp, Homo sapiens
ccgagatcacaccaccgcactccaggctgggtgaaagtgcgagactccatctcaaaataaaataaaataaaataaaaaaataaaaacaatgagagaagttaaaaatcatagttcagatagatcaattaagtattaactgtctctttatgtttattcatagattggaaaagaaatctggggtttttcttgccatatgattttgtgatttagaacttaaagatataaaagaaactaacaatctttctaagcataccgaaataaaagcaattctgcttaaagatgaatct

SEQ ID NO: 161162 - DNA, 212 bp, Homo sapiens
ccacctcagagattacttaagacaccttctggtgcagcggttacaactcagttatcatccaagataccgcctggtgcagtgttccctcctcagggttatccaaaaaatctcctggtgcagtagtcccttccgggggatgaatgaagacacctccttgtgcagtgctcccacctcagagattatttaacacacctccttgtgcagtgctcaca

SEQ ID NO: 161163 - DNA, 442 bp, Homo sapiens
atgacagagtaagaccctgtctcaaaaacaaaaaacatgattctttttatcaactttaatgttagtgtattctggcaataggaccttttaagaattttgcttatttcattgagaatttgccttaatgtatttttaaaatttatcattggtcgcaataaacattaatataaaaaagtacctatgaggtattctgaacagttttaggagcgtcttggtttttcctggggcagaggcaatgaacctatgctaaatttcataggcatttcttatacagcccttcaatttgccccttaaagtgttaggtcaggatgaaaagctatttcaagtcagtagtaacaactggtttattttattgcttgcatttggcccaccaggttggtggctgatgaaatgtgtatgaagtaacaggagtctttgctgagtgatcatctgtttattcttt

SEQ ID NO: 161164 - DNA, 430 bp, Homo sapiens
ctgtagacttggtaacaataaagaactccccaccagatagggttctattgtctccgttaagtaggagttgtaaagacatatactgagtgaggcagagggggtagggctgaaggtttacagagagtacctagctgtgttggatgcttctgttgaaattggtatctaagtcagattaaaaatctggtatgtttggccactgcagccttaaatgagcaggtgatatcatatgaaactgtccaccaaaaattcatatattcttaacaacttaaacaaaaatcagtgtttgaattttagaagaataaaaagcagcagccaaatgcagtggctcactcctgtaatgccagcactttgggaggccaaagtgggaggactgcttgaagccaggagttcaaaatcagcatgggcaacacagcaagaccatctctacaaa

SEQ ID NO: 161165 - DNA, 216 bp, Homo sapiens
tgggaaccccaaatctcccacccagaagattctccctctcactgcctccacaaccttggagtctgagagcttgggcagaaaagctgagtccttaggaagaacgggcactcacactccacctcggctgtgactgcaaatccattttcttcttaatctaacactttgcactaacactccatcttcaaaaaattagggctagggtgagtaaagccaggg

SEQ ID NO: 161166 - DNA, 538 bp, Homo sapiens
gtatttttaaaaaacatgttatgagaaaagtggcattgttttcctgctttttagaaaatctctgttcaataaaacacagctggattctcatatatgatctacattcattctgttacaacatgtactggctgaactatatatagaaaatccagtatcacacatatcattggaagaaggaggaccttgtgaaacccctgagaaagtctcaggcgcctttggagttcttggacaacacttcaagtaactgccttagtccttaaatgctcagtctttgtactatatcagataaccagatggtaccagatattttagactgagcacttagcggatacctgacaaaaatgacactgttctacagttttagaaatttcattaacctctctaacatcacagacgtcaacaagtccaacagtcaaggaagaaagctttaattttttttaatgttggaataatattttatgaatacagctaaatatttttgaaatgggatataaacttgtatgaaggtagtcatagctgcatatcttgcttgggttca

SEQ ID NO: 161167 - DNA, 294 bp, Homo sapiens
tctccccacccccaccatcagaaaaaaaagtaaatcagtagtgcatccagtccagagtccatagaacctttggcctggttgaggtaaacatacagccaataagtaaacaaaaccaaaatcgtccaggttgtgagtgtttaaaacataatcctgagtacacgagggaaagcagcaacaaaaactgaagagagacaaactaaaaaccgagggtgagatggaaagcagcagctcctcatttccaatagacctctctcctcttttggactaatgacgatgaacttgcctggcacaaat

SEQ ID NO: 161168 - DNA, 561 bp, Homo sapiens
ttgtgaagagtttatgtaagattgatatagttttattcttaagtatttgctggtgaagccatctggatcaggaattttctttgtaggattcagttttttaaattattcagattttctttttcttttgtatgtcagttttggtaagttgtatttacctatgatttttcagttttatttagattttcaaatttattagcacaaaattgtgtaaaacaccttatcttttaatatctataatacatgtatagtgatttcttcttcagttttgatattatttatgccttccctctttcttcattcatctcaccaagagtttatcaattttgtaggtctttttactgccctaaaagtcttctgtactctgcctgtttttaactctggctacccctgcttagttgttactgttatcttttctacttttaaatgttggagtgcccagggctcttctagtcttaagatttctgatgccatttaaatgccatttttgtatgctgatgacattcaactttgtattttttgcctgtacctcttccctgatctctacttccctaacccctcaat

SEQ ID NO: 161169 - DNA, 449 bp, Homo sapiens
cattggtgtggccagaggagctgggagacaggggcgggaggaagacatatttttcagtgcataccctctgcgtccactaaaattctgtggtgtgtacacactttacccttgtaaaataataggtatttggatattcactgattgcctactatgtgccaggtaccatgatatgcactataaacacaaagatgaactaaaaatattatatgtgttgcagtggttcaaaactaagtccttggagttctcctttcaatccacattcatcttggatgatctccagtcctataaatggatgactttcatgtttacatctgtagcccagacctcttccctgaactgcagactcaggaagtccaactgtctgctcgacaattccacttggttgtccatgacagcatctcaaactggatagtaccaaaactaattctaatcttcctcccttgggccga

SEQ ID NO: 161170 - DNA, 183 bp, Homo sapiens
gaattggttgtagcactgaatgtgtttgatgcattgtttgagcatgagtttggtgaaatttatattaggaaaagcattgtaaggtgagattgcgttacctggcaggtggagagatagaggagagaggagcaaaaagaaaatgagttgctacaagacattgaatcagtacgtttgagaggattt

SEQ ID NO: 161171 - DNA, 445 bp, Homo sapiens
agtgatagagaagaaaaaaaaatggcttcacaaccagatagtccggtttcaaatcctagctcttcttgtccttagctctgtggccttgagcaaatcacttggcttctctgtgcctcatctataaaatgcgaatagtgctacgtaccgctaccacaactgtaatgattgcagaaaatgttcacaaggaacctaacagtgcctagcacctggaaggcattcagtaagaggtgaaaatgcaacaggagcttgaagagaaggtagcagtaggagccatcagtggatatggagggaagagctctgcatgtggagtctagggacctagattctcatctgactatcactgagaagctgggtgcccttgggcatgtcatgtctggcattctctggagtctcccatcagtgcagagaggcccatccatgaatcaggtaatttttaagtgagaga

SEQ ID NO: 161172 - DNA, 117 bp, Homo sapiens
cctgttggtgagggtgtctgcccaggtgatgccggcacctcccgactctcccctgtgtcccacttttggagtcatcctgcctctggcagccctgttcttttcccttcattgtgtctc

SEQ ID NO: 161173 - DNA, 337 bp, Homo sapiens
taggcatcctaattggtgtgaagtggtatcttatttaggttttgatttttatctcagtgattgctggtgatgttgaattgctcttcaagaatttattggccatttgtatatcttatttgaaaaaagtttctattcagatcatttgattaatttttgttgggttatttatcttgtgttactgagttataagagttctttttggatcctagataaaagttttaaaaaaaatcagttacatgatttgcaaatgttttcttccactctttgggttgtcttttagatttattgatagtgccctttgaagtacaaaagtttttaattttgatgaaatcaaatg

SEQ ID NO: 161174 - DNA, 232 bp, Homo sapiens
atttgtcggaacgtattagtggttgccctagatctgttttgatctgcaagctctcttttcctgaatcagtacccctgaatcactgcccagaagcttagcttatagtagcatagtttcctggaagagcttagtgtcttttggtgacaaagcttacttagtatttattctgtgtggcgttgtgttagttagaggtcacattactactgccccatttactgtacgtgtccggcca

SEQ ID NO: 161175 - DNA, 249 bp, Homo sapiens
accctaagcaccaaataagcaaatcattaatcaccttccacaatcattaatcccaaatcttcctctggtgtcctcagaggggccctccatggcagcattccacagcctctcctagccagggcctttagcttctatcttccactgtccttttagccatgtgaatccatcattaaaaggatgcaaaggtatttaaataaaatgccctcctaaattgtttagctatgaaattcaattgcattcaacatagcc

SEQ ID NO: 161176 - DNA, 471 bp, Homo sapiens
aactcctaacctcaagtgatccacctgcctcagcctcccaagtagctgagactacagccacaagccatcacggccagctaagttttgaattttttatagagacaggtctcactatgttgcccaggctggtctcaaactctagtctcaagtgatcctcctgtctcagcctcccaaagtgctgggattacaggtgtaagccaccacacctggccctttgctaatttcttacttggttatttttttctaatattgagttgtaagagttctccataaattttgaatattaatcctttgtcagatatgtggtttgcaaatattgtttcccagtccataggttgactttttgttatgtcgattgtttcctttgctgtgcagaagctttttagttcgatgtagtcccgtttatttatttttgcttttgtagcctgagcttttggtgtgatgtctaaaaaatcattgccaaagccaatg

SEQ ID NO: 161177 - DNA, 196 bp, Homo sapiens
agggatggagacacactccttcccgtagcatcttgttccagtgttcagtggctttgctattagagccttttccccttacttcagactagcatctgtcttctagaaacttctacaacactgtttaccatttgtcatatggagttatagttactccaaacataaccagcccttagaagttgctattttgggtcttgtt

SEQ ID NO: 161178 - DNA, 215 bp, Homo sapiens
ctccttgcctcccacctccccaacgtttccaaaactcttctcaccaaaggtgccaatttgccaggtccacaccctcatgccagtcctcattagatcattctcacagtcagtcagtccccactcaccatcaccttcttgaaactcctttttcccttgacttcagagacacggtatcacttcctagttctgcacccacctctctggctgtgccgtcg

SEQ ID NO: 161179 - DNA, 405 bp, Homo sapiens
tcaaaatgagcccacagggaggttaaaacaggagccaacctgaaagtgttctcaatggccaaagctggaaacatttgagcaacaaaacaaatatgataatattggattataacctcccaaaataagtatacattaatccatactgatataaatacatgattgaataaataagtaaatggaggagaaaggacaaatatttctttcagaaggattccaattttttatatatgaagtgaatacaaagactctctggactttctttgtaactcttccgtaaatgcaaaattatttcaataataagccaggcatagtggctcatgcctataatcccagcaattcaggaggttgaggcaggaggatcccttgaggccaggagttcaagactagtgtgggcaacattgtgag

SEQ ID NO: 161180 - DNA, 600 bp, Homo sapiens
attggtcatcacaccacctgagtccaggtagtcactgtgtcattcatgttggtggttgatcctcaggtagttagggaggaaaataaacaagaagttatatatttaaaatcacgtttcaattttagacctgattaattgacttaataaagggcattagcacttctacttcctacagtccctctctttacctctggaaactagttatttctaggttgttttatgttgttaaggttgaccaccttctctttctgttctgcaatcatagtcctatcactagccttttgtcatggtcattcaattcacaagttgcttattttttaatttcttggctgactaaattttattatgaagacttttttttttaaagagctcagaaatactgtattctttaagttcttcagcatgtgtcttttgcctattttgattgggcaataatttagctggctataaaattcttggattatactctatttcccttagaaattataggcacccatccactgacatttcattgtgctttattttattttattttattttattttttgagatggagtcttgctctgtcacccaggcttgagtgctgtggtgcaatctcgg

SEQ ID NO: 161181 - DNA, 231 bp, Homo sapiens
tgcacctggctacatcctttaaaatttctgaatatgatatgcacataaactttgcttggaaaaagcatattctacgcagaatttaatgagaaattactcctcagaatgacctgggagagccacacaacactggtggctgaacttgaaccttaagtgagggcattataacttagtttgaaatgttttaaatacattaaaaaaagaaagtgaattgtgaattttttctgtggc

SEQ ID NO: 161182 - DNA, 337 bp, Homo sapiens
cagaaatagtgttggaaacttggttggatgtcagtttgtggtgcgttgaatgccaagtttaggactttagatttcattctgtaggtatccaggagttatagtaaaaagtttcaagtagaaaggctgtattacaggaagattaacctgacaggtagcactgcaatgatgttgaggtcctgccgatctaggaatttaggaaactcctgccactcaaagtagaaaaaacctaaactgtttacaatgcactttctcatatattatcttggactgaccttcacaattagaactaagagctatgccacttctccagccatatgcaggacaaagaaccaaagct

SEQ ID NO: 161183 - DNA, 554 bp, Homo sapiens
gatcgccggggattgcagccctctcctcagtgatggagcctcatagacagtcagcgagagcacggagcccgatgaccccacccgtgggttggattgaaatgacacatgcactgcagcctcaacagcagaacacccatcttttcaacttcacaaagattagccaccaagatggagcatacctgtcacaaaagagcccttaacaaattttaaaaaatcaaaaccatacgaagtaagttttctgaccatggtggggttaaattagaaatcagtaacagagaacaggaaagtctccaaacacttgcagactaatacaattctgagtagtccatgggtccgagaggatgcctcaacaaaaaaactttaacaaactgtacacaggaaaatacagcatgtcagaatttgtgagacataactcaagcagtgcctagaggggatttataggattaatgctttcttagaaaaagaagatgactttcagtaatctacgtttccaacttaaactagaaaaagagcaaaataagtcaaaatcaaggacaagaaagtaaataagaaca

SEQ ID NO: 161184 - DNA, 541 bp, Homo sapiens
cgttgggaagtgggaaagcagcaggaaatgagattggagagggccatgtgtgtaatgctgaatgactggcctttgccccattggctgtagggaaccactggaagttttaaaatcaggggaatggcggagattcacattttagaaaaatgcctggcagcagtgtggaagatggactggaaggggaagactaaagagaatggacgagttaggagactgctgcaaagtccaggtgagcacggggaagggcctggattaggccttgacagcggcgatgtggcagagaagactaagttgcatgtgattttgggaggcggaatttgcgtgacataccagagctgcagataacagttgtgggagggatggaagaatagagaaggaagctttttttaacctatagccattgaatgggagagtagaaaggaaacattgagtttggttctggacattttagaatggggcacccaaatggagagaaccagcagacggaaacatattcacatgtgtgtgaatgggtgagattatataaggagagcttgctgag

SEQ ID NO: 161185 - DNA, 151 bp, Homo sapiens
ctgtataaaaagcgtattataatcctccatttgttcacattctcctaaaagagtatagaaaaagaaaccagccgagctgctgacctagtttagaataacatgtgaactcactgagaatggggatgcttgcatgtacgctggaatggaattg

SEQ ID NO: 161186 - DNA, 380 bp, Homo sapiens
ttctctcactgatacctcttctgcatccatgccggtcaacgggcctgagaacttacttcaggcctcctctcaaaagaagtttctggttctggcttggtggccttttgcagacactgtctcatgtacgatacccgctcttccattataatgcggctaaacaccttagactccacattctgtggtcttgggacataagactgcaatgatgccgtgcgtgcagcaaggactcaaggtgtcagaactggccagaactgttcactttctcttggccacatattaggtagctgttccctccggccgtcaaacttccttattctcatcctttaacattaaagtcaaatcctacctcttccacacaacttcccaacaagcaaaaggaa

SEQ ID NO: 161187 - DNA, 500 bp, Homo sapiens
tgccgtgagccttggaattggtcatgctattgaatatattccctattgcttgtattccctattgagttctacagtggcacgaatcttataggctgtgcccaaaggaagcctaatgattagcaaagagtccctgaacagagttgctcttctgcttcacagccctaaaggcttagagactgagagatcctaattaagttaccacagacctttatttgcttgtaggaggtggccctgactgctctcagctttccaacctgggcaacagcccttctagtgaaagtcttacttccttggtcatcaactgtcaagtctgagtaacaacatttaagaaccaaacgaagtgtgtgtgttgtttacctctccctaatatacaaaggtatcttgcacacactgaaaacttcttagaccaaaagcctgatggctctagtttgccttgaaggtagttctattgtctataagggtatgtgagcctgtgtctgccaataaaatgttcaaatgtt

SEQ ID NO: 161188 - DNA, 467 bp, Homo sapiens
cccaaaaaatcactaagcaaagagcaggagtaacaataaacagcaacaataaatcctgcagaaaaggagattctgatttttagagttgacacataatattatttaagacactcagttttcaacaaaaaattatgaggcatgcaaagaaacaagaaaatatagctcacactttggggggaaaagcaatccatagaaactgttcctgagcaaacccagatgttggacttactagaaaaagagttaccaaatggaaagtatcaataatgagatagaaactataaaaaacaaaaagagaaaatcaaatcaaaattctggaattgaaaaatacagtaactaaagaggctcagcagcagatatgagcaggcagaataaagaatcggaaccagaagacatgaagataggttcattataattatctggtcttcagaactgaaagataaaagaatgagcaaaatgagcagagcctc

SEQ ID NO: 161189 - DNA, 105 bp, Homo sapiens
atgaactatcatgaattgagcactacctctgtttcttatcaacaaaggagactacggaaaagaagagtgactaagatctctgaagaagggaaaagctagatgact

SEQ ID NO: 161190 - DNA, 298 bp, Homo sapiens
aatacacagcgggaaaatggctgcattggattagatgtcactccaggcattaaaaccaaggttttggaatgagttaaccaacgcaaacccttaactcagatgggcagttatttaagtgctaacaaactacatacaaatttaggatccagggcgtccatcaaattctcttttattaaactaaaaagtccatctttattgctatagatcgacctctattctcacacattacatagcctcttatataaatgctcaacatttcttctttccatccgttcaccttaacctatctctcgctggt

SEQ ID NO: 161191 - DNA, 689 bp, Homo sapiens
taagtcacttagaacttggcttttattctgtttttcaacttaaaattcctcttgatgtccctcaactttttagcctgattttcatggcatttgagaaaatatggaggtgagtgttgattttagatttttagactgaaataaacttttcctttaaaaagggagagggcaccctaaatttggaacacaggtcaaggatgcttggagtactctgtactgcgggtatgggctctctccagcagtgacaactcagcatctctctagtggccactgcttttgcttcctaaacatgctgttttgagtagcctcaccttacaaatagatttgcagaacaggaagaagattcttgaaagggaagattgtgatgaaaccgataaaaatctctgtattaaaatcttgtacagccttctgttttaatatcttttcttctggatgagacattagtctttaacttttgaggaactctgtaactgaagacaaacaataaaataccaacagagaggaaattattaaaggattatatgtatttaaattacttttatcagtaacccactctagcctcagaaggtataaagctaacggagaaggggacatttaaaaccaatgtatttttattctgtaaatctttaacttaaaatagtattttgaattcaaggttgtctgatatttaaatcagttattatctcgatgac

SEQ ID NO: 161192 - DNA, 195 bp, Homo sapiens
agcagagttagcacaacacgtgagttatgaccaccttgagcagctcagcagggggtggtgccatttacagaacagagatggcacagacagagcccatggagaaggaggaaaaagagagtttggctttgggttttttttaagacagggtctctggctctgtcacccaggctggagtgcattggtgtgatcatagct

SEQ ID NO: 161193 - DNA, 250 bp, Homo sapiens
attgcagttgaactgtaactggtacaacaaagagtactggtatcattcctacttaacaagaacggatttgcattatagacaaaccttataaatgaggaattttaaactataagagatctttgctagtgctttaaataaaatgcaaaaagaaaaagtcttcagctctaaactaacattttccaagtaacacaaagaccacggatttaagggcaagactatttaaaattgaaggacacctgtgaaacagtat

SEQ ID NO: 161194 - DNA, 573 bp, Homo sapiens
ccatcagtagttacactttcaaaatagcagtttccacaacatgagtagagtatagcagtttagaagagaaagggaataagtaatgtctgtttatgaatcatgcaatgatacaaataccaacagaaatttagctaaaatagggattacacagtgatatctggacatcagtccccaagaaatgtttctaatgcacaaatctttaggatctttactctgaaaataacagttaactgttgattaccaaactaaaaaaatgaaaaggctgctggccaggcacaagtcaaatgtaaccatgtttcaggtttaaagcttatggaccatggagggttgttggtttttttggtttgcttcatttgctaagtgaagagcgtgggaactttcattattttgtttaactttcattattttatctgcaagcatttacatatacacacaatgtaaggcatttataaagacagtattttctaacaagtacaactaaatctgtccccttgaaacttagtttacacaatttacttgttaacctaggtaaaaacagcatcttttaaatggagttgtgggcttctaaaatct

SEQ ID NO: 161195 - DNA, 223 bp, Homo sapiens
acacacacacacacgcacaggatcacactttaaatggtattgaactatttgttttattgcttattatatcttagatcttttcatatctctacaaccagattttcttaattctttttaataactagatagtatacattttattggtatgccataataaattgaactagttatgattggtgaacatttagaaatttaccagaatctgaattcatgttttctaatt

SEQ ID NO: 161196 - DNA, 404 bp, Homo sapiens
aaatttttttaagctagcctcacttgttggtatgtgcctgtagtccctgctactcaggaggctgaggcaggaggatcacttaagtccagaaattcaagggtgcagtaagctgtgatcacactgctacactccaattggggtgacagaatgagacacaatctctaaaacatgaaaataaggacagatgtggtggctcatgcctataatcccagcactttgagatccacccacctcagcttccctaagcgctaggattacaggtgtgagccgccgtgcccggcctatttggtatctgttatacttggtgagccctttaatttttcacattttgccggatgtgaactcattacttggttgcattcttttctttttttctctttatgtagatttagaggggggcacag

SEQ ID NO: 161197 - DNA, 214 bp, Homo sapiens
gagaatcatgggggtgctttcccctgtactgttctcatggtagtgaataagtttcacaagatctgatagttttatcagggatttccgcttttgtgtcgtcattctctctttgcctgctgccatccatgtaagaggagacttgctcctttttgccttctgccatgattgtgaggcttccccagccatgtggaactgtaagtccaattaaacctct

SEQ ID NO: 161198 - DNA, 369 bp, Homo sapiens
aaccaactagaaagcaggaggacctggggtgtgaggctggggaggtaagcataactcggcacatccattgcaacattttctgctgatggggcaggctcatttatcctaagagaatcacctcatgaaaacaatgcagaatgcactctgggcccagacccacagctagaatgtcagtgctgattattctctcccagtccatgtgtttgtcagcaacacaaacattcacatgctactttcgggaaaatgcagcctccgcaggaggggctagaacagatgcagagagctaatttctctgtgtctgggtggatggtttcatttgcaatgtcaaagacaaaaatggggattctactagcctgctgaacctatgca

SEQ ID NO: 161199 - DNA, 370 bp, Homo sapiens
acaacaagcctccaacccccttcccttgctttatttttccatagaatttatcaccatctaataagacgcatttgtttaatgtcaatatccatgaaaatagtgactttgtttgtttcctgctctatccccataccaaataaaatggtactgaccaggcacttgataaatatgaattgacttgataaatgagcacgcagccaggttagagaaccagtggattttaatattgcgatgttggtgactattctcatgtggttctgaagtcaaacgaccacactgtttagaatggcatcatgaaccggctgagtggttgtgagcttttctgcactccatcccactggtttgtcctcaaatgagaaggggatacttt

SEQ ID NO: 161200 - DNA, 329 bp, Homo sapiens
aggaccacaatgtcaggagagatggggatgttaattataattatcgttcaaattggatgaaaactgtcattttatttcacttgaggagagatgctttacttacccagtgccctttgatttggtctgtattggcaccttaatatgtcagcacataactttcccataaaagcttttccttttaaatttcccttgcaaacatttaaatatgtactatgtatgttaatatagatcctaggttttggccaaggtaattaaacctgataacatttattctatacttttatgctttgagaaatggtctatcatcttttcatatgcttaattatgtg

SEQ ID NO: 161201 - DNA, 345 bp, Homo sapiens
aagattctaaaacccaaatctaatgacatttgttcagttcccattcttcctgaccccttcatagaactcatcattgagtcttcttctctcttaagtcctttgagccatattactctcattttccttttgcccattttaatttgttcttctctcttctttgctagctcttcaaagtcttctttctaggcctcaactaccctttactctgaataccctttcatgacctcaactggtcttttgtgtggttaattttcaagtcttcttctagctcttgccctcactaaaccttccctttaccatgtctaaagctgaagtcagaaatatggtatgtactggacagagcag

SEQ ID NO: 161202 - DNA, 588 bp, Homo sapiens
gtctcccaaagtggatgtaccactttgcattcccatcggcagtgaatgggagttcctcttgctccacatcctcggcagcatttggtggtgtcattgtttgtgatttttgctgtgctgacaggtatgcagtgacatctcattgatgtcttaatttgcattccctatgacatatgatgtgaagcgtttttccatatgatttctcagttgattgttactggcaaggggtcgtttccaccaaccatgaggatattaaattgctctgtgtgcttgcttaacagagcccacctgcccataggcgatccagggcaggcttgtcacctatttcgtcccatctcctcccgccttttttatgacttaacttttatccatttgcactgagctctttagtttctcattttgtcttttttcactcgatttttggacagaaatgtacatgcctttgtaagaacctatgtgacaagaatatagttagcaagttattgcattcattgtagctcttaagaggatgaaaatgtcataaataggtccgcaggagcaaagttctcatcttactttttttttaaattaagttgaatggacgaatgaatt

SEQ ID NO: 161203 - DNA, 485 bp, Homo sapiens
actctgaagtctttttggttatgattaggagtttcaggtttagttattccttttcggacagaccttgcaaacgctgctgccccactgggatgatttctcagttgattgttactggcaaggggtcgtttccaccaaccatgaggatattaaattgctctgtgtgcttgcttaacagagcccacctgcccataggcgatccagggcaggcttgtcacctatttcgtcccatctcctcccgccttttttatgacttaacttttatccatttgcactgagctctttagtttctcattttgtcttttttcactcgatttttggacagaaatgtacatgcctttgtaagaacctatgtgacaagaatatagttagcaagttattgcattcattgtagctcttaagaggatgaaaatgtcataaataggtccgcaggagcaaagttctcatcttactttttttttaaattaagttgaatggacgaatgaatt

SEQ ID NO: 161204 - DNA, 286 bp, Homo sapiens
atgggtgagcggatgggagagcagatgggtgagcggatgggagagcggatgggagagcggatgggagagcgcaggggagagcggaggagagagcggaggagagtggttgagggagtggatggttgagcagaagggagagcggatgggagagcggatgggtgagcagatgggtgagcggatgggagagcgcatgggagagcgcatgggagagcggatgggagagcgcatgggagagcgcatggatgagcgcatgggagagcgcatgggtgagcggatgcaagagtgg

SEQ ID NO: 161205 - DNA, 341 bp, Homo sapiens
tcccaacaatatatttgcttcttccagtgtatcttctgccaatttcaaatctttccatttggaaagatggcacttccctacagaaggcagtcctaggcttccaatcccagaaagaacttaaatcttatcaccttcttgaagccaccttactcttaaaactctcacccatacacacaccccaatgcctgattcagcagagccctagggaaccaccagatttccatcgtcgacatgcaacttcagctactctgactcctccagccattgactcacacactttgtggacaaacatctgtcctgtctgcccacaatgcacttcttggtcatgccctttctcttcc

SEQ ID NO: 161206 - DNA, 125 bp, Homo sapiens
tgagattagtagtcatcaatgggaaaatgtcatccacaactttttattcagtttgagccatcaatgttagttattatctgcggacactgctgtttgaaatgaatcatggtgctctagcaattcag

SEQ ID NO: 161207 - DNA, 482 bp, Homo sapiens
aaggagcatttattcaaaaaaaatttctgtaagaacagtgagatttgtgttaacttgccttagaccattcctcaccctctagctcagtagtcgccttggaaaacagcccacatccccaaccagagggagcagaatggagctggagctccttcaaagccttattctcagttaactgtcatgatgtcatctgtctggtggttccctggaagacctcatttgaaaggtttgtctttatttgaccagaatgaaagctgtctagtgctaaagcctctccacagagggtgtttttggaaaacaattacagacaagtgttttaacatggcaactgtattcggcaatgaataacagtttgggggaaaaaagcctaatcaaaaagcttaataggaaaagctgaggaataagatgtccacaggaatttgaaacactctgatatatgcttgggaaactagaagtccataagacatattcctggcaatttggaa

SEQ ID NO: 161208 - DNA, 131 bp, Homo sapiens
ggtgttggtagtattattataggctcaagactgttttatgcctgtcccctaggggtagaggtttttcttttacgcttagtgcaactgcagtgagtcttaacctgtactttgagggtgacatgctttgctgc

SEQ ID NO: 161209 - DNA, 427 bp, Homo sapiens
tcgggacgcagcggtgctgttctgggtcgtggccagggccggggtcggggccggtgctggggcaggagatgggacttggcgcctgggtcgcctccgtccctgcccacttgcggctctcgggccagcagcgtgagcctgatcgagtgcggccctgtggacaccgccttcatgcagaaggtgttgggcggtcccgaccaggtgatggaccgcacgaacacccggaccttccgcctcttgcactaatacctccaccacagcaaggagatctaccgcgaggaggcgcagcaccctgaggaggtggtgaaggtcttcctcaccgctatgcgcgccccgaagccgaccctgcgctacttcacaaccaggcgcttcctgcaccagctgctgatgcgcctggacgacccctttggcttcgactacgccgccgcca

SEQ ID NO: 161210 - DNA, 240 bp, Homo sapiens
  misc_feature (55)..(55): n is a, c, g, or t
cgcatcactcatatacatcagtcagcatcttgtggccctaacatgaggatgtggntgtcgtgagaaacagcaaaacactaagcctgacctctcccaaatgggaagacagaggagaaagcgcaccactgagggccaatgctaaatttgcagtgaaagaaatcagtggagccctcaactgcttttattcagctcttagcaggaactgacaaaaatcacaatttagcatgacgttacaacgca

SEQ ID NO: 161211 - DNA, 464 bp, Homo sapiens
actgagcctccaaggagcactgagttggtgagggctgtttatagacaacgaattcaccatcgaaaattagttcaaacggcaggttcaaaagctggaactccaaactctaaaataaatggagaggatctcaatctccccaaactctacaagctgtgactagtctccaaagtgacacttccaggcaactctcagcttaaagccccagctaagcacatgcacaatggccactgtcaaaccagtcagcctgggctgctggcggcggcagtgaccaaaaggcagagctcacatgcggggtccgagtcacagtgctgctggataacagccacaatgggaggcttagtgcctgctcacacgctcccacccacttttcttctccaagaagtctgtgtgattaagacctttacaatttgaaaaaggaagggactaggtgacttggggattgatctctgaccaacaaaggttaa

SEQ ID NO: 161212 - DNA, 338 bp, Homo sapiens
atctgtatctgtctatgtttgtgttgctgaggtttatagataaatattcaaatagaaatactaatgcaattttgaagcctaacttgcatgtaaatgagtgcattttcctaaaactattgaattctgtacgtctgattttttaaaaatcaaccatcagcaatcatggatagtcttttctgaacagtagctccataataaagagaagtcaatcactattagagaagcactgtaggtgaaaggcactatagttcacacttgattttgtagcggggagagggtacttagctgtgaatcaggaatgatgcaaaagatggatgagatagagttcaaggagcagt

SEQ ID NO: 161213 - DNA, 261 bp, Homo sapiens
gccctgcctagaaaagacattttaataaccttggctgctaaggacaacattgatagaagccgtctctggctatagataagtagatctaatactagtttggatatctttagggtttagaatctaacctcaagaataagaaatacaagtacgaattggtgatgaagatgtattcgtattgtttgggattgggaggctttgcttattttttaaaaactattgaggtaaagggttaagctgtaacatacttaattgatttcttac

SEQ ID NO: 161214 - DNA, 509 bp, Homo sapiens
tcaccgtttttctatttctttatacaagtcatagtgagttattaatacacaaagagtaatagaaagcagagagttagttgaatcatcttaataattagactcaaagctatgatagcctgatggattaatcaccacatctggaatgaacttgcttatgagacagttttatcagctgaccagagaatggagagagaaaaagagttatcaagaagtgcagaagttctggattaattttagcccaagctaaaatcacctatcattgaatttgattcctgaggtacaaaatcaaatgcattaatatcagccactattctggcgtatcattcttctatttattaaaaagaatttattagcaaccttagaggttttcagtgttcaacatggtgaaatgctgctgggtactttggaaggcattgagcgtatttagactttggtagacctgagagctgccttaaaatagcatgacttctttcctttgatgctagacttgacaagaggtttgattagga

SEQ ID NO: 161215 - DNA, 1047 bp, Homo sapiens
  misc_feature (26)..(26): n is a, c, g, or t
tgcaggctggtacgcccccggagtantgggatatcgtcgaccgagcgtgcaatgggatgtccaaccgcttctggggctggggccgcgaggacgacgagttctaccggcgcattaagggagctgggctccagcttttccgcccctcgggaatcacaactgggtacaagacatttcgccacctgcacgacccagcctggcggaagagggaccagaagcgcatcgcagctcaaaaacaggagcagttcaaggtggacagggagggaggcctgaacactgtgaagtaccatgtggcttcccgcactgccctgtctgtgggcggggccccctgcactgtcctcaacatcatgttggactgtgacaagaccgccacaccctggtgcacattcagctgagctggatggacagtgaggaagcctgtacctacaggccatattgctcaggctcaggacaaggcctcaggtcgtgggcccagctctgacaggatgtggagtggccaggaccaagacagcaagctacgcaattgcagccacccggccgccaaggcaggcttgggctgggccaggacacgtggggtgcctgggacgctgcttgccatgcacagtgatcagagagaggctggggtgtgtcctgtccgggaccccccctgccttcctgctcaccctactctgacctccttcacgtgcccaggcctgtgggtagtggggagggctgaacaggacaacctctcatcacccccacttttgttccttcctgctgggctgcctcgtgcagagacacagtgtaggggccatgcagctggcgtaggtggcagttgggcctggtgagggttaggacttcagaaaccagagcacaagccccacagagggggaacagccagcaccgctctagctggttgttgccatgccggaatgtgggcctagtgttgccagatcttctgatttttcgaaagaaactagaatgctggattcttaagtgatatcttctgattttttaaatgatagcacctaaatgaaactttcaaaaagtatggcaggccagacaaaaaaa

SEQ ID NO: 161216 - DNA, 918 bp, Homo sapiens
  misc_feature (5)..(5): n is a, c, g, or t
ggccngggcggagcgggaggcggaggcgccgcgtaggcccgggaggccgggccggccgggctgcgagcgcctgccccatgcgccgccgcctctccgcacgatgttcccctcgcggaggaaagcggcgcagctgccctgggaggacggcaggtccgggttgctctccggcggcctccctcggaagtgttccgtcttccacctgttcgtggcctgcctctcgctgggcttcttctccctactctggctgcagctcagctgctctggggacgtggcccgggcagtcaggggacaagggcaggagacctcgggccctccccgcgcctgccccccagagccgccccctgagcactgggaagaagacgcatcctggggcccccaccgcctggcagtgctggtgcccttccgcgaacgcttcgaggagctcctggtcttcgtgccccacatgcgccgcttcctgagcaggaagaagatccggcaccacatctacgtgctcaaccaggtggaccacttcaggttcaaccgggcagcgctcatcaacgtgggcttcctggagagcagcaacagcacggactacattgccatgcacgacgttgacctgctccctctcaacgaggagctggactatggctttcctgaggctgggcccttccacgtggcctccccggagctccaccctctctaccagggcctggtgagggttaggacttcagaaaccagagcacaagccccacagagggggaacagccagcaccgctctagctggttgttgccatgccggaatgtgggcctagtgttgccagatcttctgatttttcgaaagaaactagaatgctggattcttaagtgatatcttctgattttttaaatgatagcacctaaatgaaactttcaaaaagtatggcaggccagacaaaaaaa

SEQ ID NO: 161217 - DNA, 714 bp, Homo sapiens
  misc_feature (5)..(5): n is a, c, g, or t
ggccngggcggagcgggaggcggaggcgccgcgtaggcccgggaggccgggccggccgggctgcgagcgcctgccccatgcgccgccgcctctccgcacgatgttcccctcgcggaggaaagcggcgcagctgccctgggaggacggcaggtccgggttgctctccggcggcctccctcggaagtgttccgtcttccacctgttcgtggcctgcctctcgctgggcttcttctccctactctggctgcagctcagctgctctggggacgtggcccgggcagtcaggggacaagggcaggagacctcgggccctccccgcgcctgccccccagagccgccccctgagcactgggaagaagacgcatcctggggcccccaccgcctggcagtgctggtgcccttccgcgaacgcttcgaggagctcctggtcttcgtgccccacatgcgccgcttcctgagcaggaagaagatccggcaccagggcctggtgagggttaggacttcagaaaccagagcacaagccccacagagggggaacagccagcaccgctctagctggttgttgccatgccggaatgtgggcctagtgttgccagatcttctgatttttcgaaagaaactagaatgctggattcttaagtgatatcttctgattttttaaatgatagcacctaaatgaaactttcaaaaagtatggcaggccagacaaaaaaa

SEQ ID NO: 161218 - DNA, 228 bp, Homo sapiens
tggcccggggattagggaaagggagggtcaaggccacggctttaaagttgcccacagtctggcgttgtcctaaaatccccgcccttaccaaaaagtgctcccttccatgaccacagcctgagatctcacccaccagcccccacctcctttccctctaggtaactcccactggaagatggattctcagccccaccagcctgatcttcccaccttttcaagtccccttga

SEQ ID NO: 161219 - DNA, 1739 bp, Homo sapiens
  misc_feature (5)..(5): n is a, c, g, or t
ggccngggcggagcgggaggcggaggcgccgcgtaggcccgggaggccgggccggccgggctgcgagcgcctgccccatgcgccgccgcctctccgcacgatgttcccctcgcggaggaaagcggcgcagctgccctgggaggacggcaggtccgggttgctctccggcggcctccctcggaagtgttccgtcttccacctgttcgtggcctgcctctcgctgggcttcttctccctactctggctgcagctcagctgctctggggacgtggcccgggcagtcaggggacaagggcaggagacctcgggccctccccgcgcctgccccccagagccgccccctgagcactgggaagaagacgcatcctggggcccccaccgcctggcagtgctggtgcccttccgcgaacgcttcgaggagctcctggtcttcgtgccccacatgcgccgcttcctgagcaggaagaagatccggcaccacatctacgtgctcaaccaggtggaccacttcaggttcaaccgggcagcgctcatcaacgtgggcttcctggagagcagcaacagcacggactacattgccatgcacgacgttgacctgctccctctcaacgaggagctggactatggctttcctgaggctgggcccttccacgtggcctccccggagctccaccctctctaccactacaagacctatgtcggcggcatcctgctgctctccaagcagcactaccggctgtgcaatgggatgtccaaccgcttctggggctggggccgcgaggacgacgagttctaccggcgcattaagggagctgggctccagcttttccgcccctcgggaatcacaactgggtacaagacatttcgccacctgcacgacccagcctggcggaagagggaccagaagcgcatcgcagctcaaaaacaggagcagttcaaggtggacagggagggaggcctgaacactgtgaagtaccatgtggcttcccgcactgccctgtctgtgggcggggccccctgcactgtcctcaacatcatgttggactgtgacaagaccgccacaccctggtgcacattcagctgagctggatggacagtgaggaagcctgtacctacaggccatattgctcaggctcaggacaaggcctcaggtcgtgggcccagctctgacaggatgtggagtggccaggaccaagacagcaagctacgcaattgcagccacccggccgccaaggcaggcttgggctgggccaggacacgtggggtgcctgggacgctgcttgccatgcacagtgatcagagagaggctggggtgtgtcctgtccgggaccccccctgccttcctgctcaccctactctgacctccttcacgtgcccaggcctgtgggtagtggggagggctgaacaggacaacctctcatcacccccacttttgttccttcctgctgggctgcctcgtgcagagacacagtgtaggggccatgcagctggcgtaggtggcagttgggcctggtgagggttaggacttcagaaaccagagcacaagccccacagagggggaacagccagcaccgctctagctggttgttgccatgccggaatgtgggcctagtgttgccagatcttctgatttttcgaaagaaactagaatgctggattcttaagtgatatcttctgattttttaaatgatagcacctaaatgaaactttcaaaaagtatggcaggccagacaaaaaaa

SEQ ID NO: 161220 - DNA, 2739 bp, Homo sapiens
cgttctctgctttctggcagacctccttccctttctctcccctcgtctctcttgaaccccttccgctcagactcctgcacccaccatggcacagagcagctctcactgaggtcaccagccacctcctccactctgttggtccagaggccatgctgggccctcatcctgtggacctgccagcagcatcttctttcgtaaaatgcccctgcttggggcagcaccctctggtcctccctctgcactggctgggcctctgtgtctgtgggttctgctcatctccccgagctctcaccatcggggcttctctgggctcggtgcttcggcagccccccttttttaactccaggtgttccttggggcatctcatgtcatctccagcattaaaccacgtctctgatgattcctgaggctgtttcctggagttctctcctaaactccaggctcaacagcccagccatctacacagtccctccacgtggtggcctcagagctactgcaagcttccatgatcacagctgaattgctggtggcctgccctgccccaaacctgtagctctgtcctcttctccatgggaatggaagctctttgctctcattgctcaagcccaaaagcccgggggtcatcctcagctgctccttctctgtcatacactgcgtcctattcgtcagcaaaatccatctagaatctgcccgcttctcgctgttgccaccgccacctcctgagctagggcaccttcatcttttggtctctcacctaaatcattgccatagtctcccagctggtctccctgctttcacccctgctctgacagtctcttccagcacaacagctagggcggtcctgtccaggcataagtcacagcacgcctctaccctgctcagagcctccatggcacccatcttacccgagtcaaagccccgtccttcagtggcccttgggccttgtgcagtcactgtgtcacccccaacatccccacctctgccctcgccctgcccagctgcccgttggtctgctcctgcctcctgccgtggcagtgccatctctcctatgcagagccctaggcacccactgccctgtgggtcatctcttcaggccttcaggtttctgtcactcagttcccctggccctccctgacggccccaccgaggacaagagccacctccacccccagcaagatcgccctccttgcctgctttgcttttccccccagcacgaaccactgctggccacgctttgtgtttgcttgtttctgtttccttctattggaatctcagttccttgagaacagggcctggtttttcactgctgtacctcccgtgctttgaatggtttctggcacatagtgggtgcttagtaaatatgcgatgagtggagggactgccccacaggctgagtgaagtcagtgctgggccagagggcagcataggcaccatggggacccccgggtgggtgctgagccccaggcagtgagcccgtgtgctgcccctgcccagccttgcccaccctgcacaggttcaaccgggcagcgctcatcaacgtgggcttcctggagagcagcaacagcacggactacattgccatgcacgacgttgacctgctccctctcaacgaggagctggactatggctttcctgaggctgggcccttccacgtggcctccccggagctccaccctctctaccactacaagacctatgtcggcggcatcctgctgctctccaagcagcactaccggctgtgcaatgggatgtccaaccgcttctggggctggggccgcgaggacgacgagttctaccggcgcattaagggagctgggctccagcttttccgcccctcgggaatcacaactgggtacaagacatttcgccacctgcacgacccagcctggcggaagagggaccagaagcgcatcgcagctcaaaaacaggagcagttcaaggtggacagggagggaggcctgaacactgtgaagtaccatgtggcttcccgcactgccctgtctgtgggcggggccccctgcactgtcctcaacatcatgttggactgtgacaagaccgccacaccctggtgcacattcagctgagctggatggacagtgaggaagcctgtacctacaggccatattgctcaggctcaggacaaggcctcaggtcgtgggcccagctctgacaggatgtggagtggccaggaccaagacagcaagctacgcaattgcagccacccggccgccaaggcaggcttgggctgggccaggacacgtggggtgcctgggacgctgcttgccatgcacagtgatcagagagaggctggggtgtgtcctgtccgggaccccccctgccttcctgctcaccctactctgacctccttcacgtgcccaggcctgtgggtagtggggagggctgaacaggacaacctctcatcacccccacttttgttccttcctgctgggctgcctcgtgcagagacacagtgtaggggccatgcagctggcgtaggtggcagttgggcctggtgagggttaggacttcagaaaccagagcacaagccccacagagggggaacagccagcaccgctctagctggttgttgccatgccggaatgtgggcctagtgttgccagatcttctgatttttcgaaagaaactagaatgctggattcttaagtgatatcttctgattttttaaatgatagcacctaaatgaaactttcaaaaagtatggcaggccagacaaaaaaa

SEQ ID NO: 161221 - DNA, 1758 bp, Homo sapiens
  misc_feature (5)..(5): n is a, c, g, or t
ggccngggcggagcgggaggcggaggcgccgcgtaggcccgggaggccgggccggccgggctgcgagcgcctgccccatgcgccgccgcctctccgcacgatgttcccctcgcggaggaaagcggcgcagctgccctgggaggacggcaggtccgggttgctctccggcggcctccctcggaagtgttccgtcttccacctgttcgtggcctgcctctcgctgggcttcttctccctactctggctgcagctcagctgctctggggacgtggcccgggcagtcaggggacaagggcaggagacctcgggccctccccgcgcctgccccccagagccgccccctgagcactgggaagaagacgcatcctggggcccccaccgcctggcagtgctggtgcccttccgcgaacgcttcgaggagctcctggtcttcgtgccccacatgcgccgcttcctgagcaggaagaagatccggcaccacatctacgtgctcaaccaggtggaccacttcagccttgcccaccctgcacaggttcaaccgggcagcgctcatcaacgtgggcttcctggagagcagcaacagcacggactacattgccatgcacgacgttgacctgctccctctcaacgaggagctggactatggctttcctgaggctgggcccttccacgtggcctccccggagctccaccctctctaccactacaagacctatgtcggcggcatcctgctgctctccaagcagcactaccggctgtgcaatgggatgtccaaccgcttctggggctggggccgcgaggacgacgagttctaccggcgcattaagggagctgggctccagcttttccgcccctcgggaatcacaactgggtacaagacatttcgccacctgcacgacccagcctggcggaagagggaccagaagcgcatcgcagctcaaaaacaggagcagttcaaggtggacagggagggaggcctgaacactgtgaagtaccatgtggcttcccgcactgccctgtctgtgggcggggccccctgcactgtcctcaacatcatgttggactgtgacaagaccgccacaccctggtgcacattcagctgagctggatggacagtgaggaagcctgtacctacaggccatattgctcaggctcaggacaaggcctcaggtcgtgggcccagctctgacaggatgtggagtggccaggaccaagacagcaagctacgcaattgcagccacccggccgccaaggcaggcttgggctgggccaggacacgtggggtgcctgggacgctgcttgccatgcacagtgatcagagagaggctggggtgtgtcctgtccgggaccccccctgccttcctgctcaccctactctgacctccttcacgtgcccaggcctgtgggtagtggggagggctgaacaggacaacctctcatcacccccacttttgttccttcctgctgggctgcctcgtgcagagacacagtgtaggggccatgcagctggcgtaggtggcagttgggcctggtgagggttaggacttcagaaaccagagcacaagccccacagagggggaacagccagcaccgctctagctggttgttgccatgccggaatgtgggcctagtgttgccagatcttctgatttttcgaaagaaactagaatgctggattcttaagtgatatcttctgattttttaaatgatagcacctaaatgaaactttcaaaaagtatggcaggccagacaaaaaaa

SEQ ID NO: 161222 - DNA, 1453 bp, Homo sapiens
accggtttatgcggggactgtcgttcactgtcgcgctgccccccagagccgccccctgagcactgggaagaagacgcatcctggggcccccaccgcctggcagtgctggtgcccttccgcgaacgcttcgaggagctcctggtcttcgtgccccacatgcgccgcttcctgagcaggaagaagatccggcaccacatctacgtgctcaaccaggtggaccacttcaggttcaaccgggcagcgctcatcaacgtgggcttcctggagagcagcaacagcacggactacattgccatgcacgacgttgacctgctccctctcaacgaggagctggactatggctttcctgaggctgggcccttccacgtggcctccccggagctccaccctctctaccactacaagacctatgtcggcggcatcctgctgctctccaagcagcactaccggctgtgcaatgggatgtccaaccgcttctggggctggggccgcgaggacgacgagttctaccggcgcattaagggagctgggctccagcttttccgcccctcgggaatcacaactgggtacaagacatttcgccacctgcacgacccagcctggcggaagagggaccagaagcgcatcgcagctcaaaaacaggagcagttcaaggtggacagggagggaggcctgaacactgtgaagtaccatgtggcttcccgcactgccctgtctgtgggcggggccccctgcactgtcctcaacatcatgttggactgtgacaagaccgccacaccctggtgcacattcagctgagctggatggacagtgaggaagcctgtacctacaggccatattgctcaggctcaggacaaggcctcaggtcgtgggcccagctctgacaggatgtggagtggccaggaccaagacagcaagctacgcaattgcagccacccggccgccaaggcaggcttgggctgggccaggacacgtggggtgcctgggacgctgcttgccatgcacagtgatcagagagaggctggggtgtgtcctgtccgggaccccccctgccttcctgctcaccctactctgacctccttcacgtgcccaggcctgtgggtagtggggagggctgaacaggacaacctctcatcacccccacttttgttccttcctgctgggctgcctcgtgcagagacacagtgtaggggccatgcagctggcgtaggtggcagttgggcctggtgagggttaggacttcagaaaccagagcacaagccccacagagggggaacagccagcaccgctctagctggttgttgccatgccggaatgtgggcctagtgttgccagatcttctgatttttcgaaagaaactagaatgctggattcttaagtgatatcttctgattttttaaatgatagcacctaaatgaaactttcaaaaagtatggcaggccagacaaaaaaa

SEQ ID NO: 161223 - DNA, 1063 bp, Homo sapiens
  misc_feature (5)..(5): n is a, c, g, or t
ggccngggcggagcgggaggcggaggcgccgcgtaggcccgggaggccgggccggccgggctgcgagcgcctgccccatgcgccgccgcctctccgcacgatgttcccctcgcggaggaaagcggcgcagctgccctgggaggacggcaggtccgggttgctctccggcggcctccctcggaagtgttccgtcttccacctgttcgtggcctgcctctcgctgggcttcttctccctactctggctgcagctcagctgctctggggacgtggcccgggcagtcaggggacaagggcaggagacctcgggccctccccgcgcctgccccccagagccgccccctgagcactgggaagaagacgcatcctggggcccccaccgcctggcagtgctggtgcccttccgcgaacgcttcgaggagctcctggtcttcgtgccccacatgcgccgcttcctgagcaggaagaagatccggcaccagggcccagctctgacaggatgtggagtggccaggaccaagacagcaagctacgcaattgcagccacccggccgccaaggcaggcttgggctgggccaggacacgtggggtgcctgggacgctgcttgccatgcacagtgatcagagagaggctggggtgtgtcctgtccgggaccccccctgccttcctgctcaccctactctgacctccttcacgtgcccaggcctgtgggtagtggggagggctgaacaggacaacctctcatcacccccacttttgttccttcctgctgggctgcctcgtgcagagacacagtgtaggggccatgcagctggcgtaggtggcagttgggcctggtgagggttaggacttcagaaaccagagcacaagccccacagagggggaacagccagcaccgctctagctggttgttgccatgccggaatgtgggcctagtgttgccagatcttctgatttttcgaaagaaactagaatgctggattcttaagtgatatcttctgattttttaaatgatagcacctaaatgaaactttcaaaaagtatggcaggccagacaaaaaaa

SEQ ID NO: 161224 - DNA, 698 bp, Homo sapiens
  misc_feature (5)..(5): n is a, c, g, or t
ggccngggcggagcgggaggcggaggcgccgcgtaggcccgggaggccgggccggccgggctgcgagcgcctgccccatgcgccgccgcctctccgcacgatgttcccctcgcggaggaaagcggcgcagctgccctgggaggacggcaggtccgggttgctctccggcggcctccctcggaagtgttccgtcttccacctgttcgtggcctgcctctcgctgggcttcttctccctactctggctgcagctcagctgctctggggacgtggcccgggcagtcaggggacaagggcaggagacctcgggccctccccgcgcctgccccccagagccgccccctgagcactgggaagaagacgcatcctggggcccccaccgcctggcagtgctggtgcccttccgcgaacgcttcgaggagctcctggtcttcgtgccccacatgcgccgcttcctgagcaggaagaagatccggcaccacatctacgtgctcaaccaggtggaccacttcaggtaactcccactggaagatggattctcagccccaccagcctgatcttcccaccttttcaagtccccttgatccagatccccagaccccccccttttccctgccacccttcttgtctttacttcctccttacccaacctggagtccaaggtccatcattaaaaccctccctggcatactccctcaa

SEQ ID NO: 161225 - DNA, 439 bp, Homo sapiens
  misc_feature (5)..(5): n is a, c, g, or t
ggccngggcggagcgggaggcggaggcgccgcgtaggcccgggaggccgggccggccgggctgcgagcgcctgccccatgcgccgccgcctctccgcacgatgttcccctcgcggaggaaagcggcgcagctgccctgggaggacggcaggtccgggttgctctccggcggcctccctcggaagtgttccgtcttccacctgttcgggcctggtgagggttaggacttcagaaaccagagcacaagccccacagagggggaacagccagcaccgctctagctggttgttgccatgccggaatgtgggcctagtgttgccagatcttctgatttttcgaaagaaactagaatgctggattcttaagtgatatcttctgattttttaaatgatagcacctaaatgaaactttcaaaaagtatggcaggccagacaaaaaaa

SEQ ID NO: 161226 - DNA, 1217 bp, Homo sapiens
ctcggctcactgccagctccgcttcctgggttcacgccattctcctgcctcagcctcccgagtagccaggactacaagcacccgccaccacacctggctaatttttttgtatttttattagagacagtgttttaccgtgttagccaggatggtctcgatctcctgacttcgtgatctactcacctcggcctcccaaagtgctgggattacgggcaagtttttattagagatggggtttcatcatgttggtcaggctggtcttcaactcctgacctcaggtgatccacccgcctcagcctcccaaagtgctgggattacaggcatgagccaccgcgcccggcctgaactctcagttctaacgcagggattcaggaattgggctttcagactccttctgcagtgtcacagtccagactttttttaaatgaaggacaccccgcagtggctcacagtgggtcccagggctagcaggagcgtgctggggagccggctctgtctttgttcgcagtgggtcccggtgctggcaggagtgtgctggtgagccggctctgtctttgtaaatccttcaggggtcctacggctgactccaccggacagcccgtcctgggccgtgttaagcaccttttgtagaaatcgtatttttattaaaacatcaaatctgtgttcctgtaaaaaacaaaaaaaaaaaaaaaaaaaaaagaaaaaaaaaaaaaaaaaaacaaaaaagaaaaaaaaagagagagcatatacaaccgacaaaaacaacagaaaaagagagaacacacaaaaagcaagacgcaccgcacgaaaaccggtacactaaaagggagaccaacaacaaacacgcgacaccgaagagacgaagaagacccgcaggcgagcgaacgacacaacacccagagcgagcacgaggtagaggcaagtcaacgccgccgcggccgccacgcgaacacaggggtagcaagagaacaccccgagccaccagcagcaaccagagaaggcccaccagacagccggagcagagaaagcacgacgaagaggcagaaaaagggccatacaacccaggcgaactaaaagaccagcaatacagcagcgcagggaaaacacagcacacaccaagagaggccacccaccgccgaaacaaaaggtcaaaagcagaagagaccaacagacaagagctcgcaaacacagcaaaaccaaaagagaagaacccccaa

SEQ ID NO: 161227 - DNA, 998 bp, Homo sapiens
ggctcatctaatattttggctggaataaatcagagacttccataatcaagtaaattttaattttcatcattccatggagattcagtctgtctggaatcccggaacccctccacagaatcgtgtctggatccacactgtggtgtggctgccacggcctcctggctccagaggcagctgggccgggccaaggcaggaaggcgcccccatgtgtgtggcctcagtctcagcatctgactgtgctgccctgtccccagggaagagaatgaggaccacgtggacttgttcgcagtgggtcccggtgctggcaggagtgtgctggtgagccggctctgtctttgtaaatccttcaggggtcctacggctgactccaccggacagcccgtcctgggccgtgttaagcaccttttgtagaaatcgtatttttattaaaacatcaaatctgtgttcctgtaaaaaacaaaaaaaaaaaaaaaaaaaaaagaaaaaaaaaaaaaaaaaaacaaaaaagaaaaaaaaagagagagcatatacaaccgacaaaaacaacagaaaaagagagaacacacaaaaagcaagacgcaccgcacgaaaaccggtacactaaaagggagaccaacaacaaacacgcgacaccgaagagacgaagaagacccgcaggcgagcgaacgacacaacacccagagcgagcacgaggtagaggcaagtcaacgccgccgcggccgccacgcgaacacaggggtagcaagagaacaccccgagccaccagcagcaaccagagaaggcccaccagacagccggagcagagaaagcacgacgaagaggcagaaaaagggccatacaacccaggcgaactaaaagaccagcaatacagcagcgcagggaaaacacagcacacaccaagagaggccacccaccgccgaaacaaaaggtcaaaagcagaagagaccaacagacaagagctcgcaaacacagcaaaaccaaaagagaagaacccccaa

SEQ ID NO: 161228 - DNA, 951 bp, Homo sapiens
caaggatggcaaggtcaacatcgacgacctcgtcaaggtgattgagctggtggacaaagaagatgttcacatctccaccagccaggtggctgagattgtagcaacactggaaaaagaggagaaggtggaggagaaggagaaggccaaagagaaggcagagaaggaggtcgcagaggtgaagagctagaaccactggcctgggcacctgtcctcctgctgtgccgtcaccctggcaagggccgtgagggcgattgctttgtggtgattctcagtggctcatctaatattttgtaaatccttcaggggtcctacggctgactccaccggacagcccgtcctgggccgtgttaagcaccttttgtagaaatcgtatttttattaaaacatcaaatctgtgttcctgtaaaaaacaaaaaaaaaaaaaaaaaaaaaagaaaaaaaaaaaaaaaaaaacaaaaaagaaaaaaaaagagagagcatatacaaccgacaaaaacaacagaaaaagagagaacacacaaaaagcaagacgcaccgcacgaaaaccggtacactaaaagggagaccaacaacaaacacgcgacaccgaagagacgaagaagacccgcaggcgagcgaacgacacaacacccagagcgagcacgaggtagaggcaagtcaacgccgccgcggccgccacgcgaacacaggggtagcaagagaacaccccgagccaccagcagcaaccagagaaggcccaccagacagccggagcagagaaagcacgacgaagaggcagaaaaagggccatacaacccaggcgaactaaaagaccagcaatacagcagcgcagggaaaacacagcacacaccaagagaggccacccaccgccgaaacaaaaggtcaaaagcagaagagaccaacagacaagagctcgcaaacacagcaaaaccaaaagagaagaacccccaa

SEQ ID NO: 161229 - DNA, 322 bp, Homo sapiens
tacacccgtctgcgattagccacaaaacccctgcattttcaggcagctgtactgttcccaccgcgtgtctgcgtgcactgtgcacacacgagacttcacagcagtaaggagctggccccggggctcaaccaggtaagcatctgggcagtgaggcgtggactattctgtcatcagcttaagccaacgttattaaggaagtggtctgactgctgaaaagaccccacatccctacaatttcccatctatggaaattataaccctgttactcatgccactgctcctgctcacacctggttaacagtggcactcaggtcactgagct

SEQ ID NO: 161230 - DNA, 176 bp, Homo sapiens
tcaggtctagcagtgttctgaagtggaaccaactagttatatctaatatagttcctgacacagagcaggcatttaaggaaagtgtgcccttctctttcacagctcctctgcccctaatgcaagaagaactattaagttatcctatcattcagcaactgtacatatctccccttcct

SEQ ID NO: 161231 - DNA, 325 bp, Homo sapiens
ttctaagctcgattcctatttaaatgcttctgttggaactcccaaagtttccatagatttctaatatggtcttttatcccattgtccatgccacctggcatgaaggaaccagaaagatggccagaagaaggctgaggcaaggggaggcccttgggtggaaacttttaagaaccactcactcagggtcatgcatgactgcagcgttggactcatccctaaatcatgcatgctggcacctgcttccttaccctcgtccctgcccccatcagatcccggaagcttgagcaagactctctaagacaagaggccccatctgtagactcca

SEQ ID NO: 161232 - DNA, 200 bp, Homo sapiens
ctttcactcagttacagtgagattgttaaatagctaacaaagttttcaagagaagctatagcacaaaccatatggtttctcactgggaaaaaatatgaagggaacataaatggaaagtattataagggccaaagctattttcattttgttgtattttttctttgacaagttggttactttccgtgtgtgtgtgtgtgtgt

SEQ ID NO: 161233 - DNA, 223 bp, Homo sapiens
acctgtccctctactgcagacaggggccaaagcctgtgaagaaaatcttagttggctctgcttctgatagccaaatactgacttcctttgcacattctagaacaccaaggaagtaaaatggttatggtttcctttcttcagagaaactcgcagggatgaaagccaagagcaggaaagtaagattttcctgggcaaacatctatgtttactgagtagctaccta

SEQ ID NO: 161234 - DNA, 301 bp, Homo sapiens
tttagctaacagaaataggaagagaatctcagaatctgttttgtcattttttcaatgggttgagttatagtgattatgctaactcggtggaaaagcagtgtagtgagtaaaccccacatacggcatatcatgaacattttgttgcttttttggcttctgaccatcttcatacctttttttgtgttaaaagtctccccattgtgtatatcttagtaagaggcaggtggaccctagtttctacctaagaaaacctgaagatggggttgggggcctgtggtgtacttccttctcatgctgtcca

SEQ ID NO: 161235 - DNA, 157 bp, Homo sapiens
cactggaatcagtctgtaactactcaagtcacaatgacttcagtgcaggagttttttactggacacagaagtctgattccaagcccactcttcaacagctgagattttgtgtgcgtgtatgtatgtgtgtgtgtgtagacgttgtcctgaggttcat

SEQ ID NO: 161236 - DNA, 442 bp, Homo sapiens
cctcagcaaagagtatagaggatttctttgtactttccttgcaaccttttttgagttcaacattaaattgtagtaaatccttaccttccccaaaaaagcccattccagaggaaaaataccacctctcttctttatctcccccgtccctggcccctctcacctatgtagaagttttgagagaacacaagatatatggagaacagccatgggtttaggaaaggataaaggattcaaggtgtgaaaacatttagcgagctgggttgaattttggtcccatcactttttcagtgacctttgccaaagtatttaacctttctgcacctcagtttcttctcttgaggataatagtacctgccttctattaataagagtttgctgtgtagggttaatatacataaagcacctccaacagtgcctgagacatagctcgtattcctttcac

SEQ ID NO: 161237 - DNA, 309 bp, Homo sapiens
agaaccaagagacttctcagaatgagaagtggcagagctggattcaaatcccagtctgtcttactctagacttcagagtctagaccttaaggagtgatgatggttgaaccagtttatgtgccaccagctgacaccactttggcctcaccagcatcaggtgtttgcaccggtgacttgggatagttctcagtcttcatcgccattttccgctggtttgatgagcggctcttgtcagtttattaatgtgcccagagctgtgtctcacctggaccctgctgtgggcacacattatggagggggatcctctag

SEQ ID NO: 161238 - DNA, 440 bp, Homo sapiens
tgaaagatggttgtaagctatgaaaagtgatagacagggttgctactgaggtaagtgagcaaggaaggatgataggcaaatctgagcattcaagagtagatgcatggagatacaacatcaacaccaggattgataaaagaaaaaaaataaattgataaagttttatcaattggtaaactgataaaattttcaacaaaatcaaaaacttttgctttttgaaggataccattaaataaatgaaaaggtaatccacagactagaaaaatgcatttgtgggccaagtgtcaccggtggctcatgcctgtgatcccagcactttgggaggccaaggcaggcggatcacttgaagtcaggagcctggccaacatggtgaaaccctgtctctactaaaaatacaaaaattagctgggcatggtggctcatgcctgcaatcccagcta

SEQ ID NO: 161239 - DNA, 367 bp, Homo sapiens
gggttgccatttccactctggtttggttttgtttgttagtccttatctgtcctggctaaataaataaaatggattttcactcatattttggccaaaaacaatagaaggtcagagcgccattaagaggcagagagggcaacagcgtcagccagaccagagctctccagatcccccataaaacctccggaccagagccaagcagaatgtgggcagccaggagggccaggccagccagtggggtgcgccccctcttcacctacacaggccctcccaggtagagcatggactctttgaaaggacgatgcagtcactgtcagctacactagagcatttcatcttatttggaggcatgttcctaagtattaga

SEQ ID NO: 161240 - DNA, 175 bp, Homo sapiens
ctggtgaaaggtgacactgttaactaagaacgctggagtagaaacaggtttatggagaaatgacaaaattttgttttggatttattaactccaagatgcctttttggaacagttaagaaccaggttgtttttagagaaagggagtgggactgagggtagacagttgccttactcc

SEQ ID NO: 161241 - DNA, 184 bp, Homo sapiens
cagatgcccacattctggaatgtcagtgtcacagattgaaggtggccacggtttttacattgctcccatcaggaaggggtggtctttgggagcaccaagggagaatcaacagctgtggggtcgggtcccagctcgtctcataagctgctggtgagaccctgggtcagtcccttttcctttctgg

SEQ ID NO: 161242 - DNA, 283 bp, Homo sapiens
tttttttctaacttgaattgacctacatatgcctcttttgtggtctagggctgccttctgtgagacagctagactttgctccctatttctctccttgtttttatatcctactctcataaactcacactgtgctgttaaaagaacagacttattcatgaatatgcctaccataatgatagccatatagcaatgccctgaaaggaataaaggattagaaaaagattctattgttactgtaaagaataagctagtcttacagtattgctgtgaatgactaacccag

SEQ ID NO: 161243 - DNA, 199 bp, Homo sapiens
ttaaaacatcaagtgttttaagtttatacatgttaatgttaacatgtaaatgaaaatgttaaggtaatttaattaagtttataaatgtaactgattatttaaagcagaatttagtgttttcaacttgggttagtcaggttttattcagagtctcctgaaagataactgtcctacttttacataaaaagtggaaattttt

SEQ ID NO: 161244 - DNA, 310 bp, Homo sapiens
ctcaccagtgtctcctcttctctatctgcacattctctgtagatgatttcatctaacccatgtctttaatgatgactccaaaatttttatctcaatgtcatctctctcctgagcactaaaccagtccgtgtaaatgcccactatgggcccttatcctgccaaaatcttaacctctgaaactgggcacatcccctgcctacatctcctggccccccaacaccagcttctcttcctgggtcccatttcacgatccatggcacagcgttccattctgtcaccaacacgacaacctgggagtcatcttcaacca

SEQ ID NO: 161245 - DNA, 141 bp, Homo sapiens
cacttttcaaacaaatcacctggaacataaaaggttcagtttttatttctgtgtcttttaatttgaacataagacaaaaccattggtgcaatatttttgctactacccaataactatgccactttgggtaattattgggag

SEQ ID NO: 161246 - DNA, 366 bp, Homo sapiens
gggtcacaaaagcaatgactacggtaatgtagataactgaggcaggccatgtaatgcatattctagaagaggggcactggagcacgcatgacccatctatagcatatggtgacagctgctacttagctccagctgatgactgctttgaagaaagaggacaagggtggctgtgtcttccaatttttcaagggaagctgaaatctagattatgaaaaaatcagttcctaaatgttgactcataaacacctgcaggggacaaataaacttagctacagactaaatatggctccaagactcctagtcaagacctctgtttcatgagaagtttatttctaatgggcagatatttccattggaaagatgtca

SEQ ID NO: 161247 - DNA, 333 bp, Homo sapiens
acaacccgttgattttgattgagttacatgttgtaacagattcaacaatatattttcgaatgggtcagctccgtgctgcactcattggagtatggttttacaatgactgaaacacccagcttatatttcatgcagatctttattaataaagatgtgtttcttgcacaaaatttatttatcccatattgccagctgcgttctttacttgtgaagttacaaaatccagctgcttgattttttttaaaaaaaattcatattcgctgaaagatgagcaaggcaagtgaaattgcaaacatctgattggataccatattccaaatttacttcctcaat

SEQ ID NO: 161248 - DNA, 299 bp, Homo sapiens
agctgggactacaggctcacaccaccaagaccagctaattttttttatattttttatagagacgaggtttcaccatgttgcccaggctagttctttaaatcgtatatattctggatactagaaccttaccagatacatgatttacaaatattttctcccattctgttcactcttttgatggtattgttggcagcataaaagcttctaattttgatgtagttcaatatatctagtttttgtcacttgtgcttttggtgtggtatctaagtacccattacctaatccaaggtcacgaagat

SEQ ID NO: 161249 - DNA, 714 bp, Homo sapiens
atgttgtagaggttagactcacttgatgacttacatggcttgttttcaagacctcttgaacaaaatatttaattggaacaatttatttgctatcagttcttttagtggatagtagatattcctggtaatatttacatttttcaagtcatataacaagtattgagctcttgctcttgttacatataacaagtattgtagctcttgttacaggtaacaagtgttgcagctcttgctaccgctgtacttgttggtatgtattaaggataacatttgttaaaaaggcccttgccctctgatttaaagtcaggcaggaaagtaatgcatgcaaagcacgtgagcaatgtggtctggctgtagagtatgtgagaggcaaacacggatatgaactaattatattaccattagatcacaaaatcaggtggtaaacactctagaagggcagagatggtgaaaattaatggaggctggagttataagaaactaataaaacaatgtttcatagaaaagacccaagtactgttagaccttaaggaatgggtagaactgaagtttggttttcaaaatcatagagacagcataagccactgattcccccttccactagaaaaagcagcccacagaatgagagaagatatttgcaacacatacatctgacaaagtacttcatatggtttggctctgtgtccccacccaaatctcatgttgaattgtaat

SEQ ID NO: 161250 - DNA, 337 bp, Homo sapiens
ccaactaaattagacttcgttattccttctcgtaacatcacagtcttttccttcatagtgcttatcacaatttgtaattatgtatttgtttatgttaattaactaattaatttattattatttattcctctgttccactaggcaagaactgtgtctattctgttcaccatatcttcagagcctaacacaggtccgacatatcttatactcaataaataatttttgaaagaatgagtaaattaagaccaaagccaatataagattagtgagtcttcacaaaataaaaatcatagctacatatgcttttaatccccttcacattctactcctcttctag

SEQ ID NO: 161251 - DNA, 462 bp, Homo sapiens
gtgatgctttaggtcaaagatcagcaaacttttcttttgtaaagggccagaaggttaatattataggcttcatgagccacatggtctctattgcaactatgtgactctgctgtatgctctgctgtggcatgaaaacagccatggatgatacaataaatgaatggtgggctgtgtcccaataaaactttatttacaaaaacagacagtgggccggatttggcctatgggccatagtttgctgacccctgctttaggtaattgtttcctgaacttcaatccttttagtacgactcattatattgtttaatctgagtagcatctgcaatattgtttacttaatttttccccttaaactgacttacgttattttttttttaaccaacaacttaagtttaatttataaggagctctctatcactaccatggaaaagcagtattatatgtccttaataaggaatcacc

SEQ ID NO: 161252 - DNA, 175 bp, Homo sapiens
ataaacacaaaaagatcaagggaacaaaattcctgacggagagtatactgaatccatgtgaaattctttccacccttcattctatttcccaatatcctgccaatcatttctctgcaataatcagaattggttcagtgtatttttctgtgctcaacaaattaggctattagctgat

SEQ ID NO: 161253 - DNA, 271 bp, Homo sapiens
taaataactcacctcagttcataaagctaagattatcacctagacttgaacccagaccctttcctacaataagtgagttccccaaagatggagggatgagtgttcaaggacaccacagccagaatgctaccagtttactgaactgttccttactattccatgactgacatgactgacatgccttcaccaggacacagcatgagttgcacaggggcccagggacacgtcttgtgcccagctccccggcctggccagccttcttgaggagccc

SEQ ID NO: 161254 - DNA, 489 bp, Homo sapiens
tttaaaaaactagatgttaaagtataaaacttataccagaaaagtcttactaagaggagggactagaaaaaaaaaagtcaagccatcatctgaattttactacaataagtaattattggaatttctacatgaaaggcaattagaatgtatagttggttaatgtagaaatttaagagatacggagaagacactgcccatttaaaatgtatccttttaaaaccactgaacagagaaattcttaatacaattgagagttagttttaaagtagcatacatgtattacaggcaaattagaaatgttggcactacaaaggacctgtagaaatcatctatttactgagactttcattttagaaatgagagctttgagtactgaaattgtcagaacagaataagctattttaaattactgtatatttggttttaagtgaaacacaaatgtcttttacattcttttaagagttggaagggaggttaaattttttagaa

SEQ ID NO: 161255 - DNA, 825 bp, Homo sapiens
caggtgcgacccaccacacccggctgcaatgtttgttttaattacttttggcaagtatttcctgagtaccccgagcgtgccaggtgaagagagacggataataacagcgctagccagcacgtattaagccttgcaaagctgcacgggcatgaacttgtggcttcaacacaaccttatgaggcccaccacagctgccaaacatgaggtgatgggacagccctcgtggcctccacccaccgccctggtggagaagtgaaacatgaacccaccagtgcaagacagaggaagaggcaccagcgaaggcaagaaaactgaagctggacgctggcctccagtcctgtctttgccattagcagccctgggatcttagtgccttcaccacctggccaatacagtaaaaccccgtctctactgaaaatacaaaaaattacctgggtatggtggtgggcaactgtaatcccagcgacttgggaggctgaggcaggagaatcactttaacctgggaggcagaggttgcagtgagctgagatcgcaccactgcactccagcctgggcaacagagtgagattctgtctcaaaaaaacccaaaaaacaaaacaaacaaaaacatttgtttccctataatgaataggattgcttgtgttttaaaagggagtaacccaatcacagcacttgcagataacattatatgttgcctggaatctgatttaaactattccacggggtggggggtggtgcagaaataaagccaaattatcggaatctaaaaaaaaaaaggggggcgcgctttttgtttacacaaccacggtattaaaaccttcttgg

SEQ ID NO: 161256 - DNA, 135 bp, Homo sapiens
aatccacgctggggagaagccagccctacgaatgcaaccagtgtggcagagccttcagccagcttgctcccctcattcagcatcagaggatccacacaggagagaaaccctatgaatgtaaccagtgtggcagag

SEQ ID NO: 161257 - DNA, 438 bp, Homo sapiens
gatcccactctcggccatgctctcgtgcctgtctgccgtggaccggctccaggggggggtccctctgccaccctgtcgactcatctgggtggtgcagagggcagtcagcccgcccagggtgaggagtaagaggaggggtgggggttacgggtaattcagccagcagccctgatagcactgcctacagtaagtgctcaacaaataagctgttttgatcaggggatgggagagttggggggattcctgggatgaaggacatgtggctgctggcaaggaaacgcattttcttacatttcttggtgggtgtggggttatcagtctccaaagctccaggagagggaccaagttgacttcaactagagctactccaacctgcccctccctgacgacgtcttgcgtggttcacgcctctggctcctgccggaaggaggcggccgc

SEQ ID NO: 161258 - DNA, 322 bp, Homo sapiens
ccagaactggcatcgctaggggctattatgtgggcacagaaggccgtttcaggagaaggggcccaggcaggctccggtggccgcaggagagggggttgggaagtgtagctcccaagtgtcactcctgacgcacacagattttaactttgggtaacaggcacatcctaaaacactctgggcctctgggctgggcattctccattctctctaagccatgcacccctttaatacaacactgcagttttgatgacattctagggtaggccctgggtagagaacctctgctatatgcttcaagagcctggttctgcaagaacccacg

SEQ ID NO: 161259 - DNA, 319 bp, Homo sapiens
aaaatagtgctctctagtattttataggtacataaaacatggacaaccactgacattatatctaccttttggaataatttcatctgggttgcctgccatcccaactgcgtatcaagtgacaagaaaagagtaataactacaaagtccttgaaaacagccagaccaccaggattgaaggggtagtcatcaaaacacaattttgctaactgatcaggtatgaggaagagacaatagcaggatactcaacaagctggagtatagtgttctgaaatgtgacatttccaaatagggaggacagagaagtgctttagattactat

SEQ ID NO: 161260 - DNA, 254 bp, Homo sapiens
taacatatgtgcaggttcacccacagcagaattgtttcaaaagctcaaggttgggaaccacttacatatccatcaacagaagtctgcaaaataacatttgatatttccataaattgacatattctgcagctggtaaacaatggagcaggtctctatgtccttatatggaatctcaataagaaattatatggcttgcatttgggagaggttttccaatcaccaacagagcacagagaatgaaggagagaggcgtt

SEQ ID NO: 161261 - DNA, 236 bp, Homo sapiens
  misc_feature (12)..(12): n is a, c, g, or t
aagatttgtcantttacaaatctatttacaatactagagtttttagtcacctgatactcaggactcaacgtctgtactcagacgagccacgagtgcactccagcttgggcgacagaatgagaccctgtctcaaataataaaaaaataaataaagctctgcattttggcagttgtgggtcgtctgagtacagacgttgagtcctgagtatcaggtgactaaaaactctagtattgta

SEQ ID NO: 161262 - DNA, 467 bp, Homo sapiens
gtctggaagtgaactctaggaaactgcactggaattcaagtgtaatatgatgataaacatcaaatgactgtttgtagccgaggtgcaaggccaggctcttcaggaaagaatgaataggagaccttaaaataaacatctgtttttttattcagctaacagtggactttgaagaagattggggccatgttcagattttctttttcttccttgagaattgaagaaaaatgtcagctgaggatttttttatgctatttaacatgtcatttgtagtgtttcatgaaaagcagacagatatgtaaagctttttattccacttcaaattagaataataagttagatccagttttgaatttaaaagagaactttaacagatatgttttatgagtgagtttcatgattttgaataaaattttcacacacttaaactacagtggtttggccaggtacggtggccacaactgtactcc

SEQ ID NO: 161263 - DNA, 699 bp, Homo sapiens
agcgagaccctgttgatttttattttaaaatttaaaaaatattaaaaagagaaaagagttaataaagaaataatagtggctaatacttattgagtgctctctgtgcgtcaggcagtgtcatgaggacttgcatgtgtagtgactcatttagtattcctgacagagctacgaagcaggtgctattattagtctcctttttagatgtggaaactgaggcatgagagatgaagtaacttgctctcagctagaaagcggtaaaacttgtgcttgaatccaggcagtttgcccttaggagcctgaccttaaccacagctcttactgcctttggtcacagttgatcccccgtatgtcctgataatctcttctaattagcccaggtctttgatgatgcccataattgaattagaaaatactgcagaaacaggtttggggcactcattcattcatctagcaaatgtttgctgagtgacaaccatgagatagtgttgagtgctgggattacaaagacaagaggtgtaaaggtaatgggtccaatgacgtctagtggagaagagataagtaagagaccatcacaggatagtttgatagaagaggcaagcacagaatgctttgaaaaacatggagggtggcacaatccagattaggggtatccagaaaggccctgtggtgggaattgccccttctgagcatgaaagaatg

SEQ ID NO: 161264 - DNA, 177 bp, Homo sapiens
cgagttgattttatcaatataatgagagataggggtctagtttcattttttttggcatacggatatccagtttttcaggcaccattgactgaagagactgtccattcaccagtaaatgttcttggtgcctttgttgaaaatcacttggttgtaaacagctggatgtgtttctgagtt

SEQ ID NO: 161265 - DNA, 275 bp, Homo sapiens
gtggcacgatctcgacttactgcaacctctgcctcccgggttctatcagttctcctgccttagcctcctgagtagctgggactacaggcacatgccaccacacccagctaatttttgtatttttagtagagatggggttttgccatgttggccaggctggaagatttcagtttctaaaaattcgttgaaacttatttagtggccttatatagtctgtcatggagaatgttctatgtgttgataagaatgtataaccagcctggcaacatagcaag

SEQ ID NO: 161266 - DNA, 243 bp, Homo sapiens
gaatcttggaagtacttgcatccacattacctgaatatgttttggggaaggatatgatgtttgaccagggaaaacttcagctactatactgcagaaagcttgttagttttcccttcagtcagaacaggctaaatgagaatctgtgcaacttccccagctcacataggttgttaatttgaaacagtatcatggtggaccaaaagagatttagcacatgaattaatgacatattcgacactggag

SEQ ID NO: 161267 - DNA, 138 bp, Homo sapiens
cagactccaaaagaaaaccccatcgtggggtgtcccaggccgttgggtcgtttatacccagagtggcctaaccagagaaatccgttcttttccctcaaaacttgtaaagcagctggcgcctcagcttaaggagcgtgg

SEQ ID NO: 161268 - DNA, 600 bp, Homo sapiens
cagtgtgtcagaaagttagcccctctcaaaagtaatatgaatcaatggattaggaagaacttaagcttgtgaagaaagatgtgaattaagaatgagaaaaacgagttaattctaaccctggttctagctgctatgttttaaaacatcatagagactcaattttgtcacctgtaaaatggaagttaaatacaacaggcaatcttctgagtaacagtgaatgttaaaaatctaaagagtaacaattcaaggcagacaaagaagctccatcatggatgctagggcgtaaggtgctgtgtaaatggtgaagagaggtgactcatccccctgaatgagaaatgcgttggagggaacagaaagagagccaagttctgtagatgatcagaccaagagaaaggccaaatcccagtgggtgagagtcaccaggagtggctgcaaagaaagccagcatttagacaaaactgaaagagggttgggggaccaggcagacattatgtcacccacggccaagaagagaggcgagtcctgtactggagtgagttttagtaagtggatgaagggcatgtccaggagcatggctgggcctagacactttggatcctc

SEQ ID NO: 161269 - DNA, 660 bp, Homo sapiens
ttggataatagtctggcagttcctcaaaagtttaaatatagaattcccatgtgacccagcaattgcaagagagctgaaaatatatgttcacacaagaacttgcacacgaatgttcatagcagcattattcataatagcccaaagatggaaacaacctaaatgtctatcaactgatgaacggatacacaaaatgtggcttctctttaagagtggaaattattgaaccataaaagtggatgaagtactgatacatgctacaacatggataaaccttgaaaacattatgcccaatgaaagaagccaagcacaagaggccacatagtgtctgattccatttatgtgaagtactgcatagtttcttataaaatagttgtacaactttgtgaatatacagataatcactgaattacacactttaaagtcatgaatattatggtatctgaattatatctcaataaaaaacaaaaaagtctatgtgcatttataatactacagccattatatttaccctaattacattttttaaaatatacctaattttcccttatacctttttgaataatgcaagaatcatttaaatgtatttttatgaactttttaatataatccttaattttagttttccaaattaggtggggatagaggattagttgatattaa

SEQ ID NO: 161270 - DNA, 380 bp, Homo sapiens
taccttctggaatgccaactccatggtaaaatacactgaactttctctccacctccttgtggaaacctgactgacgttcctgaagacgttgtctcccctgcagtcttctgaagaggaagctgctcttaacccccaatgctgggatgcagatcacttataaattactcatctccatcctcatgtaccaacaccagcaggcagtgccttccaggaggttaccgtttcactgccatctactgactccatgactgttactcattcatgaaacagtcctggcacctatgttagtctctctctacttacaagtcctgctatcatgaatactcattatttatgtgaaaaaccacctcaaaactgtgcctactcactaagaagcaaga

SEQ ID NO: 161271 - DNA, 452 bp, Homo sapiens
gaactgagcttattatagtggacaaatggtaagagtagataaattaagaaccttaaaaccaacaataatgctttcatgtaaaaattaacatatttaattgtgaaatatagatatcttatatggaactaagttgaacactctggaaatatcccaagggaaaacagtgtctcaacagccagaactggtcactataattatcatagagtgggatctcaggtatggcagacagatgctatcaaatcaggtttcactaaagtacagaagatatgggagcgggtacggggaagtgctgggtagagaaaggcaggtcctggctggggctccactcctacagacctaggtgaggacaggcactcctgcttttgtgcctaactgttgcattttccaagaccactgtggtctgccatgcccccatcctgggctgggcatggtggctcacacctgtaatccca

SEQ ID NO: 161272 - DNA, 419 bp, Homo sapiens
cattttgctgagggaaacatctgtcacttcttcaagatgaataacacaccaacaccattattaatgtattcttaagtggtgtttagaatccacttcattctaaccattatgacatacatctttgctgacttgttcggaccccagagacctggcactgcatggctgctgcgcaaactgggtgacccctgatccccaagcatgtagcagagggtcaagttcacagcagcctgacaaacagcaggagaatacaccccccaaccccagtgagagagacctgacgccagtgagggccagtgaggtgagtgatgcctgctactgctggtgggcgtgtcaggccattattttggaaagtcatcagcagggtacttttttttttttttttttttgaggcagagttttgctcttgttttccaggctgg

SEQ ID NO: 161273 - DNA, 276 bp, Homo sapiens
tggcgaatgtagtatacaatgaaaaaatatagaaaggagaaaattgttctgggtgggagaaacagccagaggttaggccctatggaaggagcgggtcttggctctttcaggcacagccagagcctgtgtgactggacagaggggaatggggagtgacagccaaggggggtcgagtgacaggaagtgaggcacatcactttgtggggaactcatcagccacagtaaggactttggctctgagtgactcctccaggcctttgcacagagcagtgatct

SEQ ID NO: 161274 - DNA, 351 bp, Homo sapiens
attatttgttattgttttaaaaatgagaaaacagattttagagaggtaaagtaatatattttaaagtccagcttggaagtgaccgggttaggatttaaatccatattcgtttcattctaacactgggagagtgagctcctggtagagttctctttccagaacagtgcttgtttgcattctcttgcaaatttaagaaatgactcaatcagtctgaaaagtgcctaggtagagagagacccttgtttaagcactcacacccactacatgtctttgaaaattcctttgtgagtgccttcaagttagtgatcatactgtaccttccccttgagaaaataattcatgatatgcttt

SEQ ID NO: 161275 - DNA, 478 bp, Homo sapiens
ggcaactgcagtataatggggagagaatgacagaagctgaggtcctcaggagatgaaattggcaagacttggtaatgtgtggatgaggggagggagatggaagaagggctcccatgtggccactcttgggcttggctggggtggcccactgggcactgtggccactaccggggttagggggctggaagcctcaatgtgtggagacagatgggctctgggagtgctacgtctgcagcatgaatggcagccaggcagatggatacagagctggacgggtttggggctgggaggacagagagagtaacaggagcgctgggaatggcctaggagcaccatgaaggggagaagggagtccaggatgccagggaaaagcacagaggatgaaggggtggctcaaacagcctgagaatgtcccagtctgcaccgggaggggcaggcagggatgagggctgacattagatggaagaggctgggacag

SEQ ID NO: 161276 - DNA, 412 bp, Homo sapiens
agacacattcagggggaggatggtggcatcacgttgaagaaggcggcagcaggaggcttccaaaagaacctcccagcttcaagattctctgactcgagatgagacgccatgccaaccaccagattttatgctttctctctctcagatgctccaactgaggtagtttagtaaataaactgtgtttatgttctctagcattcctgaagcagatgtaatataactgaaggcaaacaattttagtaatgcaattcatgcattgccatctaaacaccacgtcatcatgaaactgaaatgtttaccaaataatcaaagcccaagacaaagaaaccgaaaggcattctgtaaggcaaagtaccagccagtacttccaataaaataatttattgagagttatcctggagtggcttgtcag

SEQ ID NO: 161277 - DNA, 308 bp, Homo sapiens
cgagaccagcctggccaacatggcaaaactccgtctctactaaaaatacaaaaattagctgggcatggtggcaggtgcctgtaatcccagctacttgggaggctaaggcagaagaatcatttgaacccgggaggcagaggttgcagtgaaccgagattacaccactgtactccagcctgggcaacaggagcaagaccctgtctcaaaacaaaaagttggtttccttccgtttatccatatcagaggccctcccttcccttcccagctgtaccagaattaataataatgccaaatacttaccagcatcc

SEQ ID NO: 161278 - DNA, 382 bp, Homo sapiens
cagaatgttctaagcttggggtgagcggagggaacgctgctgggtggggagtgggagaccaggctcggagacaccgcggatctcctctgatgagggcgtgatgaggttctcatctcaggtcctctgaatggcggctgcttctgaggagaccctttcccctggatctgcccctccagaaacctccacttaggtccaggtcccaaggtggatggtaagaggcggctgtccctgccacacttgatgggtgagtgtgtgaacggggctgggagcaggacacttgtcacttctgtggacagattccagaggctcatgaatctgctgctggggaaggtgcctgatctagcctgaccctccacccccgcctcccccttcccgcccccct

SEQ ID NO: 161279 - DNA, 404 bp, Homo sapiens
aggggatctgcagggcattcagcagggtaatgggtcagttcacgcaagtaaagaaactactcaaggctggagaaagaatcaccggaaaggattaggagaaacaatacaaaatgctcacacagggctgggaataatgcctgtccccacctgccagactagaaaacctaatcactcatggggcactgagtaaagtactcagagggtcttgcctcagtagtagataattaatcacagcctaaaggatgctctggtcctgccagaggaaagcacaaagaaatcaaattatttctaagtaacttaactacatcccagaacaaagactgagaatatttataggaatatggaagtgtccaggactcaaatagtaaaattcacagtgtctggcatctaatcaaagattacca

SEQ ID NO: 161280 - DNA, 530 bp, Homo sapiens
ctgcatcgccgctcgcaccccgcggccccgtgccactcggtcccggcgcccgcctggagcctgcagcaggggccagaggacgccgcgcggctgccaagcgcggcgaggtggcgggaagggaggctgggtgcagcacagccggcctctccgctgaggaagagctccggctcccttttgttagcaaaagcaaacactgccctcttctttcccgaccgcgccaacgcgcccggcacacgggcagccacacatcgggctccagccgagtgctcggtgtcttcagggaaggcaccgggcgtgcagagccgcccctgggcaaattcccaagactgctcttcacgcagggagcgcgcggaggcccgcagggtgcccgcctggccgcagaggccgcgacgccccctccgccaccctcgggccgccgaaagaacgggcagccgggaaatcccgtgtccccactcgtggcagaggacgctgtggggcgggcgggctgcgggctcccggcgccttcccgcagaggcggcgacagcggccgc

SEQ ID NO: 161281 - DNA, 630 bp, Homo sapiens
cacttctgtcctctttggatgttgtcctgtaaggggagcatgcttggacctgcggcagctacttgcaactgcaggagggaaggcaatgaagtcagagagaagccaaaatagagccctggtgtctctacactgctagtctcatcctggagtcacccacctccagccttgtgcagaatcaaaagacaaatgtctatgattgatgccctggctactgaaagtgtggtctgtgggcccctagcatcagcctcttgggagtctgccagaaatgcagactcttaggctccaccccagacctactgagtcagaatctgaacattaactaggtccccaggtgatccatctgtgagttaaagtatcgtttgtcccttctaacagggtattccactaactgcacccaaaagcgttctgagacacagatggaatgcttgtaaggttagtctttgccacagctaagtgttcaatcaatcaataaatggtgcacagggctggacacagttgctcacgtctgtaatcccagtgttttgggaggtcaaggtagaaggacagcctgacctcaagggttcaagaccagcgtgggtaacatagcaaaatcctgtctcttatttaaaaatttaaaataccagcctgggc

SEQ ID NO: 161282 - DNA, 376 bp, Homo sapiens
tgagaccagtgacctgattcctgtagacttcaaagcctaatgtgtgtagagaaagagtctacctctcttagtcacttaggactgctataccagattgccatacactgcatgccttagacaacaaacattcatttctcaaaggtgtagaggctgaaagtccaatatcaagcagatgaggcctctggtaagggcctgctacctggtttgaagatggcagtctaacccttatgtcctcacatggtggagatatgtctgtaatgtctgtctagttttggtgttagggcaatgttggccttataaaatggaatagaaggtgtttcctctgcttctgttttctggaagagattgtagagaattggtatcatttcttccataa

SEQ ID NO: 161283 - DNA, 367 bp, Homo sapiens
acgaagtgttgtccctgcataacccttggacgccgatccaaggaggtgtcacgctagtcgaggcatgcactctgtctgggagcttcctgagccaccagtggcgcctttttcgtctaaaaacttaaacactctggactgcccgcctttccacgactccgcccaaataccacgccctaggctaggggcacgcccacccggtcccttccatcctccaagatctttctccaaccccactaaccagcctcttccctttcccaaaacctcacccaaagggacacctcataccctactcctactcttccctggaggctggccaccctccagaccttgaaccagatagaaatgcaccctgcgcaggacccactcg

SEQ ID NO: 161284 - DNA, 386 bp, Homo sapiens
ttgaactctgtgagttgaatgcaaacatcacaacttagtttctgagaacgcttctgtctagtatttatgtaagatatttccttttctaccataggcctcaaagccctctaaatacaccctggcaaattctacaaagagagtgttccataagtgctctaatgaaagaaaggtgaaactctgtgagttgaatgcagagatcgcaacgtgctttctgagaaaggttctgtctagtttttacatgaagatattaagttgtctaccgtaggcttcaaagcactctaagtatgcacttggaagttctacaaaaagagtgtctgagaactgctctttggaaagtaaggttcaaccctgtgagttgaatgcacacatcacaaagaagtttctca

SEQ ID NO: 161285 - DNA, 146 bp, Homo sapiens
tatgtccactgtattctagttagaaaattaaggagatggaaagaaaaaggttaaggagagatcccagttaaatatcacaaattaaacacctaaagttttctccatatcctccactaaaatgacaataatggaaagaggaagaaaag

SEQ ID NO: 161286 - DNA, 567 bp, Homo sapiens
gccatggcagcgtgtttgttatgccactgtttccttctggcctctcacagctcagttgctagtctctgtttcaggatagggtattaactatctgggcagcagcagctagtagacttcttcctccatccaagagactaagccatttagttccctagtctcccagctactgtagatgcttacctctgcctctgatattcgatccttggaagtcttatttttccaagagtttggtcttctcaactatttcctatagaagcaaatttcctttcaccaggaatgtgaggtatagtcaggttctcctctttagtttccctccattcatctcctttgatacagctagaaagctctcagctctttccccaagaatcatcaaaagaggggaaatcacataaagactgggcagatggtgggtgcagatttagctgaagagttcagatctttgagaaggaggtgcattcatgacaaccaaggttagatgatgtattgagatgggcctatcctttgggcctctttcagcataagctttcaagcattgcttttaggggaggggccactatgagtcttaag

SEQ ID NO: 161287 - DNA, 915 bp, Homo sapiens
ggtggctggcagtgggagaatgtccagcaaaagggagcccctgctaggactggaggcccaggctgtgctgtccaagtgtaagagccgggctgaggccggctgcctagaggtgagctccttgagctgggttcagttctcagctatgagtagcaggctgcttcccgctgggctgggctggactgggcctcacgcccatctcacgccccacactgggccccagctgagggttctgcacaaaggaaggaggtgttacccacagcagggatggacagcaaatatgattcatctcgggagccatgtcaatcgactggtacaagatacctgaagcactgtggtgagaattctgggcgtggcaggaaacggtgctaggatcaattagtgttgcctgtcacaggccaaggataggagaaagggtaagtggaacagaagagcctcatcaatttatctggaggacaagaggcagcatctaggaaagaggctcctgattgactagtcatgcctgccatgcatagagaagagggtatcatatagggagaaaaacaataccttaatcacttagccacatctgctatagaacaggagtgctggcaagcttatttggaaagaatgctaggattgcttagcaatgtctgccatgggcgtgtgctagaggagcggcacaaggcaaagagtgctagatcaactagccatgtctgccatgggcacaagagggcaagatttctgccatgtggaaaaatatgctctgatccatgagtgacatctgcataggagatagaaggaggaggggcagtgccaagaatgaattctggtctggcttaagcgagatcttccacagccagggatgtgaggggaggcaggggcggtgtgtaagtatttgccatccctgacctacaggaaaccaggaaaacctgccag

SEQ ID NO: 161288 - DNA, 507 bp, Homo sapiens
cctccccctggatccatctgtgttcctgttcatactagacaacagccctatgtcctctctgaagaggagacccccaaggacaaacactggctccctgagcatcagaactggagggatcctctcagaggagcaggagtctgggcccagccccacaagacccttataatttgtccaaagacaaagagaagcagtgacagaaccaggaccagaagcctgtccttataaaccctgatcatgagttctctgcaccaccacacaactgtgtctttccatgccaggacctgcacatcagttcacctttcctggtctccaatctctgcctggaacaaggacactgtcccagaactcagatgaaatctgggaagcatcctcatttcctcattctcccccccacaatccaactggtccgagtcctgtccattcaaccttgtatctctcagtatttattctactcatccccacaatgtcctaatttaggcacttttctctttcacatgggcttccgct

SEQ ID NO: 161289 - DNA, 1909 bp, Homo sapiens
cccaacatctgtgctgatcctgctaggtaatgacgccccttccttatcgttctagagtcaagcctagatcccctacaaatacccatgcacacttagagctcactctggttaaatgttccaagaaggatgttggatggtcacttggtatcatcccatggagttcaggatacccccgccctctgagcagccattcctctcctgagcacattcccctagagaagctctgcacgtgtgcacaggcaccagctgcaggagtgccatccacagcacagctgtttatgaaaaaccgtaatcaacccaaacatctgtatgaagaaaaacgaagaaatgcagagtggcatgttcacatgatggaatactatgcagctgagaacatgaacaattggagccatggcatgaatgaagctgagagatttgaagcgtcaaccaagtaagctgtaggagattacatgtggtggaagactagtttataaatctcacagacaagccttaaagaaaatgtatctcttgaaataaatgtatacacacaattatacacatatatatgataaacccttttaaaaggcaagggaatgatcaataaaaacataaactgttccctctgggccaaggcggagggcaggccatcagatcagcaggaagttgatctggttttgaattgggttgtgtgtgcactggagtcaaacattattttacagaatatatttcatatatattttacacatatttgcttttttgtttcagatatttcacaagtttttaaaaatgtaagcaggtcatgaggccgctgtccaggacagcagcatgcccgtttctggtgatacttggtgcagagggtaactccagcagctgtgcgtgctgacccctccagccagctctgggcaaggggttgtttcctcccagctcagtggctgagcagagctccagctggcgaaggacccaggctctgccaacattgtggacatcccctccacaggccctggggtgccctgtgcagaggcagagggtgaccgggagcagtgggcagagcccggaccctcctatcccgggaggagcctcaggtcctctttggcaaagagcaggatccggtagcttgagaagctgtgcagctgccgctgggtgcaccctgtcactcagcaaggcagctgctccggaacaggcactgcttctagaatccacttccttctcgcaggaccagatgtgtcagcaggtgacaagaacaagtccaacgccacctcacaagggctttggctttgggatcccctacctgcagggcctgggttttggagaataaggcttggccccaagagtattcagatctgcagcagagcaagatgggatgcaacatatctagatagataacctcaccccaatcacaggcttcgtgcatggacccggtgcaaagggcaaaggttatgaagtatcacttacccaatgccccaaagagcccttcaggcctgggaggaaattctcaggagagcctgtggaagaagaggttcagtggagggacgctgctgcctgggaaggagcctccagcccttccaaaggccacactttcagcaaacttcacattaaaagacccgccagtgcctgatggttactgagactggtgtttgctagaccctttctcaaaaatgagtcaaggcagggcacagtggctcatacctgtaatcccagcagtttgggaggccaaggcaggcagatcacctgaggtcagagctcgagaccagcctggccaacatggtgaaaccctgtctctactaaaaatacaaaaattagccgggcgtggtggtgtatgcctgtaatcccagctactcgggaggctgaggcaggagaatcacttgaacctgggaggcggaggttgtggtgagccgagattgcaccactgcactccagcgagactctgtct

SEQ ID NO: 161290 - DNA, 136 bp, Homo sapiens
gaaaagactaaaaaacaacacagatgttgatccagagccctaccatcttttggctgcctagctctagacttcttatcacttgaaaaaaagacattcctctttgtgctagactgatacaacagatggtcccagttct

SEQ ID NO: 161291 - DNA, 172 bp, Homo sapiens
tcagctcggtactcccctgcagactcaaatcaagcccatcctctttgctcatgccctgtgtttcagacatctcagttggctgacaatgcctgcgctgttcaccctttctcctggcttgtacatgccatcctctcagcccagcgtgctgtgccctcacttgctggtgaaatgg

SEQ ID NO: 161292 - DNA, 163 bp, Homo sapiens
gtgagagtgtttgctgctctcatgttcccatgcatacagagagggcctgtcagctgctctaggtataatcgagggggctgtcagacagtgcagaaatctagtcacaaagcagctgaggcagggcttagaggcagagctagggtggagggagaatcagagacca

SEQ ID NO: 161293 - DNA, 768 bp, Homo sapiens
ttaccatgtacatgattataaggataatgagaaaacaaatatgaaagtacttagcagagtacctgatatacaggaagcattcaatatatcttaacctataaaaagtaataagaagtgaatgtgcacatgaaggctgccagtctcgtgtctgccagcatccctctgacaccagtgctggtgcacacacacacatggatgccagtgaccctaccccctcaccctgtgccaccattgtgaacattcacatggaggccatcagccctgcaccctccagtccccagccacatctaacaagtatgcaccctgccacactgctgttgctactagtacgtgcaaatgaacacagatcccactgccaccgcccaacgaaggactttggttggcatcacccattggagtgttgtggccagtggtctgggaacaccttggctcctccagtgcagcaggttcataaccttgtggggccagagaacaaagctgagggcccaatacccaacccctcagaattagagcacacagctcaggagggctgaggtgagccttggccccctaaaatcttccagattgaaggaacatcaggccacacaggtgagaaagaactagtgtaagaactatggcaactcaaaaagccagagttgtcttcttacctccaaacaactgcactagttccccagcaatggttcttaactaggcttaaatgacagaaatataattcagaatacggataggaatgacgatcattgagattcagaaggaaattgaaaccca

SEQ ID NO: 161294 - DNA, 444 bp, Homo sapiens
aacgtttcagggcctctccataaggcctctcctgcagggtggttggacttcttacatttcaaagtgtcccaagcgtgagtgtcccaagagataggacagcaaagctaccaggcctgggtttggaagctggaagagtgtcacttctgggttgaagcaggcacagagcccactcaggttcaagtggagaaagagtggatcccacttctcaatgagaggagtgtcagagagtttacagacattttaaatctgccacactaaggatcaacctaaatgggtttccattttcctgggttgggggtggtaagtgtaagtacctatttggatttgaaaatcctgctgaacttattttctctattttgtggcatttgaactttagggacttctctttcttttttttttttttttttgagacggagtcttgttctatcgcccaggctggagtcc

SEQ ID NO: 161295 - DNA, 333 bp, Homo sapiens
agttgccctttttttctcttcagctcctgaagaacaccattttacttactctttctataattttataattcttctcagtgtaattatataatgtctgtttctgtttgactctcattttatttaaggtaatgttctcaggctttgttttgtaagatgtgtcagaatatccttctgttttaaaatgaaataatatgtaattgtatgtatatgtcacatttttaaaatctgatactgatctctaaagggacatttgtgctgtttccaggaattgtcttttgtaaataacaatgaatgaacatgcatgtgtaaatatctatttgaagtcctgcttta

SEQ ID NO: 161296 - DNA, 759 bp, Homo sapiens
gaattggatattgcagacttagggaaaggcaattacagactttgggagaatgtaacatgcaattgtgtattaatggatatggcatagaataaatatggctcatcataaagaactagcgatattggtgtggtacaaaatcaagatacttttgtgacctgctaaatagtgggtttcttttctgaaggcaatggagagctaatgattgatgtggttagaagagtgaggagaatttttcttttcattgaacccttttgcattattgtagaagatggattcaaactaactctatatacagagaaattggcaaaaagtttctggcagtgatctataaaagaaatcagggattaaacagtcacagtgggatggaattgacagattaaaaataggatttgtaagactcgagagactgatttgtatgtagggagtgagatggaagagtataggatgacatattttttcacttctgtgatttagaaagtcctgtcatttactgtggtaggaatttaaggggagaagtttgtgaaggtgaaacgtattgactttgagatatctatgtggaaagtcaagtagaaatgcccagtaggcagtgggaactcagatttaggtgagaagatttagtttaggaatcattcagcttggaaaatggaatacattatcttgtatgtatctaatgtaagaaggctgaaacttcagcttttaaaaaagcagacaaaagaagagtcaataattgagacagagaagctgcctgagaggctaggg

SEQ ID NO: 161297 - DNA, 584 bp, Homo sapiens
cttgcaacaaaccagaaagtgaggtataactattctaattttacaaacaaggtaactgaggcacagaggagttcagcctgtgttcggagtcacacagctggtaacatgaagttgaaacacaaatgtaacttttttctacaccttgtctttttaaaaccaacaacatctttcagacacttgcacactttttttcagataattggtgtatgtaaaggatttcacttcacatggactatttggtagatatataacatcttagatatagccaatatcttgtataggaacaatgtttgtatgaagtaaagaaaaacaataggataatcaatgcaaggtagaaagtgatagcacacttctgtgattaatactaggataactggtaaagagtatatgctattttgtattactatttccataacaatcacatcatgtgtgattgttctgatgtgattgttatcattaaccagtcttttactactaaacttaaatggccaattgaaacaaacagttctgagaccgttcttccaccactgattaagagtggggtggcaggtattagggataatattcatttagccttctgagct

SEQ ID NO: 161298 - DNA, 237 bp, Homo sapiens
ggaacacaagtcacaagtgataaaggtgcaagtggagccaggtgttcaccttggtcgttctgatgttttacctcagacctcagaatccacctttggaggaaatcagtgagggctcactattactgaccacagtttctcacctgtagttggaaagactttgcatatgctaactacaagtataaccttggaaaaacttgaatgtacagagtcagagttcacccattaagcgcaaagcct

SEQ ID NO: 161299 - DNA, 184 bp, Homo sapiens
gtagtatggcccagcttcctctttggtaagttatcatattaaataatgtacacacacccagaaagagaagagaatgaatgacctgtagtcattatttgcattaactcagtttggggaattcactccagaccatagcactcaaggctataaaaggagcaatggttttagaaacaggattttgcta

SEQ ID NO: 161300 - DNA, 392 bp, Homo sapiens
cagagtgagaccctgtctctctgtctttttttttgtttttaagtgtatttctttattagttgatgtttacaaagtatcttttcatacccaccaaattatgttttacttcagaaatttgttatgcctgcctacagtgtagaaatatttccagaagtagttacatagcaatttggtagggtgaccacctttactttaacaaatagcatttgaatgcattttattcacagtagtagaagggagtgactgtaaatagtttactgtttgttctttctggctctattgtcaatttcaagattcatgtggttgaagcttagaggataagaatgttagggtccatagtatgggtattatttttgtaagtcatttatttatttcagcaagggccaaacagg

SEQ ID NO: 161301 - DNA, 975 bp, Homo sapiens
ttctcccctggccgataggaatctgtctagttatctctgaagaaatctccgtatttggttccttcatcctttgcctgagaatattgcctgggtccaggagaatttagctgctgttacagtgtaacacaccctgaaaaaatcagtttgggtatttcaggcccccatttttatgttaactaacttatgattttaaatggtaatccttctgtgaacagggactacttaggatagctgcgatttagcttgcttttattagttcatacctgagataaaagcgagtttttcatgttttttaagcaaatgaaattttagctacagttgaactttgttcccatggaagttattagtagagtctttggtgttggagaaagagtctgaatttccttgtagtggtaataaccagaattttgaaagagaagatgacagcgaggctgcagagggaagtgaaaatgtactaatgatgagtatagatttatttcagagtaaaaaaagtgtagtgtgttaattttagaagcatttcctttcttgatgttttaccttgcaacttgaagtttttcaatatcctaaaatgagctgatttgacagtcaaaaagtatccttgaaaaaaatgacagcttggcatcttttgcctggctgacttttcccccttccatcaggtggaaagaaaaagcagtggtaaatttcaggcatagtcagagggaagccatttttacataattttagtagctcttacttgagtgcttactgtgtccatactatttcaagcatatggatttcatttcaagctgaggatgtgggcagagcccactcccattgcgtgaagtgcaaagtactgtaccaggcattggcgtatgagagtttgtaaaccacacttagttcctgccctctggatgctcctaatctagtgggcggagaccaagagcctaacaaatcatcatttgaaatggtggtagtttctatgaagagtaattatag

SEQ ID NO: 161302 - DNA, 556 bp, Homo sapiens
ccaaggcaaccccacaccatttcataacacggggctaggcacagctgtgccttggtggtccagtcctgtgcccacgtcagagctaagcacttgctacgctcctttttggcctgaaatcccacagacctggttctgagttccttcctccccactcctatgaccttggtcacgtctctgagcctcatgtcacaggtttccacaggaagaatgtgcagatccttcctgaatcggccccatgagccaaatggattgaagaacggctatcattcagtcaactacgcgtgggaaccgccgggatctcctgggggatgggcagtgtacgagtacccaagcattccatttgttcactgtggccaatcacgccctaataaaatgagacccttgtgtgaatgggctctgaaagcagcttacgataaaatctgctcatccccatcatctttacctaagaagaattttattctgtgaacttactcttaaccacattcctaaatgttctcaacatagtgtctactctgtaggaagaaaaggctgctttcaaaagagtcacacctaaggg

SEQ ID NO: 161303 - DNA, 525 bp, Homo sapiens
gcaattcaatgaagaaagatagtcttttcaacaaatggtgctggaatgactggatatccatatgtcaaaaaaagttaattctttccataccttgtaccatatgcaaaaatttaactcaaaatggatgctagactcaaatgtaaaaacctaaaactatcaaaacttctaggcagctttatttgtagtcaccaaaagcagaaataacccaaatgtccttcaactggtggtaaatggataagcaaattatgttatactcatacaatggaatactactcagtaataaaaaggaacaaatttctgctaacacaacaccccggatgaatctcaaatgcattatgctaagtgaaagaagccagactcaactggctacttactatatgactccatgtatatgacagtctggaaagagcaaaaaaaacatataaatgagaaagaaatcagtggttgccaggggctatggttggggaggaaagaaggactaccaaggaatattggagggatgtggaaatagaggtactggaactg

SEQ ID NO: 161304 - DNA, 447 bp, Homo sapiens
tcaatgttgatgattgctggctgatcaggagggtggttgctaaaggctcttatggcaacttcttaaaataagacaatgaagtttgcggcatggattataaagggggaatcagtacttaagtaaggtcaatataagttttcaagttaggtggacctgaatatgaaccctccaggcctttccaccaactagctatagagccttggacacatcttggccatagctggccccgacagacactctcccagcgggtgagtgctcaatgaacccatctgagccagttgcctcacccaaccagtgatataattccttccttgcagaagaataagtgaaaaaaggcacagtgccaagagaatcagacacacgaccggcggaaggctgtgccagtgctctaaagcaagttctgcctaaagcggcagaaacatttttcacattaggaacaggagttgt

SEQ ID NO: 161305 - DNA, 152 bp, Homo sapiens
ctcttcctcccactccttcctcagcaccttggcagctatgggaagctggaggaggaggaaaaagggaagacgccatgctccattagctctgggttcacactctcacagctctgatggacacaacttagtcattcattctctcaataaatata

SEQ ID NO: 161306 - DNA, 120 bp, Homo sapiens
aattcttatgccaactctaattgatcagtagtggctgcctagagaactgtgttgagaaacaacattttgagatttctttttctgagaagagtaccctaatggattaactgtgtctcgggg

SEQ ID NO: 161307 - DNA, 209 bp, Homo sapiens
aggaaattcaaatttaattggcaggtgtaggaagacaaggagatgacaaaaggaactggaaatgagtaatcagagacagaaaagtaaaagtaagagtagaatgtcatggaaggcaaataattggaatgtttcaagatcagggaaatgggcaataaagagaagaaaaaaatagtgaccagagggtatagtaatgtgtagaaattcatcct

SEQ ID NO: 161308 - DNA, 413 bp, Homo sapiens
ctcggcctcccaaagtgctgggattacaggcgtgagcccccgcgcccggccttttgttgtatttttaatatagccacatagcctgatctcttccacccagccccagtgaaagagaatggggttaagccatctaaactcccagccagaacgcactctctggtaacaccgatgtgcctaataccacgtggttttttcctcacccattttatacggggaataactttttaaaaatctctttgccatagcataatagtcatcactggttaaggaaagacacataaagagatgttaagcaggatacaatcgcaaggcatctcaccataaaatgagacgtgcttattaatgacacaggcaaacagcactaggaatggacaagtccacattaggtgcctcctgagatggtgtactgagaa

SEQ ID NO: 161309 - DNA, 901 bp, Homo sapiens
ttatagggccacaagcatgattcatacaagaaggggaagggtccattttaggtggtgatagcagtagtagacatactgtggtgggagcaaattggcagcacaaacctgaattctgtcattttagtgggtgagtgagtagtgatttaatcaaacttttcgcaaatgagtgcgaatgcaatagacagctgcacagtactaaatcctgcagcattaaataaacggtttgaattttgtatgaacataactttgaatgaaaaagtaaaatgtacaccctttccatgtagaggtgccacttcggagtcacgaacaaatctgtgtcatatggaaatgtgcacagtttcctacccagcctctctggtgccaactaacttgtatttgtgagagcctgaggaaaggaagtcagggtcattcagttcactctgtgtcttacaactttactctcgcttttgttattgaaagcagaaggaggcattatgtcagcgtatcttgataacagtttttgcctgactatgctttttccttttagtgttacagttttaatgtaagacaaatctttgaccattttttatgtatcctttcaaatttataattggtagaaatacttttaaatatttttgtaggggccaggcgcgatggctgacacctgtaatcccagcactttgggaggctgaggcgggcagatcacttgaggtcaggggttcgagaccagcctggcagacatggcaaaccccatctctactaaagatataaaacttagcctggcttggtggcacatgcctataatcccagccacttgggaagctgaggcaggagaatcacttggacccaggaggcagaggttgccgtgagctgagattgctccactgcactccagcctgggagacagcaagactccgtttca

SEQ ID NO: 161310 - DNA, 466 bp, Homo sapiens
agttattccaagcaggcagtattataattttacatgcattttctcatttaatcctctcaatgaccactatgaaatcgtatattattcccatttcacagatgaggaaaatgagacataaattggtaaataacttgtccaaggtcaatagctagagaatggtggagttaggactctaatccaagcaatctgatgttagaaaatcatactcctgaaaaacagggaaaccaaggttcaaaaaggtgaaatcacttgaatgtctcacagtgagttggaatttggactcaggtgcactagtgcatattcttctacatcatgctatagaagagagtcggggccgggcacggtggctcgcgcctgtaattccagcactggggaagccaagatgggcagatcacttgagctcaggagttcgagaccagcgtaagcaacatggcgaaaccccatctctaccaaaaatacaaaatta

SEQ ID NO: 161311 - DNA, 220 bp, Homo sapiens
attccccacctcagcctcccaaagtgctgggattacaggaatgagccaccatgcccagcctatttttaaattggattgtttggtttgttgttgttgttgttgagttttctgtgtgttctgaaatcaatcccttatcagatatatgatttacatatattttctcccattctgtgggttgcctttttactctgctgatagcgtcctttcagacacaaaattt

SEQ ID NO: 161312 - DNA, 481 bp, Homo sapiens
aaggatgcttaaggattctttccctcaaaaataagatcccttttgaatcttcatttctttgaaggaatcaagcattcttaaggattcttttcctcaaagataagatcccttttgaaccttcattactgtggtattatttaacatgttaggtattcagtagttactgtgttaattgcttatggagctatgtaagggagatatcttttcatccattcagaaagcatatactagcaagttccttttagatgtacctactcatgctgtgtccctacagattgtgcttgaagtggttgcattctgccagacaccacctaactatgagtatgcagtgatcatgtaaaatttttttttttaagatggagtcttgttctgtcgtccaggctggagtgcagtggcacgatctcagctcactgtaaactccgccttccgggttcaagtaatgctcctgactcagcctctggagtagctgggagtacaggtg

SEQ ID NO: 161313 - DNA, 294 bp, Homo sapiens
agtagtggactcagtaaatggagttacttccctttttcattttcttagagccaaagaatgacagaagtatggttttagctcacggccctgtgtgataataatgatcacttgaatgtgaatgatagtgtcccacacgtgaggccccgctcccacacatgaccaggtagaggggagtttggtgctagcagattctccctcctcctgtgtctgtcatcctccaactccaagtacagaggcctcagcttccagggagcagaggcaattttatttttaatcctccccgtggcctcaagc

SEQ ID NO: 161314 - DNA, 343 bp, Homo sapiens
  misc_feature (3)..(3): n is a, c, g, or t
  misc_feature (21)..(21): n is a, c, g, or t
agntcctatttcacctgctcnaggggaaatgtggagaattaaaaagggtagtgaggctggcatttatagaatctggctttcttgtattgggtggaaagctagatgaaaccagtttctctcagccttttctctcctcaggtcttgctgcccaccttgtgtgttagcccagattctgcaaggaaagaaagggtcgagggagggagctaacacttactgagatccttctttgttccacatcctgcatctggcgcttgacaggctttattgcatttgatcagttatgtgggcagtcagtattcccatttgagtggagagaaaaccaaggcaggtgaaatggaaacgt

SEQ ID NO: 161315 - DNA, 445 bp, Homo sapiens
agtcccaatcactcccacacaaaaaagaaatataatcccacacctgtaaatgcctaagtggactgtgccatccctaatataacaggtagcttgtagtcaaagaaaagaagttaagaagctggagcgtttccaaggtgattacagagcaaagacagacctgtcaacatactaactccaggtttacaaaaaccagccttcttgaagctcacaaatagggttaaactacatagtgatttagccaaataacctttctttgaacttcataaatctacaatgaaatgagaagagtgaaatgaaaaagggctgtaagggtcttccagctaggcagggggattgaacctctctcctcttgaatcctccctaaaatgacagtgaaagaataagaatagaagaaagccttggcatagacaggactggagagaaaatttagacttatttgtagact

SEQ ID NO: 161316 - DNA, 260 bp, Homo sapiens
tgagtggcatttgctgtcctagttaatcagagggtaggagaaatgaaaaactctcgtcttcccactcccatgaagtttcaatgggcactggaaatgtaggtcaaattgcatcaccatagaaaggagcgaacaggaaggtatttatgaagtgctgccaatgtctctttagattcagagtcatgacgaactggtattgagcccgttaggtgtgagatacagggaatcagggggcatgtttgtgatgtagtgccagaatgtta

SEQ ID NO: 161317 - DNA, 493 bp, Homo sapiens
tactggctcggctggctgtggattagaccacacctgctacaaatcaacaaataatgaacttcggatgctgagaacctgaaacactacataaaagagggcataaacaaactcttctttttcaacatatgatgggcgattgaagcggtcagtggaagatagctgtgcacaagaatgtgggcctcctcccttgagccaaggtctgagttttatgattcctaacttagagttaaaagaagcaagccatacaggtaaatgattatcaggcagagaggcttagaatgcattacagttatgcaaaacctgggtttttcataggtgttttcaatgttggcatgaacagtggagccaaatagcatcttgtagcccctacgtgggcacgattctttcctgggcgacaccgtctgcataccccatggtgacattcctgtgcgcttgctacagttggctagtaatcctggctttgaagaaggttttccagttccaatcaccatgt

SEQ ID NO: 161318 - DNA, 620 bp, Homo sapiens
ctcagagtgcggagcagcgggggaactgagttcttcacgcggtcggcaaccaagttcaagggtgccctggcccagaagttcatgtttgtggatggagaccgggctgtgtgcggctcctacagcttcacgtggtcggccgcgcggacggaccggaatgtgatctctgtgctgtctggccaggtggtggagatgtttgaccggcagttccaggagctgtacctcatgtcacacagtgtgagcctcaagggcatccctatggagaaggaaccggagccggagcctattgtgctgccctctgtggtccccctggtgcccgcgggcactgtggccaagaagctcgtcaaccccaagtacgcacttgtcaaggccaagagcgtcgacgagattgccaagatctcctctgagaagcaggaggccaagaagcccctggggctgaaaggcccagcgctggctgagcatccaggggaactccccgagctgctgccacccatccacccaggactgcttcacctggagagggccaacatgtttgagtacctgcccacgtgggtggagccagacccggagcctggcagcgacatcctgggctacatcaatatcatcgaccccaacatctggaa

SEQ ID NO: 161319 - DNA, 442 bp, Homo sapiens
cagttaaaatctctggtttaactgtcctcctataaagtttttcctgagttcctcttatgctgaattagccactgcactttttgcaaataatacctatcatagaaacctcctggggtagagattgtaccttattcacctattatctccctcacctgccaaaatatctgccacataaaaggtactccattaatgtgtcaaataactaaatgttgttaagaatcctttcttatatacataattacctcatagaaaaaagtaatttttggtctttctggtgcaaaaggttgcattattttataagatttataaaatattttttaaaagctatgtttcctttgtttttggaataccatagtgattttcaaagaaaacacattatcaggatcatctgagaaattcttttcagcctgaaaatgggcagcgcttcccctaacttgctccc

SEQ ID NO: 161320 - DNA, 232 bp, Homo sapiens
tctaacatatcaaattgacagcagtgtaaatagattaataatactccttaatcctgaaggaagacttcagctactaaagatttcttaatcaagaaaagaaatgcttttcttctttgtcttcgactactatcacaaaagaaaaagaaaataaaacaaaagagagtccttcattgttgaagtaatcccctagaaatagaattcaactacatttacagggtaaaaaattaccagg

SEQ ID NO: 161321 - DNA, 781 bp, Homo sapiens
tacattctaagttcttgcacagtcattcttatccttactctgatcatttgagttcctcacatgccatatagttctctatttgcttgcaccttgaaattcttttgcccctactttgattttgtcttttcttagctcatcagtttctttttgttttgttttgttttgtattactttgtttactcctgtcacagttcgtcttcaaagctcagggcttctgctttcttgtgactgtcttttcatctattttcctcatgtcttgctgtactgcttctcatctctgagcctatgatggtatccgtctttatcacacccactgcctcctccacatttttaatctaattgttacatctccacctccaatatcagtccctaaaaatagtgagacctaagcatcctctatcaggccacatcttgttcactttcttccataatgttttcattagacccaacggtaacctgcaggccattagcccacgctcactgggtcagaccattgacctctgctctcagtactcatttctaacttgaacatagtcattccctctcttaaatttcctagttgattctccagtttctcacctgcttttgccagcctctcatcacagtgaagaccctcagcctgagtttctcccacattcgtgcttgtatgtcagtgttgggagaaaagctaagtgcttgataagctttaggtcttctctgtcttcttaactctggttctacctcaactcccggactcgtccgtccgtgggggacctctagatcgaccagcagcagcagctgc

SEQ ID NO: 161322 - DNA, 381 bp, Homo sapiens
aaacaggttttggaggagtagtgggaacattgggtgatttctagtggggttagagaaagcagtacctggttctttggccacatctaccaaagcaaagacctagacttgtagaggagagtattgtttgcttgtttgaggattgtatttcccaggtttgttcatttgcatgagtggctgaataatgtaacagagacttcagaagtaaggaaaatggttgtcaccaaaatatcttgttttacctttatttggactaaatggaaaacacatgtttaatagctaaggctattgagtgcttatcatttgccaggaactgtttctgagcctttcacatataacacctcattttatccaccctctacccctaacaaatggtgtggtttg

SEQ ID NO: 161323 - DNA, 363 bp, Homo sapiens
gtccctttcctgcaatggagactctgggggaaggcagtgagctctgggggaagctggtgggctccatagactggagacatcaggaggctgtaatgtccgtaattctgtcaggagagaaggcctgtccaaagatgacaatttgtgaatcatggttataggagagtaactgaaagatgccacaggtgaaagatgcggatcagagcaagcacagagcctgaggagaacagaggctgtggagaaatgggcccacgccaggccaaggggtgaccctgctacctcccggaagggaaaccaaggctgagctggcagagccactggtgggggcaggggcacagagagagggccatgccacaggcgatggag

SEQ ID NO: 161324 - DNA, 736 bp, Homo sapiens
ttagctgtcatggcctcttccgcacagccctccctgccatctgagcctccctcccttctgagcctccccaagtccatctcaccatctcaaataaaataaataaaataaaataaatcaggtgcagtggctcatgcctgtagtctcaggtactcgggaggcagaggtaggaggatggcttgagcccaggagttcaaggtaacagtgagcctcaatcacaccactggactccagcctgggcaacagagcaagaccctgtatcaaaaaaaaaaaaaaaaaagtgccccaccctggctggcccagttcagacctcctgcaggagcctgggagctgagccccgcccaggccaggcctccaaggaagcgccaggatcggaaaggaaccgagattagggtttccccaggaaagcagcctagcccccgcccctgggaccagataacccgggggctcccactcctcccagtggggaccgggccttccccaactagtgccctgaaggtgcagaggccactccaccacttgaggtccagtcctggctctgccctgccctggctgggtgagccaggggtcagggcctcactagagacttagtttcgtcatctgtaaaatgggcggctgctgggagcagatcagagcgcctggcatgaccctggcactgtggtttctgggaggagccgggggctgaaggcagcacatgaggtgcccgcctgggctgccagggacaaacaggaagcagatg

SEQ ID NO: 161325 - DNA, 221 bp, Homo sapiens
atccgtttgtctactaaaaatacaaaaattagcttggtgtgtgacgtgtgccgtaatcccagctactctagaggctgagacaggaggactgcttgagcctaagaagtcaaggttgcagtaagccatgatcatgctactgcattccagcttaaacaactgagatgctatctcttaaaaacagaagtagaagcaaacaactataggggaaaatgagggataca

SEQ ID NO: 161326 - DNA, 213 bp, Homo sapiens
ttcctattggaaaacatcatcccttgaataagcagtgaggcaaacacctgggcacttactttatgaacaggtggggtggggccctgagtcaccgacattgagaggcctctcctggtaaggtttttcaatatcaggttgaatcagcggtgacatcaccctctatagtgacaggtactctaggtgccggctcttactcataagtcccaggagata

SEQ ID NO: 161327 - DNA, 164 bp, Homo sapiens
cgctgggattacaggtgtgagccaccacgccaggcctttttagatattttttttattgtaaaataagacacagaaaaccacacagaacaattgtacaacttggtgaattatcatgaagcaagcactcttgtaatcaccttacttgttaagaaatagaactttgt

SEQ ID NO: 161328 - DNA, 205 bp, Homo sapiens
ccaaatatggaaacaagagtctcctagcatgtttatttacaagggttttattttaggagctctgtgtcaggaatcaggggcagaggagagaagaaaaatatgtggaactctctgcttaattttctgtagacctaaaactgctcttaaaaagtctattttaaaaatccatcattagaaacacagactttctccataataagaagtg

SEQ ID NO: 161329 - DNA, 336 bp, Homo sapiens
  misc_feature (313)..(314): n is a, c, g, or t
  misc_feature (317)..(317): n is a, c, g, or t
  misc_feature (319)..(319): n is a, c, g, or t
  misc_feature (325)..(325): n is a, c, g, or t
tctactactactaaattcgcggccgcgtcgaccagaaggtgaggcgtcccagggactgagggtgtggtgtggcattggatgacggggtttggagtatgactttggggtccaggggacactgttagccttaagtgctgggatgaggagcttggatagctgtgattagattgtgggggctgtggttcctgaagaggagagcatggagcacagtgttagggactttcttgggagatatgtgtaggatagggcaaggctgtgcacagacagaaagaacaggaaagagaagggaggtcagggcagaggaccaacgtcnncgngnccgcgnatttagtagta

SEQ ID NO: 161330 - DNA, 121 bp, Homo sapiens
ctgccggaatggctgtgagaagcagatgaaaattgctaacagtgagccgaaacggggagcgtgaggcttaacgctgtggtacatactggatagaatcaaacggctctatggcgcagagata

SEQ ID NO: 161331 - DNA, 165 bp, Homo sapiens
tctagcacattaaaagtgatggggtgaagatcagaagtggggaatattagcacaatggaatatagaaaaaaattattagaacttcatgtttagcatttggaatgatactggtatcctcgtcacttttactatgacacattatcaatcattatagtttatatatac

SEQ ID NO: 161332 - DNA, 471 bp, Homo sapiens
ctcacgtttgtgatgagaacatggaaaatcctctcttctagctatttggaagtatacatacattattgttacctatagtcatcttactgtgtactagaacacaagagcttattcctgactgactaactttgtaccttctgaccaacctctcctcctgccactgaaggttttcacgggcccagtcttcttctcactcttcatcctctcccagaacacatttattaatgtccccaacttgaaaccaccgcctgtgtaactataactttcaaatccttatctgctgcccagcctctgtcctgaacagactggacattagcaccgggatattccttaagctcttgaaatatcaccatatccaaattcagtttgcctttctgcccaaaagtgcctgctctgtatgccctattaatggtattggtcaatcatcgtggaagtcgttcttgtcctgtttttgctcttgccacatccgtt

SEQ ID NO: 161333 - DNA, 490 bp, Homo sapiens
gagctctattaggttatccgtgatgatcaatcaggaagtgcagcagcttaagagaaatcaaggtggacatttgaatgcatcatgcgtggtcaaaccctttccaaacttaaaacaaccttaaagttcccgtttctgcctgtcattagggtgctttcttgatgcagttaccactctacagcaagcatatactccatgcagcgtatatttatagatttcctgagtgcttactaggtgccaggcactgcttttggtgcttgaaacacattgagcagggaaagggaaataaatgaaaacgttagaatgtgattactgctctgcgtcaagggaaacacaactgtgtatgagaaagtctggagggagtagggtttaatggtcaggttgtaattttaagcagattacccagggcagttttcattgggaagttaacatctggatgaagatttggaggagaagagggaattcgctgggtggatatgggggcaggtgagga

SEQ ID NO: 161334 - DNA, 1268 bp, Homo sapiens
ctaagagctggtggaaggaaagcaattaatataaggaagatttcagaaatgcttcagggagctgacaagagcccaagttagttttataagagactctgtgaagtattctgcctttatacctcatttaacactgaggttgctgaaaatcagcctgtggtgaatacagcatttgtaagccaagcccagggtgacatcaaggggaagctgcaggcatgaataccacccagtctataaaagtggccaaggtgtatgttaactgtgaccagggaacaatatgcaaaagcaacaagtgtggcagctaggcattccaagggttaactccctctccccagcccggctctattggagactggcactgggagaagagcgaaggagaaggtaaggagaaagagtgtgagaagggaaagaagaaagtaaaacggaaatcagaaagaaacaggagagacagacagcaagcgtgtcagtagggtccgtactcttgcccagacccaccgctggctgcagaagcaggagaactcaggaaggaaaaaggaaagtaaattgaaagtttaagaaaaaggccagtctgttggcaacagctcttatggaaagagagattagcaatgtgagaggacttggacgtggacgcagacatggaagaagtcaagttaggcagaaattcaagagccggacaaggctggaaagagattaatgtatgagaagcaaaaagaaaggaccctggaaagatgaatgttcagaaggcaatgacggaaatggctaaggcagcgagacaaagaggccatcggtcaagggctgccgcacctttgaggaaccaaatactgatctgattgggctgccaggagctgaaggatgtaaagactaagacagatcgggcaccttctcactaggcttccaggagcccatggtcacattagaagttaaaggcattatcctcaggtttggactgtctctaactttaaagtcagacaatggactggcatttctagctgaaatagtgcaagatttaacaagactgttaaaaataaaatggaagttacatacagcctattagctgcaaatttcaggaaaaggtggaatgcatgaaccagacactcaaatagctactgaagaaatattgccaggaaattcatttgagatagaatcaggtgtttgcatatgatcctcctccaagtcaggtgcacccccaccaaacaaattgggtatttgcccagtaagattttgttcagtcaggcacccccaaatcaaaagtcaaattaaaggtgccctcc

SEQ ID NO: 161335 - DNA, 319 bp, Homo sapiens
accaaaacaactcccacaaggcccatctccaaaattgggaatcatatttcaacatgtgatttggaggggacaaacatccaaactatatcacctggtaacgttatttgctttgaatctacttggattgatattaacgtagccactccattttcctttgacgggtgttatggtacatctttccatcctttgactttttttttttttttcttttggcagggtctccccattctccaaaattggggatctcttttttcaacatgtgtgatttttatagggggaacaggcggggactcctctagagttcgaccgtgcgaggctt

SEQ ID NO: 161336 - DNA, 336 bp, Homo sapiens
gtggtaggttaaaataattgctatgccatgtatattatgaccctgtttgtgtaaaactacgtccaactaaccacgtctacagtgagaggcctggaatgattctgccaaaatgcaaaagtcattgcctcggggtggtgggattgcttccatgtcatccaaatcttgttttacaaatatgttttaaacagaagagcttttttaaaaacaacaaagttttatgaagaatttaatgatggatatgcttatgatatgttaggtctttaaagataatccaaattataaatacattatgggtttaaatttaagaaaagtaagaaaatcacagactccaagcaa

SEQ ID NO: 161337 - DNA, 416 bp, Homo sapiens
acttctctcccctaaaaagcagcactgctttatgtgaaacaatgttacaacttgttttgtatccttctgcttacttcaaaacacacaaagcaaatgagaagattgttgacagtgacagtaaaaaagtttagacgactctatataggattagaaaagataagactttatttaatttcattttcactaagaccagccgctaatgagaaaggcagctttgcataagaaacgggttggtgctgggcgcggtggctcatgcctgtaatcccagcaattaaaatttcaggatttaaaaattatggcctactgcccccagacaaaaggccataatttttaaatcctgaaattttaattgcgggggaccaaatttcagaagctaccttatttataggttactttggacttatttcactatagct

SEQ ID NO: 161338 - DNA, 352 bp, Homo sapiens
tgacctcattatgcaccatgcaagtgtctgatttttttagtttgcttgctggtttgtttccgagacacagtcttgctctgttgcccaggctggaatgcagtggcgccatctcagctcactgcaacctgggcaacaagagcaaaactccgtctcaaaaggaaaaaaagatttgtattagaaggaggggccttctctaaagtaatgaatccttttttttccctccccaagcaaaaaatccttctctaaaattaatcatctttctaagcctggtttaatgtttttttggaagactgcttatttcttttcctttcgaaagttatgcaagctcattaaaaaaaaaaaaaaaaaaaaa

SEQ ID NO: 161339 - DNA, 268 bp, Homo sapiens
agttttgtataaagtttaagcagttatacagactcaggtgcaaaaagttattccaactaaattaagaaatactgtttttgtaagacagctttttaaaatgacaaagacaatagagttttagatataaattatggctctcagttactcatgaattctcagaatagtatcattctgtggtttttaactattataaaaaaattctagaaaaaacttcagagataatgttatgacaaaccccatattaatttgagtctgtattaactgcttg

SEQ ID NO: 161340 - DNA, 182 bp, Homo sapiens
caccaggacacatagctgctatcatcatcccttctgggaccaccttacacattctgcctctgtgtgaggcacaatccctggcctcttccactcattcctttctcccccttcaggggctcatttctgtcatactcctccacatcctcatgagcctccccttcacagattgctcagcgctccta

SEQ ID NO: 161341 - DNA, 143 bp, Homo sapiens
cattgtccccccacctccatcatcccactttgtctgcaccttgccagggagggggatccctgttagagcttcccagtgaaggcaactcctaggaatggctgaggaaaaggagcacttgctggtcaccctggctggactgggat

SEQ ID NO: 161342 - DNA, 561 bp, Homo sapiens
gttctggttcttggataacagtgttgacatttgccattggacaaagcatggttagctacttgcagaggccagatgtgtatatgacctggctgtaggatgcctagacaggtgacctggctataggatgcgtagataggcagcaggatgggagccacaggacagagctgtttgtgagagcatcatttggagtcacaaaaatacaggaaaaacctggatggaaacagcctttttttttggagacagagtcttgctgtgtcacccatgctggagttcagtggcatgatctcagctcactgcaaccttcgcctccctggttcaagcaattcttgtgcctcagcctcccaagtagcttggattacaggcatgtgccaccatgctcggctaatttttgtatttttagtagagtcggggtttcaccgtgttagccaggatggtttcaatctcctgacctcgtgatctgccctccttggcctcccaaagtgctgtgattacaggcgtgagccactgcgctcggccagaaacagtcttctttaggggagtggttgataaatcatgacaatg

SEQ ID NO: 161343 - DNA, 342 bp, Homo sapiens
cctcctgaatcccagggctgcccagctgctaaggcaccagggactttcacacccctcacagccactcccgctggacagatgggaaaaccaaggctcaggcaggtctagtgacctgtagtcactcagccctcaggctgtggctggaggtggcacccgggtttgtccagcccagagctcgggccacatcttcgtaaggactttcacacacacattttgtcagagtcccagggcataatttaggaccagggagaagaaccaggccctttatctcggaaacaaactcagaaatataaaccacctcattccaaagacaagagaggcccctgcctggaattctcaccc

SEQ ID NO: 161344 - DNA, 474 bp, Homo sapiens
tgatattaatattttatatccacatttgcaattatttagaagcacgcatgtatttgttgcttaggtttccataacaaaataccataaactgagcagctttaaacagccgacatttatgttttcacattctgaaggctagaaatctgagatcaggttccagcatagttggattctgaggagggctgtcttccttactaagccaccttctatctgtgccctcacatagtggagagagatctctttctcttcctcttctcataaggccacagccccattggattagggccccacccttaacaacctcatttaactttaatttcctactaaggaccctgtctccagacacagtcacactgtggtttagggcttcaacatataaacttattctgtctgtagcaatgtgtaatttttccactgttaacaatatgtatctcctgtgttactcttatatgctggcattttagtgcacaactc

SEQ ID NO: 161345 - DNA, 386 bp, Homo sapiens
tgtgtggatgtgggaacgtccatgcagttgtgtgtcaccacacacctgtgtgtgtctctgtatacaccggcttacctgagcatacaagcctggccaaccggcttacctgagcatgcaagcctgtctaagcacactctgtcgacccagggcccgagacatacatgtggctctgcgagctccccttgcagtgtgtgtggccactgctcacagggtccagcactggggtcagtggagatggggaggctgagactggagagggccagctctccccaggggtcactcaggggctatggctggccctgggctaccagagggtacggggtcgtggagggccatggtcctgctgatgaggcagccttggtgaggggccatggagctgaaccccg

SEQ ID NO: 161346 - DNA, 185 bp, Homo sapiens
atgatttttttctttttaaagcaaaaagtttagtttattgccgtttcatttgctttcttgctgacaagataacaaactccatatgaagagttcaggtttgttgtggcaacttttcagtgtggcatttgagattctaatcttcctctattttggcacacaaatacgtaggtggggcctcacgccaa

SEQ ID NO: 161347 - DNA, 568 bp, Homo sapiens
cagaccacctgagttcagagccagctctgtcacttactacctgtaagacctctttgttgcttaaattctttcctcagtttcccaatctgtaaaatggagcaatacatgcctcacaaagtacatacctcataaataatatataccttataaagttagtattaggatataagagaaggaatataaacagctagaataataatacctggcccatggtatgttctcagtatattatccattgttattattgttgttgttgttgttgagtataattatgaatcttaccattatatgacttggcctcacacataaatgtggcatgattgtaagggagtatggtttaaaaacaaaacaaaacaaaaacctcctctcagaatttctttcacactgaggtataaatatctgatgacatattacacatttctcattcttacattcaataaaccttactgagcacatattacctgccaggtgtcaggctgggagatagaatacaaagatatagttcccactcccaagaaacccaaagccaggtaagagcaacagacgatgagtaaatcatgacagagta

SEQ ID NO: 161348 - DNA, 442 bp, Homo sapiens
aagttcttccaaaattctatacaactttgtatttttgcaatttgaacgcagagaaaagcatgaagagatggtttggaacaggttctttcttgtctggaagctgattctgggacagtttttctttctttcacagtaatttccagttaaatggagatgaactgcatgctttgaagacagtttgccttgcagtgtttctactagtgttactggtttttcacactttgtatctaattattttatctccatgacaaatgcaggataaagttctccattttctgaggaaagtcatgtttttccataagaaacatcacgattgtccatgctggacttttctatctggggccacgcagccttttccatctcctctcccaggtttctcttgttctggccctgcggtcctgcagctttcctgcctttccgttttctacacaatcattcttcc

SEQ ID NO: 161349 - DNA, 272 bp, Homo sapiens
ctggggcaaatagtaatatatactcactagtggggtttcaaagagtaaacgagataacacaggcaaagcccagtgcctggcacacagccgtgatgaacaactgtaatgggcattttaccattgtcatctagattaggaggtgaagggtggaaaattgggaagcagctgggctctaggtagcccagtgaatacttgagacttaacctctttacacctcagattcattgtctgaaatgggggctaacaatacctacctcttatgcttgctagag

SEQ ID NO: 161350 - DNA, 274 bp, Homo sapiens
gtggtgaagaataactgtgtccgagactgactccagcccacagtgtctgacacagtggggcaggtactgaacacttggtaagtatttcactttgacttttaaatggaaaataaattatatttcctgagtaattccaaccataacaatcaacatttctaagagccaattattttaagacggtgagttccaaatcataaaatgcaatttttaaaaaattgccacaagaggcattccttcacataactaacttttcttgatgacttctctaattctg

SEQ ID NO: 161351 - DNA, 462 bp, Homo sapiens
aggcttatagtcccagctactcaggtggctgaggtgggaggatctcttgagcctgggaggtcaagactacagtgagccgtgatcgtgccactgcactctagactgggcgacagagcaagacctgtcaaataaataaggtgcagtagccatttctgttaccataggaagggccaaactgaggtcaaaaccaaggaagcccagcaagccacagagaaataaagtcctgattatgttataaacccaatgattaaaagtaaagcacacctgaatatacacctagacggcctacttatagcttttaaagaaaaactctgtttctgccaaagaaacggttttttctggtccttgagacagaatcctacctagtttaaaaagaataataattctcaaccttaaatttaacccacaggtactaatatcacgaactagtaaagtgttgtgtgtggtgcctcacgcctgtaa

SEQ ID NO: 161352 - DNA, 178 bp, Homo sapiens
ggtggtaaaaaggttgatgggtaggggtggcggtatgtgccttcaggagagctaggcaggaggattaggcatcagagaggggctacagggcagggggcagggggctgaggttgagctgaccccggtggtgcgttggtgcggggaggggcctccctgactcaacccctgtgccctccct

SEQ ID NO: 161353 - DNA, 186 bp, Homo sapiens
tgtacaaaaatggtgcacacattacacatacccctatctcactaatgaatttcttacaaaagggccctcaaagtatcactgagaatcgtgccccatcttagagcctttcactggtacgtccctctccacaagtgcttttctcccatatattacgttagactcccatattacactcagattattgct

SEQ ID NO: 161354 - DNA, 534 bp, Homo sapiens
agagaagaaagcatgttaacacatgaaaagctgtcagaaaaactatcaagaaagcaagttaatgcatgaaaatctatcacggtacaagacaaaaataacccacacagccctgagtgcttctgatacagtggtaaaagcaaacgccatattactacagatcaaagtgtcaaatggtcaggaagaaaaagagcactgacaaatacatatactggtaaatccaaagattcctttcccctagtaccttagcactatcattaagtataaaagtaattatttttattcccttttaaaaccaagttttctatggaaaattaaagatatagataaatcactactcctatgttccagacacttatctcaaagtgagtacaaatgactggatcctagaaaatgaagtgtattatagaaatcttatcaaccttctttacttactagaccaaaccagagcaatgcaattggattcacttgtctgtctcttcccctcttcccccaagtttgtgagcatgtaataaataaatgttaattcttatttgc

SEQ ID NO: 161355 - DNA, 242 bp, Homo sapiens
ttggggtactctatagctgacccacattagcactcactggaccttcttcatgctgctctgaatgctattaacataaagtgaaccttacagatagatctctaaccagtgttacccacactcaggccccttcacagctacgaccatccttaacacacattccagtccttccactgtcctgtcccctctcccaccgtgtccctcccgaaacatgtgggaagttatgggagtacaattcaaaacga

SEQ ID NO: 161356 - DNA, 603 bp, Homo sapiens
catcacataatttgtagactcatgtaaacttatattcattcccttattaaacactgtgtactgtatataaggtactacgaaagaggcaaagtcccttctctcttagagggcttgtatatttattttacttaatcaaggccttatcatgtccttcattttcccattgctcaaaagattgactgctgtaaattaagccatgtgtactcctacagccaggtcttaaaggaaataaaagctataaaataagatttcaaaatgatgtctgccttccctgacatcaactaattgcatgatttacctccatttatacctcctttcttctacatgcaataaagaatctcgttttgaaaccttttccttatctttaatatttaaagggaatttaaacatttctcccaaaggacgttttgttcatgggcaaagtacctcttgaaaatatacagtgggtaggagaagcacaagaacttcgatgtggtacagaaaggacgacaggtaatatgagtatatcagtatatacatgtggacatcaccataaagtttctaagtcctccattttaaaatatatttttatgtatatagttaaattattttcagctattaaga

SEQ ID NO: 161357 - DNA, 594 bp, Homo sapiens
gaagatcaaactatgtgctttttcttcaacagcggaatgaactgcagatggagtaagggaaagaagaatcaaaaaaagcataagcgttttaagagcagaataatcgcattaactgatccaaatgcaaatgcttcctcatatctacaccctttggttatgccctcgcacaccaacactgggcttggccacgtggcttttttattgttttttaaatgggacagtaacaacttaactcaatcaaacttaatcacaaccttgaaaaagtttgtgagtttcctcttcctcttaagccggcccacagaaaacccaccatctggccacagatgcatggaaaagacccactgatatcaaccaagcctggcacaaatcagcagaaacattcagctgacccacgggcgcagatcattttaagccactatgctttgggaagatttacaaactgcaatcgctgatacaattgtcttcaatgtttaaagagctaaactatgcaagagaaagtttaaatccttcctgttccagttccactaaaagagaaaaaaaaaaaaacattgtactgataggaagacagatttcattttaagaaagtattttcta

SEQ ID NO: 161358 - DNA, 140 bp, Homo sapiens
acctgccagaggaccaaccttttcttatagctatgcaaggcctcagtcatctctggaacttttcatatcttttccatcattatatgttagctttggacatgaggttttacttttatgttgtaggagaaaacactagtata

SEQ ID NO: 161359 - DNA, 326 bp, Homo sapiens
ataaggaccctagtcactggagccacagaggttattcctggaactggaagctagatgctaagctctcacttgaaaataaggtttctctttcctctggaatggaggtctcaactggaagcaaagctggaagcaagaaaaacttggcttggaaaaggggtttagagttgcctgataaaatggttcacagcacccccatgggccttagagatttccttgtagcctggggtcaggagtcatccatttttgttctttgttctttttcagtttcaattctgatttcagaccatatttccttcccgccacgtcctcaatttctcactttgaga

SEQ ID NO: 161360 - DNA, 237 bp, Homo sapiens
gggagattaggacagacaaagaccaagagagaaggggggaagagtgctgatgggagcccccaggcccaggcaccaggatcatgacagaaggagcccagtgctccccttcacctcttttcagagtctccacaacccctcagctgctgggggtcagggagctaaggggagtggggtctcctgggcttgggaaggtggttgacggggctgccttgtgagccctgtctggggtgggctggg

SEQ ID NO: 161361 - DNA, 171 bp, Homo sapiens
gggattacttaccctacacaatgcatttaacagcacatagttcatagtagataacccctgagtatactgtattccattgatttatacagttacaaatcctgctctctcaaatacaaatctctctcaattggccagtcatcttagatctaaaggtgtttttcaacctgaagt

SEQ ID NO: 161362 - DNA, 407 bp, Homo sapiens
tgggaaatgaagaaaaagataaacatctttaaaaaaatcaatcagaattctggaattgaaaaattcacttaaagaatttcagaatacaatggaaaaatttatcaatagagtagaccaagctgaagaaagaatttcagggtctgaagaccactcttttgaactaacccagtcagatagaaataaagaattaaaaaaatgaagaaagggtttgattaatatgtgattatgtctagcaaccaaacctatgaattattggcattcctgtgagagaagataaagtaaacaacatggaaaatgtatttaagggaatacttcaaaaactttttcaagaaaaaagagcaacaaagtctggatgacagcacatctgtttgcatcataatttactgaatatctgaggaccacttttg

SEQ ID NO: 161363 - DNA, 183 bp, Homo sapiens
attgcaggcatgagccacaacaccaaccttcagggtttcttgacctctactcagggagccttctccactctgtcagccacccatattcacacccatgctctggagtctagagcctagacatcgtcattgtcatgaactgtaccatatctgaacttttaaggcccttgagcccctgtcctcatt

SEQ ID NO: 161364 - DNA, 297 bp, Homo sapiens
cttaatttccaatcattatttcagtctcattaagtatatcttacaaatttttgatgccgttattacttttttaatctccatgatctttgaaggcttggaaattgtgttaaaggctcacacagcagtcttgcaaccaatttacctttgttctaagaacttttggttgatgtatttagtttaggtagatagctcttaaaagaccattttcctagttcattgcatcttttataaaaataaaaaatcctctttggtttaatgattgcgccttaatttctattttgtctgatgttaattctg

SEQ ID NO: 161365 - DNA, 349 bp, Homo sapiens
gctaattcattgccaccatcactgccgtccttaccatctcatgtagggagcccttactaggccaaatggctgcaattctaatggctggtgctgatgtcattcccattttaccactaaggaagcaggttttgaactcaggctatcaggtaccactgtacacacttgtgaggagactacctatgacctaaaaattttgaagattatcaacagattactaataactaagtatgataatggaactcaagatgaagctcaagaaacaacttatttaggaaagctgaaaatcatcaatggcaagactaatttttcaaaggctttggcagtcccccagtgctctaacagaaggctg

SEQ ID NO: 161366 - DNA, 286 bp, Homo sapiens
taaataaaatcagattcgagaaaagaggactaaagacatagaaagagaatagaaaccagagaatttcatttccaaggttgttcaggtaggctagtttatgctgtggcaacaaacgtcagtgtgtctcttccatgctgcatgtccagcgtgggttttgaaaaaggacattttctttctcgctaacactcagggacccaggctgatggaggctctgcctttctgttgctgcatagctccgctgttatggccacagaggaagaagataataaagtcaatttttatccat

SEQ ID NO: 161367 - DNA, 253 bp, Homo sapiens
taatggattcatgcttgtgctcttgatagcgggagaggtatgagtgagaagaacctacaagaaccacatcagctgacatggtggctcatacctgtaatcccaactctttgggaggctgtggcaggcggatcacctgaagtcaggagttcaagaccagcctggccaacatggtgaaaccctgtctctactaaaaacacaaaaattagccaggtgtggtggcaggcacctgtaatcccagctattaggaaggctg

SEQ ID NO: 161368 - DNA, 202 bp, Homo sapiens
tagtcctagtccacaatgccttcatcagacaatcttcagcacccactgctgcggtgtgtgggtgagacccagacacctctccctgaggtctttcaatggcttcgattgccctgcgaatcagtactaaattcctatactacagtgctgcagggaagtctctcttgattgccctcagggctcctccacctaggaaacgtgctca

SEQ ID NO: 161369 - DNA, 567 bp, Homo sapiens
gtctttgctgtactctccccaaccgtgcaagttgacagtgaccataatgacctagcaggcctgggactgcgctctgaccgccaagggggtgtcgcggagggcacaacatagtggagggaacaaagatgccaacaggccaggacacaggaagtggagtctggagcagcccatcagctgggttgccaggacctgacaccaccagcgcagacttgcagtgcagagcctaagttcaagagaaagggctgggcttgaagtttcacacttttgtttcatgcttttgcaggaagaaggagttgttatgatgacttcggtttaaacagattgggaacattaaggataggagtttgggggagatacgagaaataagaatacagacgtaggagttagtagcaaataaggttgctgtgggcctgaactagacccagaggatgccaggatcaaacccctgagaacaggctatattgagggggtaggaagaaaaagaataagcaactgaggcagcatggaagggaaagctcaggaccctaatgacgccttcggccaaggtccaggataacctgaagtgtc

SEQ ID NO: 161370 - DNA, 338 bp, Homo sapiens
agggggaggactgtggggctgagcagaggcaagcctgggtctctgcttcccaggggacagaggcctcctgctcctgcagttcctatgtcttttgttggactccacgtctaaatcctcatcccttgttgcccgactttttgatgatggcctctgtctcctagacagagattctggtcaagctgcctggtttcctggacgtggacatggtcaggacctcacccacgccctaccgcttcctatccttgtggttgaagacgccctccgtttccatgttacttctgacccacacctgctgtctgttgctgcgcagctcctaacactgcaagggaacaaacaat

SEQ ID NO: 161371 - DNA, 329 bp, Homo sapiens
ttgttcttagggggtaaaaaaacaatcttactcattttgagtataaagtagagatacacatacagtacctagaaaaatacacggtggtatagacatgtctgtggtatgaaattttatggagggagggatggtgattaggaaaaaaactgcctagaaaaggccccttaagggggcgattaatgacaaaggttgaaaaacgctggttttaaatgaaacattaatgttaatacagtaacacaatataggtacttattagggatccttgaaatctgtagatatcattttctgttggaccctttctctaattcctgagtatttggtactacttc

SEQ ID NO: 161372 - DNA, 323 bp, Homo sapiens
cctctcacaaagcggcgagtgttcccagttattactcggagggccgggcctgctcaggagggttggtgagatcaggctgtcccctaacacacaccatggcagggctcatcctcctgagtacatgcaaggtgcactgagccggctccccatggaactccaaaaatagcccagctgggaagaaatggaacgttctgggggacactgattttcacattgaaatttcctatctttttaaatttattttggttgagacagtcgcccaggctattgcccagcctggagtgcagtggcatgatcgtagcttatggcagcctcagcctcct

SEQ ID NO: 161373 - DNA, 107 bp, Homo sapiens
ggcccagtcaagctgtattttctgtttctccagcctactatattctaggaggcccagcccattgtttcccagtcagcgaggcactgcagcttgactcaccacaaaaa

SEQ ID NO: 161374 - DNA, 531 bp, Homo sapiens
tcgatcgagctcggtcctactttccacaggttataagcactatagttcctattagtttagttttgtaaattaaaaaaataaacagccaatacaatagtatcagatatagcatgaaagtaactttagaacaaaatcccacatttccatttatctccctaaatgaattttaccactttaaatactgacaatttgtttaaataaaatattaatttgaggatgttggaaacacagaaattattgctgaaaacatcacattaagtaactgagtttgtaataagtcccatataaaagccagctaacccaattttgcaaattgcttgaaattgcagatgaagatattaacaattcttttattaaaggataaagtgaccataatacccaaggcactacgctgattaaagcaggtgcaatggaagataacccataagcttcataattccttggataatagatcagtgattcactgtaatgtgcttattaagcaaaatggaaaattgggtcaaattagacagtgagatggagttgtccata

SEQ ID NO: 161375 - DNA, 568 bp, Homo sapiens
tcccaacactttgggaggccgaagcaggaggatcacttaaggtcaggaatttgagaccagcctggctaacatggcaaaaccactgtaatcccagctacttgggaggctggggcacaagaattgcttgagcccaggaggcagaggttgcagtgacttgagatcgcatcattatactccagcctgggtgacagagggagacccttgtctcaaaaaaaaataaaaataaaagtagaattaccctatgttccaccaatgccattctaggtatttatccaaaagaaatgaacatcactgggtgcagttgctcatgcctgtaatcccagcactttgggaggccgaagcaggcagaccacctgaggtcaggagttcgacaccagcctggccaacatggtgaaaccccatctctactaaaaatacaaagttagctaggcgtggtggtatatgcctgtaatcccagctacttgaaaggctgaggcagaattgcttgagcccaggaggcagaggttacagtgaactgagattgtgccattgcactccggcctgggcaacaagagcgaaactccatctc

SEQ ID NO: 161376 - DNA, 272 bp, Homo sapiens
aggttcagtttcctactcctcacactcctgaaccaaactgctctgctctcatgagccctaaattttataatttccatgaatcagccatcctttttcacatccttgcatttatgcatcctgttctatatgcctgaagaaattctccctccttccctgctttcatcaaaatccagctcaaatatgatctttgtcaaagaaaaaattattcattacacccattaaagaatggtaaggcagactattcaaagagtactattacaatagttacacag

SEQ ID NO: 161377 - DNA, 293 bp, Homo sapiens
tttgggtctaggaggcctcccctctctcatccactggcagcggaggctggagccctgtgcagagcagaaatctgagggtgagtctggctcagaagggaagtgggtatcacagaactgtcttccctggacttgagagtggggcatagatgcacgaatgtcaccattttactactgtttgtgtagggagataaaaacagaaaagattaactctttgattttcaaagctctgagtgtttaaaagagcacacagaaaaagcaagcttagaattctaagtggagcaaagactctagag

SEQ ID NO: 161378 - DNA, 495 bp, Homo sapiens
tctgtgatgcaggtatttcagcccctgctgtaccaggcaacaggattagacaggttagtggagcatcagatttccgactgttaactttttcacttttcttctctgcacgtaggcttgagaactgacaccaagacaggaagagggaaagtgatagaggcaaaacggaagattaaaagctgatagacaactcagagagctagagggggagtcagaaagtatgaaggcagagacctcaagggatctgatgcagttaatcaaatagtatgaccttgtagctatgtcagtgtctgacctgggggaatctgaaggagggaggggaggagagatttagatagaaaccacacatgaggagagtaaaaggaaagtaagtcttattaaaggtgggagagtcagtactagctgttgaaacttatgcatcccatttcttggatgagaaatagatagcatttattgagctaatgaccatgtaattaagctccaatgagttaagcttaa

SEQ ID NO: 161379 - DNA, 506 bp, Homo sapiens
cactggggatcttgagcaggaaagtaaaatgattccatttaaatagcatgagctcaagtggaatgagtctagaggcagagagatttggaagggaggtcattgtaataatctagacaagaaataatgagaatccaaagaagtgacgagagtaatgattgctggaagggagaggacagaacagttttgaaaacaatcaggaagcaatctgtgactgattgggttttagtggtgaatgaaaagcagaaatgtcaaatgcattccaggttttggttgggagaactggctggacagagaacaaaggaagtcaaacctatattttattgtcaagtttaaaatatttgtgatatctctatatgcagaaatccagtaggccagtcatataaaggtgtgaaacagagtaggacattctgggctagagatgactataccagtatgtaagggtttttggtgctaccgttagccacctacactgtcaaaagaggttataaaatgtatcgtttaactaa

SEQ ID NO: 161380 - DNA, 167 bp, Homo sapiens
ccaagttccactccagaactttactttgagcctcttccaactggaaggtcttttctcccaacctctgccctccacaatcccacaccatccttcccggttcatttcctctgtgtgacaccaagatttaagggtcagaattaatttctccttctgggttctggctccgg

SEQ ID NO: 161381 - DNA, 265 bp, Homo sapiens
ggactttcaattgttctgttgttttagtttttctcatcaactggggaactgtttgtgactaagctttgttaaaagtagagaagagcttttcatagttccaacattagttgttacctggtgcagtggtgtctgtctgtaatcccaactactcgggaggctgaggcaggagaatcacttgaacccgggaggtggaggttactgtgagccgagatcgcgccattgcaccgcagcctgggcaacagagtaagactctgtctcaaaaaaa

SEQ ID NO: 161382 - DNA, 547 bp, Homo sapiens
tgtctacccaggagagataaaatataaagaaagttaaagtttccaaaggggtgatgaaattaattcttgggcttagaaaataatgacaatatctcacattcttatagttcttatctaccaacacgctttggagtttcctagcaaaaaaattacccgagtcagagcttttgtcccgagattaaacatgccctgtgactatactgttacagctacagataactcacaccttttggttgtaaatgtactagtctcaaattcatctgtttgcttgcaaaacagatgggctctattgagtgacaaaactaagccgatgcagctgaggcaatactccaacagggtgaaagcactcaatctggttcccatgtttctcctgcaaaagaaccttccccttgcttagccaactctacttcccctccttgaggaagacgggaggattctctgtgatctccagggtgaaaccatattagatacacatgtggatccagttttaccaggtatgccacttattctgttgcatatgaagggaaaactatatagaaggagcttt

SEQ ID NO: 161383 - DNA, 653 bp, Homo sapiens
taaatttcccaaggtcattcagctcgcaaagagcagagcccttcctctagactgactctcctaaaaatctcacagctcaatgcatggatggttattatttcaccaacatcactgtgtgtcctgctaaggggctgctgtcctaagcaggttgctacatctaagaccacatcttccaacctcccagcctcaagttggaatctcttctgagaactgggcctgggccagcagacagagcccagcacttcccactgcaggatggaggtgaggcttcccccagtaaacttccaagtgtgttccagccctactgtcctcattttacccctatgagtgccgcttcacctcacctgcattctccgccctgagtaggtgtgactgtcacccatccaggagcaggtcacagctctgcttttagtggcttccttaaaatcactgcacttacttacttttgtaggctgattgtacaaaatgtgcactagctgacataattccagttatttatttgtagattcaggaaatgagtgagaaagcaagattatttcaggttcaaagtaatttgctgaaagcataggttctcctggttctcccacttagcagcatcttacctaggtaaattacttaagctctgagtcctaatgcttacatctgtaaaaagg

SEQ ID NO: 161384 - DNA, 731 bp, Homo sapiens
tatttgtctagtatcttatttgtggaaacaaaaccaatctatacacaatagtcacagaacaattgttacactttgtgatactaactgtaagtgcaacagggaatcagaagagagatgagtataggctggaatacttaaagagatgattggaggacttggagtgggccttgagcttggcctttagattaacaggggccagaagaaggacattttacatggaaaattgggaatagcacaatgaaaacagagtaggcatggtttaaatataaggaacagtgtagttctgcctggtttgaagaaataagatgtaaggtcgagtggagatttgtggttcaacaataggcttagatttgagtcaagtggaagctcttgcacatttcggaaagacaagtgattttatgaaagcagtgtttaaagattagttttgtactagaattaagggtagattcctagagaaaagaggattgcaggtaccagtgggtaccagtggtaataggaaaaggcaaatctaggatgctttggaaggaaaaatgagaattagagtttaggagaaagcagatcactgaagttttaaaaataatgtggaatagttggtaagaacaacttattttatgaaagctgacatcggagtctcactggaacattgtagaggagaggttttctaggcatgtggaaatgcagtaagaggcatgggtaaaagcaccttttagtttttaaggaattaggttaaa

SEQ ID NO: 161385 - DNA, 346 bp, Homo sapiens
aaaagcctgcatgcttctttattttggctgacttgtttaatgcatactaataggtagatgaccctccaaccaataggtggctttctgttgcatgtcatagtgcagttgaaactccttagggtaatcaccctctttaaaggcaaaagacaaatagcatgagtgaagtggtccaaatgccattctttaataacctcagtggtctgatttactttgagcatgctgtgtttcactctgaagtaaaatctgattatagtttggtgtatctggccaagatacaaaagctgaaatatttataacagcagaaccccacaataaaatacgatagaacttcttggcaacagtttat

SEQ ID NO: 161386 - DNA, 625 bp, Homo sapiens
ttcatcttgttgcctgttttagaggcaaaatcttaaaaaaaagtgctacaaaaataataacagatgacagcaatttatttaaaatgcaattaggtttcttaaataagtaaaaaatttcagtaaacttatttatattacttgtctgattattttacatcttatcctacatcttaaaaaattttagctaggcatgcaattcaaaaattgacagattttttaaataggcaacttaaaaacattttattggatatgttgggtaacataatactcaaatactttatattagaaatcaacacacttgacaatattcatagtatctatgaaagtgacattatgaacatgcttttatagttgcaaaaaatttaggtgaaaaaaatttattctggtcttcagtagtaaaacttaaagattacaagaatgagattaaatttactgactaaattacccacaagaactgaaacagattcatttacttgttctttatctttcagtatctgataacaaagagactttacgacattcagaatgggcttcagtatagaaataaggccaaacagctcttgtaaaataatcattaaaatatacagaacaaacctatcatgtatatgatttttaaaaatcaccc

SEQ ID NO: 161387 - DNA, 236 bp, Homo sapiens
agacagtgctggtccatggctgccttcaaaatgctactaaatttctgtctgccataaagtggagagaaaaagagtgcaaaactaaaacgggaaggtaatagttacatttgccaacttaaaatacattagtcttagtcttgacatcatcaaaatgaggtgagagaggataaggctcagatgtctggctagggttaagagcatggacaacgtcaccatgcttagagagaggggataga

SEQ ID NO: 161388 - DNA, 511 bp, Homo sapiens
taaattttaggatgtatttaatttcagtggcgcctatattggtggtacccagattattccatttgtaataaaaaacaaaggtataacacgtgccagagtggagtttaatctaaaagactttccggatttttcaatggatcttaaagacaaatcaggtatatattttgtatataatggtattactgtaaaaggaaaacagttttaaattgccctgtggtataatttctaaaactaattcaatcaagggaagttcttcttaaatgtttttaatgaccactgcatgtttttcttacactctgtaactcatcatggttttatttgtagaaatacatcattattaatatcaaaacactttggtaatacatgaaacgtaaccgttcttattagtgtgttaaatatgctaagttaagtatgttatatataagtatatgccttaaatgaacataaaattatgaatcgcttgttttaattgctcaataattttagataaatgtctttggggagctatctc

SEQ ID NO: 161389 - DNA, 164 bp, Homo sapiens
ttgaggctgtggggaagatgccttttggaggggctgtagctcagggcgtgcactgtgaggctagacctgttgactatgcagtgggcatccatttagctttaggtcgtcttgtttctgtatatagtgacatagcattctgctgccttcttagttgtggacaaagc

SEQ ID NO: 161390 - DNA, 587 bp, Homo sapiens
agattggtttgaccaggcgtgtcattcacatagcccgtgaaaaacctggcactcctaccttactcctttaatatgcaaatgcaggtcaccatgatatccatgttatctggaggcaatcatgacacttggcacatgtagtgatgaggaggagagggtggcactcttcctgttggccatgttgggtggacccagtttctaatcgccagcatttgcatatcaaagcttgccggcctggtttttcaagctgcctttctgttagaaaagaaatggtttgggggttgcttcttattacaggaaaatttccactgagaacctttaccctttctagcggcctaaaagttatttcttaataattcctgtattatttggaggtgtttgggtcatgtgggtagatccctcctgaagtaatgagttctcactgttcgttcacacaagagcttgttgtttaagagtctggcatctcgcttgctcctactctcaccatgtggcacactgtcgcccctttgccttccaccatgattgtaagcttcctgaagccctcatcagaagcagatgctggcactatgcttcatgcacagcctgtagaa

SEQ ID NO: 161391 - DNA, 464 bp, Homo sapiens
aaaggtcgtgctttgccttgttctgatttcactctttgaaactgttccttttcacgcacccttgatagagtaggaagagttaccaaagaaaaacacaaacaacaataaggaatcataccaatgccaatgatggggcaattcagaaatagcaggggcctgatctgtagggtgcttaaacttccatgcatgattttcatgaaatgcagcacctctaaagcataggactggtggtcagggtctgatagcttcgtctagaatgagcatctagtgccagtccttgcagtcacttacaaggaaggagggcacggaatagaacatgttgtagatggttgaccccttgcagtagggactgagggatcatgacggatacatcatggatggaaatccacaaagtggaaaccgtttttgcttgcctttaaaagcaaatctaaaaatatgttttctagcagctgtgtaactgcaag

SEQ ID NO: 161392 - DNA, 288 bp, Homo sapiens
acactgtacctttcaggggaggattatggaatctagcctcagactatgaatactaaagagatgtgaggaaggacaaaaaagtacatggctggtataggccagcataaggcagaacagccctttacctttagaaatacaactatggagtctctttcctgatcctcagtagtgtagtaaatagggaatgggagcctgctgaagatctctagagttaatatatataatcagccatttttaaaaaaactttaacacttatagttaaaaattaaaaacagtatcttaaaaatg

SEQ ID NO: 161393 - DNA, 302 bp, Homo sapiens
cgtaatttttttctttgtggttaccatggggcttacattttaaaaactgtgtagttataataggcaatttaagttgataataacttaactttggctacatgcaagtattctagacttaccttctacctcccaaatttgtttattttttattaaaaacattttttttttgagactgagtcttgctttgttgcctgggctagagtacaatggtgcaatcttggctcactgcaacctcgtctcccgggttcaagcaattctcctgcctcagcctcctgagtacctgggactgcaggcacacacca

SEQ ID NO: 161394 - DNA, 426 bp, Homo sapiens
tgtttacatggcggcaaataagttgagatagaaaactgatctgccctctccccaggagctgaatgcctccctcctctagctggatcatagctgcaggggccactcgtgtgcccctcacctgtggaggtcctggaaaacagccaacaactggtcatctacatcagatcaataccacacgttatgcagaagcgtaagtccctctccagactagcttgaaagcttaaaaccaggccgggtgcagtgactcacacctgtaatcccagtacttgggaaggctgaggtgggcagatcgctttgagctcaagagttggagaccagcctgggcaatatggtgaaaccccctttccacaaaaaaaatgtacaaaagtaaaataaaataaaacagcggggcatggtgggtcagaacataaggggtaccgagctact

SEQ ID NO: 161395 - DNA, 331 bp, Homo sapiens
tatgttcttcagactcagaaacatttacactttcatatcatgtggggttgtatgatttacaaattaggtattggctggttttttatctcctcttgaaatttcacatgaatcttggtttgattctaaaagtagatgttattgcgttatcacaaataagtaaatttggaattttgtcaagtttttatatacttctttggcctcaaagcatatcttaaagccattttatagtaagactagcaactcttacagtggcagatttggatggctaaatattaaaaaacatagaagacttgacattgttgtaaaaatgtgagatcatacattatgtctt

SEQ ID NO: 161396 - DNA, 174 bp, Homo sapiens
aaataaatcaaaataaattttaatctaagttaaattcaaattaagcatagacattcagcattactgcacagaatagtaaaacttaataaatattgtgagaggtgatatgctctccaatagtaagggttctggagacagcccaacttcattttctacttccctcaattaatagat

SEQ ID NO: 161397 - DNA, 478 bp, Homo sapiens
ctggtgttggggtgccccctcctgccaccgggggtggcgatggcccgttcgcctgcccactctgctggaaggttttcaagaagcccagtcacctccaccagcaccagatcatccacacgggcgagaagcccttctcctgctccgtgtgcagcaaaagcttcaaccgcagggagagtctgaagcgccacgtgaagacgcactcggccgacctcctgcgcctgccctgcggcatctgcgggaaggccttccgcgacgcctcctacctcctcaagcaccaggcggcccacgcgggggcgggcgccggggggcctcggcccgtgtacccctgcgacctgtgcggcaagtcctactcggctccgcagagcctgctccgccacaaggccgcccacgccccgcccgctgccgctgcggaggcgcccaaggacggggcggcctcggccccgcagcccccgcccaccttccccccgggcccgtacct

SEQ ID NO: 161398 - DNA, 323 bp, Homo sapiens
agaatcgagccggtacccctagttttagaagtttcaatagcaggttaaggaactgctcagggaaaaagggttctcttttcaagtcattttcttcagtggccatttaaatcctttagaaacacacaatttttactgagattcattgttcccttaatatgccacattcctgaagtcagatgtgcccctccttcattgtggcttgacttgtcattcatgatctacctcaggtctccagtaaaaaaaactttctccgtctaccttcctattatgatcctgttttgctattgaaacttctaaaactaggcgaccggctcgacttcgat

SEQ ID NO: 161399 - DNA, 389 bp, Homo sapiens
tccataaggtgtgcccactatattccttctaattttccattccggcaatgggtctactcttatgcagttttctggcttggttcacaccatccccctgatccgggacacaccctctccaccttcccatgaagcctatgctaacttaagtatgacctttctttcaaagcccagctggctggcttttttaaaaaattcaagccaactcttctgtgatgcctttctccaatgaccaacgcaggcattgccaaatacctcctgggggcagggagagggacacaattgtccccagttgagaaccacttctttaatacaactccttctctggacttttagaaatcatgccaagaattcttaaacattccaagcatagtggctgggacagtaatgat

SEQ ID NO: 161400 - DNA, 247 bp, Homo sapiens
atgagcggacctccaggctgattgcaggcactgaattatagagttggaaggggtattagaggtgattgagtccaacttgtcactcagcacaggaataccctttatagtggcacacatgactggcagcatagcctctgccagcatacttttttttttttcccaagacggagtcttgctctgtctccaggctgcagtgcagtggcgctatctcggcttactgcaacctccgcctcctgggttcaagcaa

SEQ ID NO: 161401 - DNA, 404 bp, Homo sapiens
aatagaattataaaatctctttgttcttttttgctgagtactaaagaccataaatttattacagatgatatttactgataataaagtacttttatttttactggtacccaaagaaggattcaaaaatcttggcagataccatattaccaaatctaactataggagctggaccaagagagaagactctgtaaatcacctgtctacagacccaagaccaaccatcttaaaagaggattcaggaaatcatttaaatgtttcttcctgctttcatgccttgaacatgctgtttctgagcaatacactacagagattgccctaattgacactaaatatgagttttaagcatttattctgaaaactagacccatgtaaacaagttagcatccaactatcaattcttagaa

SEQ ID NO: 161402 - DNA, 247 bp, Homo sapiens
tttcctttttactgctgttgtttagagtgtgtagttctgttgatgatttacttatgtacttgaagtactcatttctgtcaaacagatgcccaactattttccttttaaaaaactgtattctttactgcaatagatagcggaatagtaatagacactttgttaaaaaaataagtttcatgtttaaaataaatatttttttaaaatataaagccaaaatgaattcaccaatattaaggatttaatgtag

SEQ ID NO: 161403 - DNA, 423 bp, Homo sapiens
tttactagttctgtgaagaatgacagtgctattttgatgggaattccaataaatttgcagattgcttgtggcagtatgttcattttcacaatattgattctacccattcatgagcaggagatgtgtttccatttgtttgtgtcatctatgattttttcagcagtgttttgtagttttccttgtagaagtatttcacctcctttgttaggaatattctaaagtatttaaattttttttgcagctattgtaaaaggggttgagttcttgatttgattctcagcttggtcactgttggtatatagcagggctactgatttgtgtacatcctgaaactttgctgaattcatttaccagttctaggagctttatggatgagtctttagggttttctatgtatacgatcatgtcatcagcaaacagtag

SEQ ID NO: 161404 - DNA, 457 bp, Homo sapiens
  misc_feature (457)..(457): n is a, c, g, or t
gatcccctgaaatgggcacagaaattcagttatccaaatgaatgaattctggagatgtattctacaacgatgtgactacaattagcaacactatattatatacttgaaatttgctaagagggtggatcttaagtgttctcaccaccaaaaaataaaaaagaagggaaagaaaggaaggaagaaagagagagagaacaaaagaaaatggtaactatgtgaggtgatggatatgtatatgatatatatgcatattatatatatatgatttgatatggatatacgcatatatatgcataattgaaatatgtacaatttccaattgtcaattatatctcaatatgggaaaaagtcttgtcatgaaggagatgcttaataaatagtagttaatgttattatctttgattgatttgtctttgaataaatttctgtgcccttcaggtaccggctcgatgtatcn

SEQ ID NO: 161405 - DNA, 544 bp, Homo sapiens
gatcccctgaaatgggcacagaaattcagttatccaaatgaatgaattctggagatgtattctacaacgatgtgactacaattagcaacactatattatatacttgaaatttgctaagagggtggatcttaagtgttctcaccaccaaaaaataaaaaagaagggaaagaaaggaaggaagaaagagagagagaacaaaagaaaatggtaactatgtgaggtgatggatatgtatatgatatatatgcatattatatatatatgatttgatatggatatacgcatatatatgcataattgaaatatgtacatatttaaagtgtacgacatgatttgatatgcatatatatgcatatatatccatatatatgcatggatatggatatggatatatatgcatggatatatatgcatatcaaatcatcatgttgtacactttaaatatgtacaatttccaattgtcaattatatctcaatatgggaaaaagtcttgtcatgaaggagatgctccctatctcgtcgttgttattcgtcgcccgttcct

SEQ ID NO: 161406 - DNA, 601 bp, Homo sapiens
gtcgatcgagctcggtcctgaatgggcacagaaattcagttatccaaatgaatgaattctggagatgtattctacaacgatgtgactacaattagcaacactatattatatacttgaaatttgctaagagggtggatcttaagtgttctcaccaccaaaaaataaaaaagaagggaaagaaaggaaggaagaaagagagagagaacaaaagaaaatggtaactatgtgaggtgatggatatgtatatgatatatatgcatattatatatatatgatttgatatggatatacgcatatatatgcataattgaaatatgtacatatttaaagtgtacgacatgatttgatatgcatatatatgcatatatatccatatatatgcatggatatggatatggatatatatgcatggatatatatgcatatcaaatcatcatgttgtacactttaaatatgtacaatttccaattgtcaattatatctcaatatgggaaaaagtcttgtcatgaaggagatgcttaataaatagtagttaatgttattatctttgattgatttgtctttgaataaatttctgtgcccatttcaggaagcatattca

SEQ ID NO: 161407 - DNA, 502 bp, Homo sapiens
gtcgatcgagctcggtcctgaatgggcacagaaattcagttatccaaatgaatgaattctggagatgtattctacaacgatgtgactacaattagcaacactatattatatacttgaaatttgctaagagggtggatcttaagtgttctcaccaccaaaaaataaaaaagaagggaaagaaaggaaggaagaaagagagagagaacaaaagaaaatggtaactatgtgaggtgatggatatgtatatgatatatatgcatattatatatatatgatttgatatggatatacgcatatatatgcataattgaaatatgtacatatttaaagtgtacgacatgatttgatatgcatatatatgcatatatatccatatatatgcatggatatggatatggatatatatgcatggatatatatgcatatcaaatcatcatgttgtacactttaaatatgtacattctgattatatctctatatggttttctccttcatgacgtat

SEQ ID NO: 161408 - DNA, 273 bp, Homo sapiens
gtggggtaggtagctgtttaataacacacaccatatacctcccacaaacctggaggctccacaggacctgaaaagcttttcattttattgatcatgaatctgagggcaaaagacctttgttttcattacaatactgagcactagacttctattcttctgccacagaagtgcatccctaggatttctggagcttcctacctgacctaatttctgtccaccctcctctattccttcctttgctttcttctcccttcctcctcgcactacctctgt

SEQ ID NO: 161409 - DNA, 252 bp, Homo sapiens
gaagaatgcatcttcaatcatttcactgcttttgctctggattgtggttccccccaccaccatttctcactaatacatctttcttaaaagaacgacattaaacggtaagtctttatatgaaagtgacttgtcaaggggactggcttagatcctgattctatggattttacttcttttaattatattgaatatgtgtagtatgtgctttactgtttcaaaggagtcagcatctctattttgaaagatttatca

SEQ ID NO: 161410 - DNA, 296 bp, Homo sapiens
agtgttatattcaataaatattagttggatgaattagtgactggtaagtgggaaaaaatgtatttattttgtattcctttgattatcagtgaaggtaagtatcatttcatatattttttggcagtatgttatacaatatggcaatatgtgttacttctcttgtgacctttttactcatgtgcactaaccattttgtgtagggctttgggttgagtttggcttcagtaggtagatttcagggtgattgtgggacagccatttaggtatcagccatttaggtaacagccatttaggta

SEQ ID NO: 161411 - DNA, 248 bp, Homo sapiens
cacattttcctgatgtttgtgttatgatcagtaactcatagtaggcttttcaggacctaacagccatgtataaaattggctctccaggaaagcctaatctgagccctgcatacacatttatatatttgtgatttaaaaaaaaatagccagttcattaacatgatttgaaaatccaaaatcataaaaggatagtgaaatttctttgccaccctgttccccttccatctacttcccctctctgtggacag

SEQ ID NO: 161412 - DNA, 499 bp, Homo sapiens
cctcacaacagctgcttgcagtaggttataatattctactttacagatgtggttaagagggtcatgcacaaagccctttcaagtcagcgttggtccttctcacaccactctctccctctgccactaacacataatacataatagcataatgtagtagagttggctgtgtagtgactgcctctgttcctagaatatgagctctccacaggtaggaacagtgtttattcatctttgcctatcaagcttctagtgtagtgtgtggcacagagtagatatcttattaatgatggatggatggacaggctgacagttgaatacacttatgtgtgagtaaaatcatttcttgagtgaggggacccacaaacctttccatctataatctgctcctgcaggtctctgcagtcttgggttccacacctactaaaacttgattttaccaagattacttggggtctccttgaagacaagtaggtaaaaactcttctcagtccttgttttg

SEQ ID NO: 161413 - DNA, 374 bp, Homo sapiens
tatgtcctctgaggggaaaaaccttttctagtaatcctttgaacccaccaagactgcttttcataccaattagttcataaaatgtgttagagatacttttcatgcagttttaaatgtttttattaacattttctcaagttggtgaaaatgtggtagatgtagcttggatttttttttccaggcaagttagtcatgatgactgagatcctgaaaactataaaataatctattgtagacctactgagctcaatgaaaacaagtagcacagcacatagtccttacccttgaggagtttacattccactatgagaattgggccacagaatgaaaagatttggtaaaaattcaaggtatcagggagaaagagattataa

SEQ ID NO: 161414 - DNA, 676 bp, Homo sapiens
gcccgtgatatatagtgaggagttgatgtgcagcacacacaagtgtctgttacacaggatgtgcattaaataacgcgactcttaaatgctgtaaagtattgaaagcatgcacgtaggatttcaaggaaagcagagaacacagcctttcacaaagtagtcaataggcatctgtggattgaatgggatgtggttctaacagtgagttgagtttctggcttctgtaagacaattctgattccaaatacactgttccatcatctatataaacagactcaggcgtgtcgaaccctgggtcttccttcttcagacatatgggcttttatctacacccttccctgtaagatcagtgattttttaaagtgtgggaagttgaggaggttgagagattcagggaaagcccaggaagaaaaccatgagctaggtcagtcctgttcattcaaaatgccatgtggccacaaatatgagccagagatgttattttaaattttttagcagacatattttaaaaaggaaaaagaagcagatgaaattaattttaataatatattttatttaaccccacatattcaaaacattataattttgacatacactcaatatagacattattagagatttttcattcttttcttctaagtcctcaaaatcctgtttacagcccatctcaatttggacc

SEQ ID NO: 161415 - DNA, 601 bp, Homo sapiens
tttgtttcaacaccaccaatgcccactttatttatgatatctcttaataactatttttaaatttctatccattctctctcccttttctctttccttagtctcttggaataagtctgctctctgttgttttagcataacttttccctttggaggtggccctgaactagcagctatggctcaatggctagaattccagcttggcccagcatcaggttctgccccaacactatccctataatttagtgattacagataataacaatcaagagattccatgttcagctttctgacgttgttgttcctttgcatttattttggcctccagtgagccaattctctatgaatgagaccccatgatatctaaattccattggtaaatttacttcaagtaagataagtaaaccctatgactacctgggatttatttcaaggatgcaagactgtttcaatatttcaaattcaatcagtataatctatcatattaacaggtgaaagaaggaaaatcacatgatcatacatcaatcaatgtagaaaaggcatttgacaaaatttgacacccattcataattaaaattctcagaaatataagaatatagaggaa

SEQ ID NO: 161416 - DNA, 377 bp, Homo sapiens
gaggattactgaaataatgtctagttcctaacatgtaagtgtcaaaaatattaatcatgtatattactaatttgaaagtttctgaagggctcaaagatattcagaccataaaaagaggatgatcagacttggccctatggaaaggcacagagtaaggtctgaaataaaagactctaagaggctctccccacccgaaatcccctatctccattcctcctatccttcctgtccaattttgcttcccttcaacctctctcagaggttaatcactcctgatattcccaacattaatatcttttatgcctggagatattttaggtgagttaagtcattttctcccaaagaaacactattcggcaagtacattatgttaatct

SEQ ID NO: 161417 - DNA, 566 bp, Homo sapiens
catctcattttgaccttcagtcatttgacattattattttgttgccccttgtctcaatttttctatttgtattagcttagattccatggtttctcatgttcacttcattgcacatcttcaagtcctttgcccccttcttcttcgcagcagattgcagaattcaaagaaggctcttttttttttcctccatccattccttttcttcctgcttggtacactgtagagtgtgatgttcaaagcaatgacagtcaacttgtaatcatgactaaaaggtggtccactgagaatagcaaagagcaaagaaagggtctggatccttggccttgcacggtggctcacacctgtaatcccaccactttgggacacccaggcgggtagatcacttgaggccaagggtttgagaccagtgtggccaccatggtgaaaccccatctctacttaaaaacacaaaaattagcctggtgcagtggcacatgccacctagtagtcccagctactagggagtctgaggcttgagaatcacttgggcctggaaggtggaggttgcagtgagccgagatcacatc

SEQ ID NO: 161418 - DNA, 373 bp, Homo sapiens
tccacccaaatgtgccctgggtgaaacatacccacatcctaaaggcatcttctttcttctatgaaatgggcaccattctcctcccagctgcttgggttcctcaaagagagctgcactccctttgccacaatctggggaacaggaagacactggagccacaccagaaaaatggaagcctcacttgtgacccactctctcccactcgaatcagttcttgattctaatctccaatgtagcttcaattacctcgggaatcctagttgcaagagcaactgacattgtttttgatgtgctagtctctgcaatccaggaaaacagaaccacaaggacactggaacaaatggaagagctaatctactccatctgctacatt

SEQ ID NO: 161419 - DNA, 466 bp, Homo sapiens
gctaacctcgataatgaactcttttttcagcaaaaatacctcaaaatgttatttcaattctgtgttccttcaaggagatatttacagagcgtgatccacaccaaagtccctggaaaagtgttcagtgttgcccaacttgaaggtcatggctaagtgataaatgtagtctaaaaaacacaggtggttggatcacactgtttccactgcccctgctgccaggactagctataaaccagtgtgtaacatgagcagcatgtattgcagctatcctccctcctttcttttccgtaacctcagtaagcagtgccctcaggctgcctgcagctgtgcgggtgccccctctatggtgtcatccatgccttctccatcagtgctgtcctttgaccccacctttcttctcctaatctgcaatgtgtcctgctggacacaggactcagctagaaccatgttagaaagaccatgtgat

SEQ ID NO: 161420 - DNA, 275 bp, Homo sapiens
gttgctcccagctcccatccaaaaaggctgcctcacttccctgtccttccttgcctcagaagttccctgtcacttttctcttaaattccagtgttctctcttggatgatatgttcaagatgcacttatctattcattacttttgttcttcttagtggaggaggtaaagaacagatgcgtctagtcagccatgttgaagcccatccctttgaataattcttaggaaaggtttaaacaattttctgagaaaaaaatcttgcttcaagaatccttttg

SEQ ID NO: 161421 - DNA, 256 bp, Homo sapiens
gggttctccctcaacctcctcactttgggcatttacaatatcttaagttatccacagataatattctgtttctaatggcccatgctaccaaccattagttgctaaatagtctgcttttcagaagaaaattacaatccatgtattattttgaacttcctatgctattttagaacttggcgattttaaattgtcccttacacaacctaccccaccctctgatgtacatgtttttctgttcagactcatcatttcttta

SEQ ID NO: 161422 - DNA, 660 bp, Homo sapiens
gttatccgactattccaagtacaatctacatttgattcaagacacttcaagatttttggtttcttgaaagttacagaagatggtcagagagggccattccctttttgtcttatccccagagtgtcaggaacgggtgtatctaggtccagagtttgcctcacaccaaggatctgagtcaagctcttggtggtgaggccaggacaggctttttcccttcaaggcttcccacaagaacagtatctctgtgctttaggttgatatatttggggggttggggggagcctggagacagacaaggacaaaagagacagctttgtgaggttgagaatgcaagtctggaaggcacacaactctacatggctaccaaattacaaaagcattccatctgagaggctggccgacaagctgaggagttagttacatcaacatctcaggcaaatatactcgcagtccctgaaagtcagggtgacagaaatgcaaactggtcatcatcgacaccggtaggaaggggactgagttacttagagggccaaaaagaaggcaagcatctttgaagcacagcccagaaaatatttacctaactccaaagttaggaatagaaatgagcaaaatcctattgaacccagaaatcacacagcagcatttcaggagacatggatg

SEQ ID NO: 161423 - DNA, 681 bp, Homo sapiens
tccattggtggatctaaccctggattcacaggaggccaattctaaatgcatttgagatactaggaatttcttgctataatgtagaaagaatccatacgcttcagggggtaggtaagttagagtggatttatcacgtgtgacttaacctggcttgaaaaatacgtaggtgtgtggagcttctacattcgtaaaaagagttctggtagctgttgtctgtggacagagatgctggtgggagggatgatagtggaaagggagcccctgatttcagtggggctgggaggattctagggtgtcagaggccaagcactgtgatattttaacccaaagtgaagtttgggtgttattccgtggtctgtgccacacaggtcttggctgtgactcatcagtggtaaggattttcggcctgagaatggggagcccatcgtggtcccctagacgtgtagacctgaactaccaccatagctggcacaatggaggttcctgacctctgacccattccccaggtctgaatctgctcaaagaacctgcctcccttgatgatagggaagccaagcttgagaaaaggactctgccaaaatatccagtcacggacagtgaatccttctgcccgatttcccatattaggcccttcagctatttgcctgcgaaactatgatggaggagtgggaaatatccaca

SEQ ID NO: 161424 - DNA, 381 bp, Homo sapiens
ctgctatgtagcccaggctggcctcgaactcctgaactcaagcgatctgcctgcctcagcctcctgagtagcttaggactaaggagcatgccccagattgctcgtcattagctgcctgtctcccactaagacaggaaggagctcaccagggcagagatcgctgtctgtctgctcacccatgggcacctagggcagagcccagctcacagtaggatctcaataactgtgtttcaaatgcatggattaaaacattcctgttacacaagaccagcattccaatggtggaatctttaaaaacttttcccctgtgggagtttcaattctttttttcccctgagcccacacagagaagaaatgtgtgcttcccggctcccagggcag

SEQ ID NO: 161425 - DNA, 739 bp, Homo sapiens
aaatgtagaagaaataaagtaacatcgttcttggatcatagttttctacaatatttttctcatttagaagaccaaaagtaaagccatgtccctcctcattattgctaacagttacatatattctgaatgatatatattctaaatcaattattcactacaatgcacacacaaacgttccattattttgtattacccaaggtatcaggcttgttcactgagaatatgtgctaacgaaaatggtttattttccctgaggagtccagacaaaggagaatgagaggtcagtagcagtttaaagacaacgctgaatttgcctaccaactttttaaaaaatcaagctattttgaggaacctatggtattttgtcatagcaagtagatacttttaccaaagctatttatttgggacttattaaagaaagtctccttgcccattttgccattgtctttgtacaaggcacttgctttagtcaatagctatgaagtctaaattaacactgtcagataatcaggctaaaaggtgacaataaagctataaagcagctgtctgaaaacttaactctgtataaaggagaaagaacaaaaagaatctattctgtgtcatgtacccagagatatttgtgttctgggtagaaaagatttgaactttcttaaaacgttagtgagtataaggggaggtgccctacttagaaaataaaccactagttttcctcaggtggcttgaaaattgggcagatgtt

SEQ ID NO: 161426 - DNA, 444 bp, Homo sapiens
gtactttatttctcacagatgaaccttcctatttaccctgactcttctcttatcaaaaaacttatcatatctgggttaaactacatactataatgttcttaccgggttcccttcctgaaactttgcttctctggaggcaattagaaatgattccattaagctcatattcatgtgctggtcagctctaaactcatcatgaaattctcaattccttacaaagggaatctcccatttgggggaagtaactcattttctagctgcagtatgttattaagcttgctcacttcttagtgctgattcttccctgatttgcttctgtgcctccacgctacatggctgtcactacctgatgcaggaaaacaggttacaacacatttttgtcccatccttgaacacacacaccagcagccgtttgctcccacaagccttccccattcagaatac

SEQ ID NO: 161427 - DNA, 443 bp, Homo sapiens
actattggtatatatgtctcctccttaagggcagtgactataactcatattgcctaaatattatcagggtgatacagcattttccacattacaggcactcattaaatatttgttaatgaataaatgaatcaaggctgggcacagtggctcatgcctgtaatcccagcactttgggaggccgaggtgggtggatcacctaaggaaaggagttcaagaccagcctgaccaacatggtgaaaccccgtctctactaaaaatacaaaaactatccgggcgtggtggtgagcacctgtagtcccagctactcgggaggctggggcaggagaatggcgtgaacccaggaggcagagcttgcagtgagctgagatcgcgccactgcactccagcctgggcaaaagagtgagactccgtctcaaaaaaaagaatcaccatgcacggtggct

SEQ ID NO: 161428 - DNA, 258 bp, Homo sapiens
aactgcttccaaaaagtcaattgttggaattatttccccaatggagcacagaagaaagtgcagagatgcctcacgctgaagttagcatgtgagaagatacaacaaaaggacaggttcagtcccaaacacttactgtctatgtctaccaggtacctacatttaacacaaggaataaaaatcacacatggtgagagataagaagtcactccacaggtgaccacaggtggcttacaaaagaatgccatggcccagaccatc

SEQ ID NO: 161429 - DNA, 430 bp, Homo sapiens
aatgtgcagcccatgtcttacagtaaccactataagcaaaaacaaaacaaaaagaagaggtatagctaaaaagaggagataatatataaaatggaataccaaaaaagattaatccaaaagaaggcaggaaaagagaaacaaagaaacaaaaatagatgatccaaataaaaaacaaatagcaagatggtagttttaaatccaatcagatgaataattacattaaatgtaagtggattaactctccatttaaaaggcagagactataaaactggattaacaaacaaagccagctatataaagacacagattaaaagtaaaagaatcgggaaaatataccatgtatatagtatacataaaaacactgttgtggctatattcatatcagataaagtagactttcagagggtaacagcagagataaagagaaata

SEQ ID NO: 161430 - DNA, 394 bp, Homo sapiens
aactcagtagaaaaatgggcacgggatagctacagacagtttcaggagaagacacccaaacggccaatacgtgtaggaagagacagggctcagcttctctagtaaccagggaaatgcaaattagaacaacaatgagatcccatttcacacccgtcagattggcaacaattaaaaaggctgacaataccaagtgtgatcaaagctgtggggaatcggggactccagccctgctggtgggagtgtaaattggtagaggctctttggagagcgaaacggcaggatattgtaaaactctgtttatctcccgtggcccagccttctacttggggtatacacccaagagagaaactccagcttgtagacacatgcatgtaagaagcactggaatagccaa

SEQ ID NO: 161431 - DNA, 776 bp, Homo sapiens
cttagtctcctgagtagctgggatttcagccacccgccaccatgcccagctaatttctgtacttttagtagagacggggtttcgccatgttggccaggctggtcttgaactcctgacctcaggtgatccacctgcctcggcttcctaaagtgctgggagtagagtgcatttcttttaaaatttacttactaaatttttttttccttttagagacaggatctcgctctgttgcccaggctagagtgcagtggcaccaccgtggctcactgcagcctcaacccccctgggctcaagcaaaccgcctgcttcagtccaccaaattgttgggattacaggcatgcaccaccacacctggcctggatttcattttattcctttaaggataccagactttattctggcatatacatatggttaagttacttgtagtcatttggacccttcccatgttttcttttaaataccgttggggctcatctagtgcagtctttgcctagtttaatttcatctcactactaaggtgaaatccttctgagtactctacctgttgccttatgtattatgaagtctctccactgtggctaatgggaacatgagctcttcagaaaatatttggcctactgcttctctctagttttctccagtctctggaatttcaccttacaaatttacagatgatgttttcagagatttaagggtaccctgtgcagatctcaaggctgcccccttctctcccatattctgttgtgtaaatcctacccactttagtttctgca

SEQ ID NO: 161432 - DNA, 256 bp, Homo sapiens
ctcgcacgcctcaccagcactgcctctcccgctggctgctctgagccaggcactctttcccctctgggtcttggcacttttcacacctgctggtccactccaggtaattccctgtgcttcagccaggcatcttcccagaaaccacatatcactccatccctcccctgctgagccccttggccttcaggtaaagtcttcccatgtctacctaaagcctcctctccctaccagctccctggctgcctgaccctcctaa

SEQ ID NO: 161433 - DNA, 185 bp, Homo sapiens
gcaatttctaacattcagtgcaacctaacatttgttgtgagctcacaatacgttggatactaagccgactttgcaagggattgaaagataaacaagacatggaagttcacagactggtagagaagacatcatgccagcaacaatgtgacaaatgctatcactgagatatgtacaaggtttgtatg

SEQ ID NO: 161434 - DNA, 879 bp, Homo sapiens
gcctttcatgtgtttacaccttacagtccagcagaagaaagagctcctcttctgaaaaccttgaaagctcttgaatcttatgtctaatcccccaacaaatcactatgatggcatgccataccacactgagtctgggtctgtgctacttatccttgaaccaatcactttggtgaggggatcggtattatgataaatggttagtttatgtaaattaaggctgaagcctaaaattgaagcttgagattcattcccactcaagttaatgtgctattattcgaaggaacagagtaagtactataaatattggaaagaagttagcacatttctcactgctggaaaaccatacaattccatatcttcaaaagccaaatggatcaactcataaagtatatcagaaataatcagaaataagtaagattatttttacaagattaataatggaaaaaattcaatcatttttatataaaaataaccaattagaaaatataattaaaggaactatttcatttattagatataaaatatactgaaataaatttattaagaaacatgcactatttatatgaaaatacatgcagtttcactgagagatctaagatgtttctagctaaaagagctcaacattataaagatatgtgttctccttaaatttgtttctaaaattattgcaatcctaatcaaaatcacaatgattttcttttttggggaggtagatctggctgggggaggtagatctggctgtcaagacaaaggttttaaagtctatatgataaaactaattatgctaggctagccccgaaaaaccaaacagacaagcccaggcatcatgggcctgtgtgaaagaaagaagcttttgctgactgtatatataaaacataa

SEQ ID NO: 161435 - DNA, 409 bp, Homo sapiens
tctcatcatgcttggtatctgcagagggaggctttgattttgaagcaaatttccttgattcttggaagctctacttgtagcacaacttggttaacttctcttgtgaatttcatgttttccctggaacttgggctaggtcccatggcccctggtgtgtgtgtctttttttctgttaatattttcttattttgttcaacttgcggagagattttctctacttttatcttctaaccccttctgttttcttgaattttaaaattttctgctgtcatttaaaaaaattctccaccagcggcagtggcttacatctgtagtcccagcaatttgggagcctgatgcgggcagatcacttgaacccaggagttcgaaaccagcctgggcaacatagcaagaccatgtctctacaaaa

SEQ ID NO: 161436 - DNA, 406 bp, Homo sapiens
taatgaaatatcagccaggggaattcagcaatatataaaaagaattacatgccatggccaaggccgagtagggtttattccattgttgtaagacttgttcaatatttgaaaaatctgtaaatataatccaccaaataaacaggctaaagaagaaaaatcatgtgattatatcaatggatgcagaaaaagcatttgacaaaattcaatactcattcatgataagaactatcaggaaactaagaatagaagggaacttcctgaagataaagaacatctacaaagaacctacagctaacatacagtcattccttgccatatgtgggggattggttccaggacccccacatacactaaaattcactcataatcaagtcccacagtaggtaggccctgcagaacctgtgta

SEQ ID NO: 161437 - DNA, 835 bp, Homo sapiens
acgtacccacctgaggtcaagagttcgagaccatcctggccaacatggtgaactccaactctacttaaaattaaaaaattagctgggcatggtggtggacgcctgtaatcccagctacttgggaggctgaggcaggagaatagctggaactgggagggagatggttgcagtgagctgagatcactgtactccagcctgggcaagagagtgagaccctgtctcaaaaaacaaaagaaaaaaaaaaagaaatacctgagactgggtaatatataaagaaaagagctgtaattggctcacggttccacagctgtctaggaagcatagcagcatctgcttccggggaggcctcaggaagtttccaatagtggcagaaggcagagtgggagcaggcatgccacatggcaacagagagagtggctggggggtggtgccacatgcttttaaatgaccagatttctcaagaagtcactgtcacgaagatggcacgaagccatgagggatgatcctgccccgtgatccaagcacctcccaccaggccccacctccagcactggggatcacagttcagcatgagattttcgtggggacaaatgtccagactatatcagttagcatatatttacagttataaataacactacagggtcctcatacttttatgtcctgttttcaagatgaattcctagaagagttttatggtcaaaaggtatgaatgttttaaagactgatgatgtaaattaccaaattgttttccagaaggagcaccagttacactcccggtagtggctgagtgtgggagtatccatttcctgtatcttgccaacacatggtgtta

SEQ ID NO: 161438 - DNA, 425 bp, Homo sapiens
gccaggcgtggtgacacgcacctgtagtcccagctacttgggaggctgaggcaggagaatcgcttgaacttgggaggtggaggttgcaatgggccaagatagccccactgcactccagcctgggtgacagggcaaaactctgtctcaaaaaaaaaaaagtggaaccagaagatgattaaaaggatgcaacaggtaacaatgaacctgagaatacacaggaagacctaagattcagataaagctaagcaattttataacctgaaccagaaatagtgaaaagtaaaggtccctgcagagcatggtggctcctgcctgtaatcccaacactataggaggccaaagtgggtgatcccttgaggtcaggagtttgagaccatcctggccaacatggtgaaaccccatttctactaaaaatacaaaaaata

SEQ ID NO: 161439 - DNA, 305 bp, Homo sapiens
acgctcctctcttcaacagtccaaccccattcaaaccacatccagcccagagagaactgaccccagctcttcaccttccctgtcctcccagaagtggccttggtccaggaaagaggggactcctctcttgctgacaacatccaaaacctgctctatacctccagatcaccacctagagctgctcttcagggatagcaccagcgcctcagtctctggtgtcaacttgcctgctgagatgctaaggcctggacacagcctgcactgccttttcagccccacggtggccctggggctatataccacac

SEQ ID NO: 161440 - DNA, 535 bp, Homo sapiens
tcatgccaacaatagccacggcactgttcaagctgcagcaaacataattgtacaagctcctccacaatttacagtaacccccaaggatcaagtggtgctggaagaacatgctgtagagtggctctgtgaagctgacggcaacccacctcctgttattgtctggacaaaaacaggagggcagctccctgtggaaggccagcatacagttctctcctctggcactttgagaattgaccgtgcagcacagcacgatcaaggccaatatgaatgtcaagcagtcagttcgttgggggtgaaaaaggtgtctgtgcagctgactgtaaaacccaaagctcttgcagtgtttactcaacttcctcaggatacaagtgtcgaggttggaaagaatataaacatttcatgtcatgctcaaggagaaccacagcccataattacttggaataaggaaggtgtgcagattactgagagtggtaaattccatgtggatgatgaaggcacgctgactatctacgacgcagggttccctgaccaggga

SEQ ID NO: 161441 - DNA, 248 bp, Homo sapiens
tcttgtgttgattttcatattaacaacatactataatcaggttattcttttgttcagagtaaagctaattagacaaaatgcttaagtagttgcaaggttaataaacataagagaaagtaagcagtttctattaaatggggaagttagtcatataatttttaaatgaagctgttagaacaatgtgcaaagttgatctggatttttgccaattcctatgaaaaataatccccagaaataaactactaagg

SEQ ID NO: 161442 - DNA, 167 bp, Homo sapiens
attatcagtactgcatgtagccctctccagcacaagcaccatcctataaaatccccaggaagcctttgtctctttgtagtcagctaggccctgccaccactgtgcttggctgagttcacaaatctgttgtaacctgtagcttccctgtcacttctctggctctcctc

SEQ ID NO: 161443 - DNA, 551 bp, Homo sapiens
cctaagtgatcatcaagctcctccatcctccctgccctgcctccccacaaatctcacccaagcaggatcttcaaagaactatttaaagttctgctagaaaaggcaaacctaatgtgaagcatgtaagtttttgttctgggaagagttcaacaatttatatgcctttttagggcaataatttattttaaagagtgggagtgcagctgtggcctgttaacatctgcccttgatatttaaaatatttggcacagtttgtgaatctgttttttacctattcaaaatcatctaacaaatgctagcctggaattaaactttggagtatataggacacaacactgtcactgtttaagctttgtatatagaaaatatgtgggtgtcgagaaggtatattttattttatttatttatgttgagactgtctcgctctgccacccaagctagagtgcagtggtgcaatcatggctcactgcagccttaacctgggctcaagtgagccttccaccttacctcccaagtaactgggactacaggtgcatgtcaccatgcctggc

SEQ ID NO: 161444 - DNA, 230 bp, Homo sapiens
aatccatctactctctagggagaggcaaaggtgaacacaacccagttgattctaaactcctatacataccactttaaacaccacttcaacctccaaggcaaaacctggaagaatggtgggatggtggtcggaggtttgtaggaagtgaaaaaataagatattttctagattattttatttctaaagccctaagctaccaagatcataagaagaatacctagcaccaaact

SEQ ID NO: 161445 - DNA, 388 bp, Homo sapiens
tgtgtgtgcatctgtctccatgtacatctgtgtgtgcacatcagtgtgtacactgatgcctgcctgcatgcgtctgcgtgtgtgtgcacctggcacatatgtggctcagcaccagctgtgaacacagtagggccacagagagcagctgctgtgaccgtcatcactaccacaccaggaagcagcatcctcatcgcagcccacctcgctgtttccatgggtccctgatgtgcttgctcttccactgacatggctaatggtgggtggttcacttctaagaggcgagcctctctgcagggccccacttggtcagagcagcccacgttcttgccccaggaaccaggcatgtggctcttgtaggtgtctgttcccagagtggcagctgacctgg

SEQ ID NO: 161446 - DNA, 167 bp, Homo sapiens
agtaacaacaacaacaacaacaacaaactaagaaatgttataatggagttttggcttaaggaattacaagaattacaattataacacttgtttgtttttctggttgtttttttttttttttttttttttttttttggaaacgaattaccgctcttgtggcaccccaa

SEQ ID NO: 161447 - DNA, 240 bp, Homo sapiens
actaaacataggaaatgagggatatgctctcttacaagactctcaagaagtgttaaatgtttaagactggctgccaatgctaattggttctgctgtcatgatatgtgtaatagcctgaagtgctttctctactaaataaccagtaggaagacatatcttaacacttaaaattcaaagtaaaccccaaatatttccaaccattgtaagttccaattccattttcctactacatgcatcact

SEQ ID NO: 161448 - DNA, 294 bp, Homo sapiens
acttgcaacaagtatttcctgagtgcctactgagcatcaggtactattatagacaccaggcaacaacagtgaacaagaactaggcagcaaacaaaaagagacaaaaatctctgcttttgtgaaatttacattagggttgaagaaacagttaaagaattttaacaagtaaatatataataggccacataatgataagtgctctgaagaaaaattaaacaagataaaaagtcagagaatgagaagggacactattgtaatagtgatgagaaaagcccatttgatgaggtgacattt

SEQ ID NO: 161449 - DNA, 353 bp, Homo sapiens
acgtattaactgcaacactgcatgtaacagtaaagactggaaacaacctgaatttctatcaatagcaatctgttaaatcattaaataaggtatagcctcaaaaccactatgtagcaatttagaaaaattaaaaagaaggggaagatcacagaagacccttcaagatcctttgttaagtggtgggtgggtccagagtcagaaaggtcagaacagtgaagacagctgaactaatatgtacatgatagactctagacattaagggtctctattttcccaccgggaaaaaatcatttaattttgctcctgacagaggagactgtctagttatgagcttttgttgcaagaggcggcct

SEQ ID NO: 161450 - DNA, 448 bp, Homo sapiens
ctcgagggaggacggaggcagggaaggaacagccctggcctcatccagctcacccgcagataccccacccatatatagatctgaagtcacgtaacacacctcgattctgacatacaccccaacaaaccagacgcaccagttcacggtcaccccaactcgcagacactacccattcagatggacacttcaaaacttagaatctttagctcacaaagatacaccccctactcagaggcatatggcatacctcagacacggccaattcgaagatgtaaaccccaccacacataaacatccagcctacaccccaactcaaacacacactctgaatcgtaagccctaaagcacaaacacaccaagccatacaaacccttgattcacgacgcccgggcacacagatgcaactcaactcaagcaacaccccagctcaccatggacgttccctctc

SEQ ID NO: 161451 - DNA, 197 bp, Homo sapiens
tgggttggtggggtggggtgggtaagggattcagataagccagaagcagggtgatttttagttggaattgtaaactttagtcagcccccacacgctgctggggaatgtggaatgttctagctctgagatgttaactgagaaaagagaagtcaaacaaagccgatacgtgcagccctgtctatagaatccttcattat

SEQ ID NO: 161452 - DNA, 333 bp, Homo sapiens
acacatgctgaagacaaaaaaaaattcaatactgcaatacaaactttctttttcttgatgcctacaatcaactgaatattagaaatgtttgagcctgggggccaggcgcagtggcgcacacctctaatcccagcacattaggaggctgaggcagacagatcatctgaggtcaggagttcaagaccagcctggccaacatggcgaaaccccatctctactaaaaatacaaaaattagccaagtgtggtggcaagtgcctgtaatcccagctactcgggaggctgaggcaggagaactgcttgaacttgggaggcggaggttgcagtgagctgag

SEQ ID NO: 161453 - DNA, 468 bp, Homo sapiens
ctgatatgtcaacgctcaatatcacctgaatttaagctatggctcaagttaaatgcccttaggcaattttaccttagttacttttaccaaataccgtatccacaagtgggtggacgtcagttttgtccttcgagatatgcagatgcattactcatccctccaatgttacgctcttgcaacatcaatgataagcaaattagcagactgttatctttttaatggaagaatttactcatcaatagcaaaagctttatcagaaattgacattattgaatcctctggagttgcagaaaagaaaataaaaagaaattgatattgggaaaacctgactggtttctttcagctgtgtattgtattgctaggttaggtgtgacacttaacacctgtgaatgtggctgaatctccaagaatgatcaaatacacaacgctctggggtgatgctcaaagatctttggggtaccgagctcg

SEQ ID NO: 161454 - DNA, 115 bp, Homo sapiens
taggacagttcacagtaagacagttcagagtacacagtaggacagtacacagtaggacagtacacagtagaacagttcacagtacacagtaggacagtacacaggacagtttaca

SEQ ID NO: 161455 - DNA, 240 bp, Homo sapiens
aggacctgcatggtggggtgggccctctcctggctctgtggaggagggaaaaggcttatggagctggaggccccgtctcccagccccactcagcccacagaggcaggagaaacccacttgcccctgatagctgctgctgctgctgtgagccaccgcactactgccttgttcccagcctgtgtgtgcagattcttttctggcacaatgccttacatgttttatttgtaacagaagtggggg

SEQ ID NO: 161456 - DNA, 313 bp, Homo sapiens
attgtagccatgtagctgaggcctgatgagaaagcagtcccagcctctgcctgaggctagttaaaccaggcaatttcttaaattagagcatgaattattaatagtcataattccatagcaggcttcattttttgagcccttactatatactagcagtgcagatgatcacatttaatccctccaaccaccctaaagacatctcacagtttgtaagtggtaatcaggaagggaatcagtttgactctaaaactagtacccctaatcctaaagctgcacattctaggtccagactcaggtggtgtgagaacagagc

SEQ ID NO: 161457 - DNA, 266 bp, Homo sapiens
ttgcttttgttttaacaggatctgtctggctgcttgatggaagggacgaggtagaagcagggaaaccagttaggaggctgttggaatccaggcaggattctcctatcactgaacactgtgcctcataggaggtccttcatacgtatttgtaaagtgaaagaaggaagagagagaaatgatcaggttctctggaccacctggggaggccgctaggtctgttgcggggctctggccccagcccgtgggacgtatctgcacacccacag

SEQ ID NO: 161458 - DNA, 560 bp, Homo sapiens
gaattttagatgagcagttattttctttcagcccattgaaaatatcattcccttgtcttttggcttacatttgtatctcttattgctactcctttgaaagtattgtgttttcttcctctagcttcttttaaggtttttttttgtaagttttggaatgttcccagttatctcttagatattgcttctattccattctgcctcttctctttagtctttttttttactgtatcttgtaggtctcttaatctcctttgtgctttacattatgtgtttggggagtggtgactgtgcttcattctggatattttcttattcagcattctctcttcagccatttctactatgcttttatgtctacccattagttcttacttttaaataccgtatttttctattctagggttttcattttgttattttatgtagtttccaattatctgtcaaaaattttcaacctcataatttttctttgaatatattaaacatgtattttaaataatgctgataacttcattatttagattccctgaggattgatctctgtaggctgtttcagattt

SEQ ID NO: 161459 - DNA, 315 bp, Homo sapiens
actggtggtggtggtcataagtccagcctgcaggactttgctcgcaccacttcctcatgtgctaactctgctttgtctaaatggtagtcactagctagctatggctgtttgaatttaaactaagtggaaataagaaaaggtgcaactgtgacctctcagtagcaccagccatatctccgtgtgctcagcaggcacacagggctcatggcgactgctgggcactacacaacagaggtatttgtcattgcagaaagttctgtggacagtgctgccaaggtggtggtgtagtattttggtgatatcttctagcaatta

SEQ ID NO: 161460 - DNA, 386 bp, Homo sapiens
ctttcaggattattccccttgtatcactgcaaactccccatgacattcactgaggacttggtcgccttgctcctccctgacattcactaagatgtcccaattcttgctgtcctcccggtcctaccattaacttgggatgcctgtgttcatgtttccaagccttcttgacttcctttaattctatgtatttttatttcttcaagctgggtacttgagtgacccactgcatggccacactctgcacttcacataacccagagctgcctctcctcagacactgtaaacgccaacagcatttcctgcatgaatttatagaaaaataactgctctccctctctccagctgcttgcgtcctccccggccttccacacagtgtcgtctactta

SEQ ID NO: 161461 - DNA, 236 bp, Homo sapiens
ctccctaagtattgggattacaggcattagccaccatgctcggtcaagatgttattaattggaaaaaaagttgcaaaaaagtatagcatatatatgagtaaatacacatgaaactagaaacaactgtggctgcaaatggtttacagaatatataccaccaactatgtataaagcaaactgggaagacacatacactcatataaaccaaactgtgggttgagtgggttactggggac

SEQ ID NO: 161462 - DNA, 319 bp, Homo sapiens
gcgtcagtcaaattgtccaagaacctgacatcacatcctagaaatatcaaatataatctaaatgcagcactgtagccttgcttatggaggttaggaaacaaagttgttaaatatctcactgaggtcccaaaggcaaagcagggacttagtttgtcttcttagcactatgatacgctgcccctctttaaaaaaaaaatcactaaattctgaggttctagaatgtagagcatgtagaccttacaccttgtgtttctgcttattagtcaaacagtagctactgtacatttccttcctcttcctaaatctaaaccttatcatt

SEQ ID NO: 161463 - DNA, 282 bp, Homo sapiens
gaggctaaagggggtgggctttggactggattggggctgacctcagcctacacctgcaggaggaggtggagacagaggtggcctgggaggaatgtgggcacgtcctactgtcactgtgctacagctctcagcagggtggcttgctggtaggtgtgctgcgctgcgcccacctggcccccatggatgccaatggttactcggaccccttcgtgcgcctgtgagtgaactggggtaggcaggcgggaggtgaggataaggcggtgactcctcacctctccaggg

SEQ ID NO: 161464 - DNA, 183 bp, Homo sapiens
cattttaggagaaacttctgttgtcctcatggaacctcaagaacttcaggcagacaggtctctcaaactctaaggctctcctctgttttgctttgcgttatctgaccttttaagtttgggtgggaatcagaaatcagtcagggagagagatctagagaaagttgtggatatgaagatgtattt

SEQ ID NO: 161465 - DNA, 721 bp, Homo sapiens
aaaaacgaaataagtgaatgctagatgctaaaattcaactgaaaatatcaatttaatttcacaagttgattcattgctcatttttcactgaaatgactgagaaaaaaatgtcatccaagtagtaatgaacacctgtaacaaccatacaggcctcttggaaaacggcttattcaaggttcagggcaggaagttgagcatgggacatcttattgtattaaaaacaaagaaagctttcaaagatgaatgtgtgtctttttaaaaggacacagcagctagcaggaaggggttataacttgtcaaagttgtggtaagttgagcaccaagaaacataataattgtgtttatgaaaacacattaaatccatagaaatccataattccaaaatgacactaaaaaatgagaaagccagagaaaaattaacttgtcatctttagaggtagctgttaaaaccatttcttactttgaaaattagaaattacagggaaggaatgtagcatttatcctgtctttacagtaagaactgtatttcatgataacctagttgcccagcttgggagagaaagccctcttacggaagaatgccagctaataagagaagagaattcaaaagaattagaaaaacatcatttctcagactctaatgaaattattgattcaggaaaggattatcagttggcgataaagtcattaaatgaatgattaatggaaagctggatgcttg

SEQ ID NO: 161466 - DNA, 169 bp, Homo sapiens
gtgactctagcggatcctctcctacgagcgcagctaataagagaagagaattcaaaagaattagaaaaacatcatttctcagactctaatgaaattattgattcaggaaaggattatcagttggcgataaagtcattaaatgaatgattaatggaaagctggatgcttg

SEQ ID NO: 161467 - DNA, 568 bp, Homo sapiens
gtttattcaattcagttgtacttttcaactccagaatttctatttggttcttattatgatttctatatatttatttatattgtttatttattgagacattgccatcatgacttcctttatgttcttaaggatgtgatttagttctttgaaaatatttatgattactactttgaaagttttttgtctgctaaatccaacatctggtccctctcacagtttctattgcctgctttgtttatttcctttctttcatatggtttctactttcttgtctcttgcataaatcatcattttttgttgttgaaatttagatattttccgtaatatattgtagcaacactctatactcttttcacccttccccacagcttgttactgttgttcacttgtgtatttgtttagtgactgacagaactattttaatgatggtacaaccttgggtgtgtacactgtcaccttgagataacagtggtttgacagggttctctttgtctctttcctaattacatagagctattaagctccattaattacatgctgattgctctattgttttcaacaatgatct

SEQ ID NO: 161468 - DNA, 185 bp, Homo sapiens
acttcccacatcctaagtgtgggctgtgcatagtgactctcttccaaagagtacagtgtgaaaagagaggagagagtaactttacagtggagaacacggacagacactacctcagccaggtgatcaaagtcaacatcaatagcggcaagtcatcttgagagaatgcgtgcctgatacagagtgct

SEQ ID NO: 161469 - DNA, 154 bp, Homo sapiens
tacgagatcactcagctacaaagtgtgaaacgtggagtaggacccacagtgtgtgtttactgattgtttaagaagagtaggttgtagagtcagtaatgtgggggacccgttcccttttccctggcctgcagcagcagagctgggtagtgaattt

SEQ ID NO: 161470 - DNA, 471 bp, Homo sapiens
ccttaaatgcccttcccttcatttcttgctctacctcacccccaacacacacgtacactgcctggttagcttccacttatccttcaaggtgccaatcaaatacaacctcctctgatgagtcttcccactgattacttgattcccttcttcactgtaatatacaaagtgtgtattgtattcagagcaccatggtgttctggttattggttaactctctgtcttctctactagagtgggaactccttaatgataggaatcttattttatacatctctttatttccagagcctcaaaaactgtcaggcaatgaaatgtggatttcggtaatgtctgaaagatgtgttgaaaatgcaagtgatcacattaagcatcagttggatggtaacataagtactaccttcagagttcaaagagatcacttagattggcatggttaaagaagacagaatgaaggagttaaagaaatgagtt

SEQ ID NO: 161471 - DNA, 112 bp, Homo sapiens
ctataaatagcctgtgtcagcacaggtcatgttttactgccagatgagtccaagtcaggtcagcttttgccaccaaaagatttacatcttttgttacaacatcacatcactt

SEQ ID NO: 161472 - DNA, 698 bp, Homo sapiens
ggcatttgtctccccgctgctacgctccagctattctggcttccttgctgtccttcaaacatgccaagctctttatcaatcagagcccgactgactcagaacacttcactatatcattccagcccctcaataaatgtctggcattttctttctttctttctttttgagatggagtctcgctctgtcacccaggctagagtgcggtggtgcgatctcggctcacagcaacctctacctcccaggttcaagcgattctcctgcctcaagtctcctgagtagctgggagtacaggcatgcgccaccaggcccagctaatttttgtattttaggagcgataccatgttggtcaggctggtctcaaacacctgaccttgtgatccaccagccttggcatcccaaagtgctgggattacagacgtgagccaccacggccagccatgtctggcgttttctaacccttcaggtatggccttacatattttctcaacagcagacctttccttagtgctcccggtgaaccatcatctctcttaccacaccattagtgcctctcattgcatcaccacctaggacgttttattgtttgtaattttatttagtggtagacagtgggggcaaaagatacctaaattacttctctcaatatttccattggtttttctctgagatttggctaacatacatcttaaattcctttt

SEQ ID NO: 161473 - DNA, 193 bp, Homo sapiens
cagagttcactgaataataattcattaaactatgtgattacaacatcaagtgccataacagtgtgttgggtacaaacacaaatgtttcttggtaagtctacagtaactggggggaataaaagttcaagataaaactaaagaatagtctactgtcattcaatgtagcatgagcatcagtcagcaaattctacag

SEQ ID NO: 161474 - DNA, 148 bp, Homo sapiens
agggatggggcttaggtagctcagaggggggccataaaagatgctgagggactcagaggctggggtctaacgggactgacagaggcagtccagaggaatccctggggccttggagctgggcgagcggtcctcagagccatggctggag

SEQ ID NO: 161475 - DNA, 274 bp, Homo sapiens
cttaaggtaataggaaaagcgcagggtcctagtggctcgccagctatggccacagcatgtagaattttttgtactggggtctctatttctgctactggaggggacagtacaggccagttctcatcctccctctcctgtttatcattttcaatgggcgctgctggtgagacaaaagattctttcaatttttgagattcagaacatagcacctgctgtctggcagaataagaagaggacaatggcaggaggacagtacagaccaaaccccaagcag

SEQ ID NO: 161476 - DNA, 291 bp, Homo sapiens
tgatccgccggcgttggcctcccaaagtgttgggattacaggcatgagccactgtgcccggccactttctaagctttgtgaagagtggactgactaagcagccaggtagatgtgggttcagatctctgcttctgtcctgctgtgccaagtgctggggcagacacaggcagagagtggacagcagcatggtgcctgctgctagccatttctatgcaaaaccagatttctggtcccatcctggaggccaattctaggtacctgggtgggcctgggaacctgtgaacaaagtat

SEQ ID NO: 161477 - DNA, 350 bp, Homo sapiens
caggaatctttgccaacagaagagagtgaaaacagaagacaatgtgcaaactcattggactgggcagtacaacaaggagcctggaaaaggtgcagctgtcaagtgagctgaaagactgggaaggaggggcaatttgcctacaaacccaagggctctgagagcaaggcacggacaggcaaggggggaactcctagaacttgtttgctcaggcttccaatgattgctcactgccttcatctgggtgtggtgatgccaacagactaattgggtctcccggcagaggttaaaaacaagagaggatgagatctgtccttcagaccctggatatttttaagagatgattttcctgg

SEQ ID NO: 161478 - DNA, 197 bp, Homo sapiens
cctgcctcagcctcccaaactgctgggattacaggcatgagccaccgcacctggcctatacatcagccaatctgaactactttcaattccctcaagtccataatctcctacctctccactttcagccttcacacatgcctctctaatacaacaagctagtgcctgcctgcattctctgctcatctgtgccatacatg

SEQ ID NO: 161479 - DNA, 607 bp, Homo sapiens
ctgggggtattggagctagagaggcccactcaggccctggagaaaagggcaggggcttttctaggatgctcttggccttgcctgggggcagaggtgaggaagacagtcaacgcagggagctctgtgtcagaaatacgtctgccttcaaagaaagcagccatcctggaggagaaggcacctgggagggccttagggataggggaaagagagaaaggcactggccaaccaacaccattggccagccagacagccgggctgggtgacacctggagatagcccccagccatgcacagggaccagtgggcgtgggagaaccagtatctgtttagttacaagcagaacatccaacacactcgccttgccacgctgatactgtcatcccccagaaggcggaaaaaaccattgctgtgaagcattcgagccagtaatgaccaacagagaccaataggctggccaagtggaaatagaaactcagggggagtgcccatgtcccctaggtaccccggaaggtggtcctgggtgatggtcacgtgcacagactctggtcaaatggagctaagggtcgatgccaactccacccttaacaccctcggtgaccccaggcaag

SEQ ID NO: 161480 - DNA, 177 bp, Homo sapiens
taaatgagtcaacacttgggttattttagccagtttgaatttggctcatcaaaatatttaaactggtataccaaactacttcagtatatttaaactattgccgttgttgtgtgcctcttttctttctcgggacagatatcagggttaccgtgtattttatctaagagctggtttatg

SEQ ID NO: 161481 - DNA, 552 bp, Homo sapiens
tcaccttcccctagcattgccacagctgctagtgggctgacctatgtccttaagcgaatgccactgccttggcacaagcaaagagttaggtgcatgtggtggacaggtggcctgcgctctgtttgccagccctcctgctgggatctagacccagatgtaaacagtagagggagtgccccttccacttctgccttccagaggcccagtctagagtggacgaggattgtgatttatgactttgattaccctgcattgaggaattatctagggctgtaggattccaaaggatcctgagcaggaacaggattctttcttccagaccagagctcccagggtcaggtctgttctgttactgttgaatggggcctggagcaagtagatttgtcatgtgctttctcacaggaatagataaagtgggccaaatggtgagaaaagcacagcagagctggctgagttatgatgtgggtgggtttgtcccctaggatgatgtgattttttcattcttagaaggttttcacctgcatagtatagaaccaagtccccagctggaga

SEQ ID NO: 161482 - DNA, 347 bp, Homo sapiens
tgaccactccaggttggtgattggtgattaaggaacagacagcattttcctccctccctctaccatttctctttctcgtttttgttttgttttgttttgttgattaaaggtagaacagcaatggtatctccacataggaaacaccaagcctttgtgaccacatgagccgcagcgtcttcatcatggatgaggaggggaaccagttctggaattctggctcagggtagatgcatcttaacggaagaagaattagtcaattctgtttccgtggtttactcttcctgtctcctgcagatgaattcattagtttaattaatgagagccctttgccttcctctgcagtgttg

SEQ ID NO: 161483 - DNA, 396 bp, Homo sapiens
acccgtgtcacctcctgcctggtctgtatagggtcaacactaagggggaatgtatgtgtctccttggaaaagatagccctagaggccgcctatgattttatgaaatccaagttttgtaaaggctttgtgataaagctagctacagatagtatgctttactacaatatgggcattctcttagggtctaggatgcctttgtgactaaatgaaagagctgaattctgtagtcaataagagtcaacaccttagtaagatacttaatccctcagaaaggactgatgctgaaagtccctcagagaaaaatagagaattaaagcatgaaccaagatacccgccttgtttcacccctttgtttcacatgactaggatatgggtgctcattggaaccatcggttg

SEQ ID NO: 161484 - DNA, 486 bp, Homo sapiens
tgtgtgtgtgtgtgtaccataaattcttaaaaagatagttgctttcttcatggctaacttgaatactgtatggtataatgagggtggtatatagagtgtacaggatgatttaggtgtgatctaggcttatttttatcaactcacatatttatatatgttgataaaactagacaatctggctcatttattcagcatatctttcctgagtattgggtctgggttaccctctgacacaaaacagactcggtctttgaccctacagaactgccagggtcttattcaacaattcaagcatatattgagaaatatatgattaggttataatatttcataaaacaaagttcaggctggattttattacagtgacatcgaggtgtttatcgatgccacaaaatacagtatttttccatcacttttagttgtaatgtacactatgtacagaaagataatactacctattttaaactaaatatagatgaacaaaca

SEQ ID NO: 161485 - DNA, 197 bp, Homo sapiens
gaaaggaatgcaaatgctgagtcatcactcttcattggaaaggaaggaaaccagaattaagtggttggaagatggaattcattcattagattgagcttcaggtaaaaagcaacagcaagacaggagaaaaagcgttcagaagacacacatcaaatagcggatgaagacataattttagccaactctgaagctttcga

SEQ ID NO: 161486 - DNA, 496 bp, Homo sapiens
ctgtgtgacattgggaaagtctccatcctttctgagcctcagtctccaccctggggaagtggaaatatcaatctctgtgacacagaagcaaatgagcgaatgtgcacaaagtaccttgcacaagagagacgctcaaacacttgcctccaggtttcaccgagaactacagagtaagatagatttgttcccagtggaggaagcctgggaataatttgcccctagactatgaattcctggggctcaagatcgagcacagggccaggcacacagaagggaccctggaaatgtggcaggaggccagagatagacaggcccttagagctcatacccatgccctctgacctcaagaagaaagaaacctgctcaaaatctcacaaagagcttgttccaaccctgaatcgagtctgaggactccttcctgagtccagcactttttctgcaagaagtatatgcctccaaagctgatgggcgcaaatcttgaaccccgtcacataaa

SEQ ID NO: 161487 - DNA, 325 bp, Homo sapiens
aataagtagtacgttatgtaaccactattatgtctttatgtaaccatatcattttcaaaaagggtaataaggacatatttataataatgatattaacactgatatactttgctgaaataaacagtaatgagaaattttaccttattcaaacctactgcaagactaaagttatttaagcagccacttaggcagtcccacctttttaatggatggaaggaaaattcatttcacattatcagtttcccccaaattaatctctaacttcacagagttctaaaaatgttgtgtcttagtcaggagtgacagtactcaaataaggatactc

SEQ ID NO: 161488 - DNA, 606 bp, Homo sapiens
tgggttctagtgtttcaatctattgaaatgtctactttttccttattggcaaaatgaggataatttgcctcccacagaagggttcatgtagttattataatcatgtcagttaatcaacatatttgataaaactatctcctgttattggaagtgtttcataagattttacttctaaataatctccttagacctaggaataatttttttgcatacacttaacctggtatgtcaccaatgccaaattagtggtaagttagtgaagggttaatacatgaaattaatgttcagtggtttcacttgtccccttcccggcattgacgtcagtgccctttgtgatgaggacacgtctaatggctacactttgctgaggatattctcccgataaggactgtgagtatgctagggagattgttataagagaaatcttattcccaactatttctgaacattctctaatagtttaatggaagtacattcaaagactaagttggcagataaagaatggtactattcattcatctttgttctttgaaagaaaggaaatacagaatcctaaaatatttacctacaaatgctttaaaggaacacagtatagaagaaagaagc

SEQ ID NO: 161489 - DNA, 641 bp, Homo sapiens
agataggaagataacttgcaaataatgtttaaaatgcatatgttttaatgttaaatatttagagcaggtgtaaaccaatgctactttaaactccaatattttattaaaataaaccattcccatacattgagggagttggcataggtttttttgtgacacaatgttgaagatttattagaaaggacaaacatagctgcatggtagacaagaatttacagcttctcataatgaaaattttaaaaaatgggattttagactaagtctacaactcaggcacagctaaaatgataaattttagttattttgaaatatttgagctatatttaatattatttccaatagcttcatttatacttaaataattgacagagtcataaacaatagtttggcagaagcttttggtttgcttatacttaatgacaatgtaataattatagccaatggtaatgcatgtgaaaacttaacaaatacaattctgaagttgacataagaacacatgttgttcagttttgcagtaactatcatctttaaaagtaaatattgtgattgtttaggaatatagtatttaacagactagaaaaatataagtaaaattttcaagtgcatgaaatacatactaattctttaagagactaatgaag

SEQ ID NO: 161490 - DNA, 341 bp, Homo sapiens
  misc_feature (149)..(149): n is a, c, g, or t
  misc_feature (160)..(160): n is a, c, g, or t
  misc_feature (168)..(168): n is a, c, g, or t
  misc_feature (226)..(227): n is a, c, g, or t
  misc_feature (232)..(232): n is a, c, g, or t
  misc_feature (257)..(257): n is a, c, g, or t
  misc_feature (301)..(301): n is a, c, g, or t
tgcaccttaagttttgcagcacagccaaaccatgaatataaagcctttggtgagaacaaagaagccacacactctttatagtaacttcgggagtctcctactcctgggaacactaagaagtgattaaataggctaatttaaatatatcngaactttgtgnaaatggtnactcatgttctttttgttatgatatacctgtggttaatttttctatcatgctgcagtnnagcangatgtaaatactgagtaatatcacnacatgtttgaatcctaaaagaatttatgtgacatgagccagtanccacagaaaaaacagcacaggtcataggtggttcttagaa

SEQ ID NO: 161491 - DNA, 204 bp, Homo sapiens
tcaaaataagttaagctatgctgctatgataaacacagcagcttaaagaaaaggtttgtttctcacttgcactacacagacattgcaggctgtctgaggtcattgttctacatcatcctaactccaggacctaagctaacagagcatttccagttgccatggcagaaggaaaatggggcaaaggcaaataattcaatagctctc

SEQ ID NO: 161492 - DNA, 437 bp, Homo sapiens
attgacctctgctttctccactcggcccacactgaccccgcaaggagagctggcagatcaaaacgcgaatatacagatgaggagactgaggtagacggaggcagagcccaggcgccagagctgtggcacgggacaaggacaagcagacaccctggccggcttttctggcacctctgtaagtagagcctggatcagggaggtgccacatgttggtggttcattggtagattaggcagagggagctgtgagcctggagaagctcaaccatacgtccctcccctccccagaggaccctggtccagcccagcccaacacagccagcggcctcatattggggctgtgatctgagcacctcccaaagcctggggctgtgatcttagctccactgcatccaggggtgctgagggaggccaggggcagcagctgactctctgggg

SEQ ID NO: 161493 - DNA, 478 bp, Homo sapiens
gactgaattcaaatccaaccaaacctctagatctaaccagcagattaatgtaactaacagaagaacatgttggtctagaataagagaatgcaatcaaccaagttcagaaaatgtgaagttctccaaaataaccaacctgcttctttgaaaaagaaaacggtatgatcagagacagggagaagagggcctggagccatgttgtttggggaaagagactagaagcatatgtcaagcaatgccaatacgcagaacatgctcaggtcttaattcaaaattaccacctaaaaaaggcatttttgagatagtccaggaaaatgtaacatggactgcatgttagattaaggaatcactgttaatcttatagacaggataatgatattgtagggtttttttaaaatccttatcattaagaggtaaaataccttaaaatgttttaaagacagagttatgctttaaaataatccaatcagccgggcgc

SEQ ID NO: 161494 - DNA, 152 bp, Homo sapiens
aacccagagaaaagaagactggaacaaacaatgaagcagtgcagcgatgacctgtttacctgacatctgcacagtagagaagggaagcacatgatccgaaatcaaagcggactggggtttttagataatggacattacacctgtatggttag

SEQ ID NO: 161495 - DNA, 413 bp, Homo sapiens
taccctaatgatcactccccgagccccattcacttatatgcatttagtaaatgcacttgcttttagcaagtttctggatggccccttaacacctcactcctgtgagcatttgggtggttgagcgtgaactgcagctatgaaagtgcattcaggctgggcatggtggctcatgcctgtgattccagcactttgggaggccaaggtgggcggattacttgaggtcaggagtttgagaccagcctggccaacatggtcaatcccatctctactaaaaatacaaaaattagccagatgtggtggtgtgcacctgtaatcccagctactcgggaggctgaggcgggagaatcgcttgaacctgggaggcggaggttgcagtgagtgcagattgcgccattgcactccagcctgggtga

SEQ ID NO: 161496 - DNA, 410 bp, Homo sapiens
gccggggctcatgccaactgaaaattgggacccggcccagtctgccggtttagttgctgagatgatgtggggagcgggacagagcacgtggatgcagagaggcagagctgccagatgggcatgtccccaagacaacagcttccttgggatcagagcgcccgggacagcacaccagccaagggaagcgtgtcagctccaaaagcgggcctcgggcgttttgggcgactggctgccaggcttaggtcaggagctgggtacatgcacagacaagggacgaaggaacagcagccaggaaggggtccaaatccatacaggaatgtactttgtgagaaaggtgggatttcacagctgtaagcaaaagacaggtgctctcgacaggtggggctgagaagaaaactgagccaagatct

SEQ ID NO: 161497 - DNA, 522 bp, Homo sapiens
tacaggcatgtgccactatgtctagctgcccccactttaacatgagaggagaaggaggccaagcagtgaatgtcagaatcaggactggcccagtcagtgactccggggcctgtaccctcacatctggcatagcttgctggggataccctacagtgggagttctctatagcaggctgcagcctgttactaagccatgaaatcatttagtacattatgaacagtattgaaataataagatagaaaacaggattttgtaaacagtaagtgtaagtattatatcaggaaagacatgttcctttcatacacacacaagtgctggagcacaatgtaaaaaaaatctatgggcaaaaaggtatggaaaaccctttggttctagtgcacacacatatacaggaagcaagcatttatggcaaattacattattcagtcataactaatttgttcccagggaaggtgattgttaatgtggcggttttacatgtttcagaaacaaaaattgtaaatgctatgtgatcatttgcc

SEQ ID NO: 161498 - DNA, 242 bp, Homo sapiens
attacatgcaaaaggtagcatacgatatagacaatatgttctgtactgtgccttttggacttaacaatacatctgggagatcctgctgtatcagtacataaggagcagctgggcaccgtggcttggcacctgtaatctcagctacttgggaggctgaggtgggaggatcgcttgagcccaggagtttgaggctactatgtaggacatggactgagatcgtgtcctttaaaaagaaagaaaca

SEQ ID NO: 161499 - DNA, 533 bp, Homo sapiens
tgataatactatttgcactttgactgaatcttaaattgccaatttatattatttcttgatatttccttctgattatagcagactagcctatgtagaccaactacctcactgagaacaaccaaacaagctagacaaataagaatcagttctgaagatatagtataaatattctcatagagaatgcaaatttacagaagtaagacatttggcaccattttccccctcaaggtctttgcagatgtataagccgaatctagagcttaagaagctaaactgaacttctagccattttcagtgctgcagggacaaaaactggagctcagaacccactaaggaggagaggccctggtaaaaatttaggctttcagaaggacctctaaaggaccacttcagaggagtaaaggtaaaggtaaactagaagtagaccagtcctcgtaagatgaatttggctataaactatgaatataacataaaagttatatatccacgttggattgattcattccaggaaagtaaggtctgtttcatgtttg

SEQ ID NO: 161500 - DNA, 338 bp, Homo sapiens
  misc_feature (267)..(267): n is a, c, g, or t
cctgagtagctgggactacaggtgcctgccaccacgcctaatacggctaatttttgtatttttagtagagacggggtttctccatgttggccaggctggtctcgaactcctgacctcatgatctgcccgcttcagtctcccaaagtgctggcattacaggcgtgagccaccgcgcccggcccgttgctgacatttctaaacagcgaaacaaatgcagaacaaccacctcagactggttaccgtgtgagagggttaagggctcccggngggttaagggctcccggagggttaagggctcccggagggttaagggctcccggagggttaagggctcccgg

SEQ ID NO: 161501 - DNA, 170 bp, Homo sapiens
gggtgtgtgcaatatttgctgacgattctttgggaaaaggttaagcaattaactttcaaatacaagtcttggggacacaagctttcttcttggtaactctgccatgtgaatgtcaccgcagagaggtcctgcctggacagctggctctgtgtggctccttcagcttgggg

SEQ ID NO: 161502 - DNA, 717 bp, Homo sapiens
caaagtccattcagtttacacaaaaaaagggactgtcagaaagcatttgcataagtgccaacctgagatctaaatccggaggatggacccctactggagtgacctagggcagagcactaaccctgtgatgattggatcttgttttcaagggaccaacagaaatacatggaaggcacagagtacaaggagaaacatacaagtgtaaaatgtgctggcaaaaaaatccaggcattgagcttctgaaatgaaatggggtttctctaagcacaaatataaatgttcttagcttttggtgtaattttattccaaacataaagccaacatctgttctctctttctctttccttctgccccttctccctgcctgccacctccaagactcatggaaaatccatttaccattgagtgaaagaagcactgataattgaagaactagccaagaaggatgaaataaaatgctttagaattgagtgtaggtttctggctgggcacggtggctccaaaactttcaaagaacattgctttcatcaccaaatcttcaaatcatgtgccagaattgtaaaaaggcttaaaggctggtttcacttcctgtgtggaggcagcctgccgttaattggaccaagtgaaaaaactggcctccaggcacacacaacacttgggaagtccatgaatatttatcaccgcactgagaattccttagcggccagtgacgaaaca

SEQ ID NO: 161503 - DNA, 145 bp, Homo sapiens
actctgtctccaaaaataaataaataaataaataaataaacaaataaataaaaattaaaaagaaaagttagtcggtgtggtggtgcatgtctgtagacctaactacttggtaagctaaaatgggaggattgcttgggtccaggag

SEQ ID NO: 161504 - DNA, 171 bp, Homo sapiens
cagagtgagaccctgtctcaaaaaaaacaaacaaacaaaaaacaaacccccaaaaccaaagtacacatattaaagtgtacaattcaatcaaaattaaaaaataaaaacaatttcaaggaagagtgacctcttcaggtttcaatcaagggaacagagggagactttttttgt

SEQ ID NO: 161505 - DNA, 290 bp, Homo sapiens
caaaataaaactttttttttattataaataacttaacttcaggtattcctttatagcaatgcacaatggattaatacatcctctctccacatccttcccccttcctccacggaagaggagtattgtcactgactggtcaagttcaaggatgctgacttgggccatatattcaaaaactagggtgttagaagaaagagcatcacccttctatcttttctctccatgtgaccaggatgataataaggctggatcactcccttcagattcttccttcaaggaggctagagaag

SEQ ID NO: 161506 - DNA, 136 bp, Homo sapiens
gtgagctgagagaggtacattatagaaaaaatatgacagaaggtatttggtacaagattagaaacgaaagctcattattaaaattatattcttcaaatgagggtagtgccttccttatcctgtttctctttcctat

SEQ ID NO: 161507 - DNA, 283 bp, Homo sapiens
gaggcagactcagtgcacatgggccgttttccacacctctatgatttcatccccaacgaatcagcagcacctactctctagccccctgcccactaaattatccataaaaaacctagcatctgagttcttgaggagactgatttgagtaataaactctgtcttccatgcagctaacctaggtttaaactctttctttaccacaatatcatggtctcagtgtgttggttttgtctgtgcagtgggcaggaagaactgaaagggcaactacagttttacccccaaa

SEQ ID NO: 161508 - DNA, 382 bp, Homo sapiens
cgacctgagtagctcttgccagtaggccgggactagctgtctcggggccttccatccgcttggccccacaggtccaagggtggggaaggacttctccagctgcctgcatctggccgaggaagataccaaaaaaggcgagggtaggggaaggtgcctgcagcgactgcttggtgtgtgttaacctctcccactggagcctccagaccaagcctcctactgaggggggcccagagaaggatcagagcagcccctcccagactcaggcagccccccagggccccagcactgcttccagggcaattagcgacatctgctttcccacctactttcgagcagagaaaaaaagtctgcaaatcaaggagtttatttggtgcaacaaaga

SEQ ID NO: 161509 - DNA, 384 bp, Homo sapiens
actcccaggcccatcggggctggcagagtgggctgttttgtgtggggctgaggtgaggtgtgtgcaggagatgcaatggcttggccgcctgcatgctgtgtcctcgggatgctccctaacctcggtttcttcctctgaagaatggggctgaaaccagctcttaccactcagaagtgcctagtgctctctcccagcagagccaaccctcactaatgggaaccccgggctcatctgtgagcagggccaccttactgtgcaagcggctggtgaccctcccctcctctgcaggccgctgtcccgaggttagtccagcagaaactctacctcttcctgcggcattgctttggccactggcccttggacgcattgttcagagctaggagt

SEQ ID NO: 161510 - DNA, 303 bp, Homo sapiens
  misc_feature (2)..(2): n is a, c, g, or t
antgtccagaataaatatctggtaaagtacaaggacatagaatgtacttattcccttatatctaacatccacataggatagggcttaacaaagagttatcagcaaaaagcaagaaggctttgaaggaagtcagtctttaaaagaaactattatttctaacatttattatttattatttaacaagaagggaaactttgaagaggaactttttactttccacaatttccccctcttgattttatagtttttcctcttcaaactttcttaatatgtcttggcttagttgttctgcctgagtctctt

SEQ ID NO: 161511 - DNA, 472 bp, Homo sapiens
gacactcttggttggaatgcaaataacgttttggttttcctacattatgaacaggttttatgtggagaagtgagtttgacaggttttcatcctatcctgtcttgtgtgttaactgttggttaatccctttgtgatactggttactgccatgtttttttcttggccctcttgtattttttttgtacctcaaaagtttgagtatgaacttgacattttctatcttgtgtagttttaatcagacttggtatagattgatggcagtagaaaacttgtgttttggatgctgggtaataggcaatatttgtgatttttagaataatttgtttcgtggcacagaaattgtattttattgctctgagctggtgttatgtattttaacaattctagctagttggctagccggtggttattttgcagtttttgatcattctcatcactgtcaccttcatctaccagtcaaccaagagtgtcg

SEQ ID NO: 161512 - DNA, 171 bp, Homo sapiens
agactgaggattggacagggtaagggacaaagcaaagttcacctgtaaaactgccaagaaaagccaggactaaaacatctgtcctgaccccagggaagggtggactgcatggggtgttagggtgagcactggatttcatgtcagaggacttcatcttcatgagtatgcaga

SEQ ID NO: 161513 - DNA, 557 bp, Homo sapiens
cctgggaacaggcctgtcttgtgcagaagcctgagggactgggagccaatctcatcactccctcacttgattatggaaagatgaaaacagagagtggagaaatgaagggtaagaccagggaagagattctctctggggtcccaaaacatggccctggctatggacatacttgggggtggggggatccacttgcctgctggcctcttttgggcagttggtattggttgcccgggtatccccggggcagtagctgcagcagtggcctgatgggtgtgcaagcagctagctggtgtgtccagcacggtcttggcacacctggttgttttggaaaggtcttttcttgaacaggaacttgcatactcaaaaacaacagcaaaacacaaggccacactcaccccccaagggtaagtccgtggctcctcctgcacacccaggaaagatcccgtggaaacacagcaccggaggatatgggataagagacaacagagaggagtggtgcttcctgaatttaggaaacatagctgctactttgggccctctagatacttgaaagaaaa

SEQ ID NO: 161514 - DNA, 152 bp, Homo sapiens
tgtcttagaggaaagatcttgctcatttctgaagttgtgctttggaagtgtctgagctgcagttgttcttccttcccaggtcggtgtagactctgctcttcctaagccagggcgctgcagccatattcagtctcttgttctttggctcccgt

SEQ ID NO: 161515 - DNA, 525 bp, Homo sapiens
cccattctctccttaattcctgaagacagtattctaccttgccctctgttcctactgatattgaccaaaaccaagcctgcactcatacttctaagtaattacctacatcctgatgtactttttggtaactatactagtgtattacatagtggttaagagcacagactcaaatcagactgcctcgtttaaatatcagctccagcactattcacacaatagaggtgtaaattttggtaggttactaacttttatacctcagttcctcatctataaaacaagaataaaagtagtatctaactcataaggttgcaaagagatttaaaataatttatatttaaaacatttatgtgcctagcacataattaacaccataaaaagattagcaataattattatattattgtcatctgtcctaaaatttgcccctacttgcacttgggcaaccccacacacacatggtctcatttccatttcctcgtcactttttaatttcactggattgtctcattttcctttgagtgtatt

SEQ ID NO: 161516 - DNA, 112 bp, Homo sapiens
agtaaaagcaaattaagagatccactatcagcatgattggcagccaatactggagtaatgactaatatggatttatatccttaggacatttcatgtacatccactataagca

SEQ ID NO: 161517 - DNA, 369 bp, Homo sapiens
cttgagcccagggagttggagactgcagtgagccgtgatcagaccactgcactccagcctgggtgacagagtgagactctgtctcaaaaaaaaaaaaaaaaagtgtgagaagtccaggtgtacatcctccaggtaaggaaactggaagtgagaaaaccagagaatctccttagtgttaggggttctgcaaagtacccacaaagcatttcaagagaaagtgcccttaaaacatctcagagcccagagagtggcaatgcacaatatcaatcaaagaagacattccctgcccacttgccacctcctttctcccaccctcgtccctacccattttgactctggaagtattagcaatggtattagcaagtgggt

SEQ ID NO: 161518 - DNA, 264 bp, Homo sapiens
cactgcaagcctgcaccccagcacaggccccatgctgcaggcaggaggcgaggagggccctgcactcgggtcagaaggcgccgccccttggtaactttgcacccaagacacaaggtccctcaggccataaacatctcaactatgaaacagaaaagcaagcctcagctctcagcgaggatgccgggaagaccaagacggccgagaaggagtctgaaacgccacaggtcactgcccagatgagaactggctcggtactactgtttg

SEQ ID NO: 161519 - DNA, 318 bp, Homo sapiens
atggatgaatgcatggaggaaagaatgaatgaatgaatgaatgaatgaatgaatgaatgcatgggtgaatggatggatgggtgcatggatgcatggaggaatggatggatggatggatgcatgcatggagaaatggatggatgggtgcatggaggaatggatggagggatgcacggaagaatgggcagatggatggatggatggatggaagaatcaatggagggagtgatggatagatggattgatggatggatggatggatggatggatggacgagtggatggatgggtaaatggatggatggatgagtggatggat

SEQ ID NO: 161520 - DNA, 288 bp, Homo sapiens
caaactcccgggctcaagtgattgcccaccttagcctccctagtagccaggaatccaggcgcacaccaccacgcctggctctgattgacagacgcacaccaccacacctggctctgattgacaggcacacaccaccacacctggctctgattgacaggcatacaccaccacacctggctctgattgacaggcacacaccaccacgcctggctctgattgacaggcgcacaccaccacgcctggctctgattgacaggcacacaccaccacacctggctctgattgaca

SEQ ID NO: 161521 - DNA, 325 bp, Homo sapiens
taaatagcaaatatgacaggctattgtagagcttgacttcagacaccagacagccagaggcactctgtagatacctggcagtagatgagagacacctgtgaaactgagggcaggtcaggagctagtgaattttagaagtaacatgggattgaaaggactatttggtgggaactttggaaagggtcaaaggttctgtgtaagcaaattaggacgatggtaactacagttttaaattattgttaatgtaactttatttgtaactgctagttgtgcaaattcagattgcatcatcatttcaccccaattttccttacttttgtattta

SEQ ID NO: 161522 - DNA, 279 bp, Homo sapiens
gagttaagaatatatgaaataaaaactgacaccccaaaggaattaaagattatagaacccaatttacattacacataatgtctattattttcgcccaatgttttgctgtaatttttggctaagtactaaattgggcagctctggaaaatgctgtgattattattgtaaaaattaatgatgccttataaactaaaacactattaaggaataggtgtgctatctatttatgagtggagaaattatatataaataagaaacactagcttgattcaatattat

SEQ ID NO: 161523 - DNA, 352 bp, Homo sapiens
  misc_feature (25)..(25): n is a, c, g, or t
ggcctagctccctctgcatcacagnatgattacaagactacatttccacaaattcccattaggaggcacttcggttgacctatgagggctgtgggggatttcactggccctgtcttgtctgctcatttacctgcttatgtcttgcccacacttttaggagaacttaagagactttcctaaggaagtcaatggaaaagaaagagagtttcagattacctgaggagagaagatgatcaaaatggaatggaaaggatcaaataaagaagagagatatttaatctatatatttaattatatatacttatttatgatattgttcattgttttattttaccacttcactattctgcaa

SEQ ID NO: 161524 - DNA, 386 bp, Homo sapiens
acagagctggccctgggtggggaagcgctttggtgcagcaaaggggggcggcatgtgtgggttggctgtagtgcagggtgatgcagactccgcttggccgttccctgccccgctctagccttttgggtgcttgtcagatggaacctgccacacctgtgggagttgccactggtgggtgggactcatggtgcagagaggggacaagcaagcgtcagcagaggccgctggggcagggcctccccagtgcctgagggattccttttccatgcactagacctggcctagtgtccagtgctgctgctcagcctgggggcagctctgtaccaagccttccaccctctcttggccgaggaccctctccccatgcttgctgactggagacccac

SEQ ID NO: 161525 - DNA, 599 bp, Homo sapiens
agcctatcaaatactggggcctgagcacctctcctgcctcgtctccctccactacaccctgagactctgctccacactgacttcccacagtctgcgacgacacatgttccctggcatccaggcctttgcatatgccgttgtttctgtctagaacacctttcctttgctctctgccttccctaactcctactcattcttcaggtgtcagctctaatttcacctcctctaggaagcccttcctgatccaccaggctcccacacacccctgtactcccccatcccactctgggtggtcactgtctggtgacaggtatgtctcctctactggactgtgagcccccaggagggcagggccaggggctgtcttgatcactactgtgtcccaacaccacctggcacatggccagggacagataagatattcaatgcatatttgttaaatgaatgaatgaatgagcaattacttaaaacccttctattgttccctgtggtagcctgtctccaaaatggcccccaataatctctgctccctggtattcatgcccttaaagaatagggctggctgggtgcagcagctcatgcctgtaatcccagcattt

SEQ ID NO: 161526 - DNA, 244 bp, Homo sapiens
actctccaagcaagaggaagcagagaggctggggagcagaaaagctataaatcccaatacccattatctcctgaggacagacagtctccggtgcaggcagatgcttcaggagttccccataatctgtaggatggaagctgagtgccttaatatggcagaggccctctggatgtggcttctgccttctctgttgatcgctttcttctcactcgcctgtcaccgagccttgcttgttccgctggta

SEQ ID NO: 161527 - DNA, 373 bp, Homo sapiens
ttgctggctgtggaggtgcggccgggaagacaggagctccttgaagtgacagaaacctggctccagcccacagcctcaggaacagctggtcactgcccgggtgggcggacacgctgtcctggcacaggggcctggcggggcagtggccagagcggggtccggctgtctgtgttccctggctggcatgttgggaggaaaagacttggctgacgggccggaggcccctgcggccccaggcccctgaaaggaaggttcagaaaggcccctgtgttccggcctggtccagagctggctttttccagaccagggcctcaggagtctttggaaagaacaccgagtacctgacgcccactgctgactcgctgtgtgacct

SEQ ID NO: 161528 - DNA, 297 bp, Homo sapiens
gctttactgggttgtatttcagtctgatgcgaggagtaaaaagggagcctttctgttgctgattttattggaaacaaagaaaattagaagataatgaagcaacatctttaaagtactggaagataaacattgtcagctgggaattgtagactcagagaaactatctttcaagatgtaggtgaaataaagattttgttcaggcacttagaacctgaaagaaatcatcaccagtaaaacaacactataaaaaatgttaaagaaaatgtttcaggcagaagtaaaataatatcaaaagga

SEQ ID NO: 161529 - DNA, 635 bp, Homo sapiens
tctcctctcccatcctttctcagtagatgacttcgattcccattgcactaaaagactagaagctatcggaggaaagtttctgctgagctactccttgccacatttcagctccctgtgtctgtgcctgtggctgctccataccccctcgctatggaagagctaccccagatcttacctcgggtcacctctcgacctgcagaacggacccacccacgtgcttcctcagggtcaaaaccccaataattcttccctcttgttctgaatattcaaaccttccctgttgaccacatgatccccatcaccccatggtgaggccagcattccctccatctttcagaggaatatgcttaccttcagctacagacttaaaaggtccttgtcatttcctcataagcacacatgataagtgagcagagagaacctcctgcctatttctttcttctttccggagacagctcagctgaatgcccggtccattccctgaaccacagaggttgaacgcagaaaccctggtctagacttccctgcaatgtccagtctgctgcctaagggctgtttggcttttggcaattcaccaaaattctctgcatcttagcttcctgtggaaagtggggatctctaagcgactgagggtg

SEQ ID NO: 161530 - DNA, 555 bp, Homo sapiens
gctccatcacatcataaaaggacttgttagatatgcaaattttcagaccccatctcagacctactgagtcagaaatacaagtaatgggtgtcctgcaagctgtgttcacaagacctccaggcattttgatgcacccaaagttatagaacactgtctcgggaaatacttcatatttcatttctttcattgaaaagacttaagttctcaaggacaatgatataagaaatatcatgatgtattattcagttaggtacctttgtattcatggataaaaaaaatctgtgtatttgttactgatttttcttttctttttttttttttttttgagactgagtttcgctctcgttgcccaggctggagtgcaatggcgcgatcttggctcactgcaacctctgcctcctgggttcaagcgattctcctgcctcagcctcccgagtactgggactacaggcacgtgccaccacatccggctaatttttgtactttcagtagagacagggtttcaccatgctggccaggctggtctctaacccctgacctcaggtgatctgccca

SEQ ID NO: 161531 - DNA, 518 bp, Homo sapiens
aatgtgcgcaggcacttaagtaaaatattccaagcacagttgaagtcccttccccattttcttccctccctagatacaatcattatcttggtttggagactttccatgcatgcttttgtatcttcggtatacttgggtatacaccttgtagaaaaccttatataacatatgcatcatctacaacttgttttttggatcaacattgcttttgaggtttatccacattgatacatgttgctacagttcattaactttaattgatttaaagcatttccattgtatgattagaacaacgtatcctttctcctgttgatgaacatgtgggtcatttctgattttttgctattacaaacaattcttcagtgagcatccttgtgtgtggtttctcacttatgtgtggagcagctttctaagatgcataaataatgaggagaggagttgctgggttgtagagtacgtgcatcctaccttcactaagagttcacagtttttgccaattgggggagtgaactgatatg

SEQ ID NO: 161532 - DNA, 136 bp, Homo sapiens
agtttagagggggttgtggagcccagggacagtcattgagtcagaaccaacaaatgttcgagcaaccctcatgtcccaggcctttttaaagatattatttcatgaaattcaacaactgtgtgaaatagatgttgca

SEQ ID NO: 161533 - DNA, 137 bp, Homo sapiens
gtgttgtgattacattttacctctgcatttcagtcaacttccctgagactttgcccctctacccattatccctgcagacctagttatgttctctgtctccctgatctggcccctgcctgcctgaccatctgctacat

SEQ ID NO: 161534 - DNA, 635 bp, Homo sapiens
tgtatttgtagggatggagtttcgccatgttgtccaggctggtctcaaactcctgagttcaagcgagatgcctgcctcagtctcccaaagtgctgggattaaaggtgtgcgccactgtgcctggctactttttttttttatttaattttattttgaaatatgtaaaaatttacataattctatactatgaaaatctcacttctgtcctttcctcttccatcttttaccatcttctgccttgagataaccatttctattgctttttgttttttccatccagtgttttcctttctttaaacttagtaagcattgttttataatctgtatttgataattccaatgtctgaagtttttgaatgtctgtttctgttgcctgcttttgtgtgtgtgtgtgtgtgtgcttcttcctcatactgcttagtttctttgtgtgcctggttatctttgacgatgtgctggatacttggaatattattttatagaaataatttgaacactgaaatgatatatttctgcacagaggacttttctttgcttctcactggtacccagtggtgttctttgtctggtactaccctaatccaagttctgtgtctgagattccctgaactataggaggttagactgcaagcttg

SEQ ID NO: 161535 - DNA, 193 bp, Homo sapiens
atctcctgggttcatgccattctcttgcctcagcctcctgagtagctgggactacaggtgcctgccaccacacccagctaattttttgtatttttaacagagacgtttctctaacacataaatttatgtttgtttttaatctacctctagggttagataaagagaaaactagttgacttacttccagcaagag

SEQ ID NO: 161536 - DNA, 323 bp, Homo sapiens
ctgagtcctcgttttcttggtaaaaacggggttagtaaaactccctgccctgcttccttacagagcttttgtgaggctcagggaagattatgtgtgggaaagccctctgtgggtccaaagccctggacacgagaattctgattttcctttatttaattgcaaaaacagtatcagtggaacatggaagataatttaaaagaagacgaaaaaaacctcttcatacaattcacccaagtatggaaatcctaccctacccaagtatacaccagctgaatgggtttggatgtattttcagataaattcctcacttggcgaactcttgc

SEQ ID NO: 161537 - DNA, 206 bp, Homo sapiens
taaaagagtggattctaggtgctcttgccacaaaaaagaagtgaccacgtgagatgatggatatattaattttcttgactctagtaaccattttaccacgcatatgtataccaaaacatcacgttgcacaccttaaatacatataatttttaaagcggagaaagtgttaagcctaaggtcaacaatggttctataattccgggcca

SEQ ID NO: 161538 - DNA, 325 bp, Homo sapiens
gggtggcagaggggccctaggcccccagggcttccacccccacggtcacttggggcgatggccatggaggacacacacgctcagacacgcgggctgtccctagtgctgcaattccctgtttcaggcagcacagtgagggcacgtgcatgtgtgcatgtgtgccaaggctgggtgatcaggcctggggggctcatccaaaggcagggagcgcgactgtcctgcccttggacgcttgcctgcaagtgtgaggtctaaggcagagggtgggtgggtcacagtcccctgctggtgggatggcgatgtgcaaggacagagggatacaggt

SEQ ID NO: 161539 - DNA, 577 bp, Homo sapiens
agcgacagcaggaaagaagaggcccttcgtgtacacccagggccaggctggtcctaaaccggggccttcttcccttgcttcgacacgcttgctgtaaatacaagtatccagctcttatggaggtaaggagactaaggttaggtgcacctgcccttgggatgaagaaatgatttcagatctatcaatcaggtcacgtttcaggggtaaattattatatccattcaggggtacttctgaaaaatggcttactcttaaattctggcacctacggaagtggtatgtagccttcctctaaatcccatcagttgagcacagatttagtttctggaaaccttggtgtcctccaagatagactccaggccattatcatcacacacaggtggccggtcatgctcttattcaaactattcaaaaggaaactctctccaccaatcaacatagtggcctggtgggtgacatcctcaggagcacacctggcctcccgtggggatggcagcccctggtggggcctgagaccagcccagtcaatggagtgacttggctcaaactggtatggcagagtgactaaaatctagag

SEQ ID NO: 161540 - DNA, 317 bp, Homo sapiens
tagaggatctccggatacaccagcgcatgtcttcagggtataacaagagtcacaggtgaaattatgttagaggcagggtctgagctgcttggttgctttccctcattcacctaacttcatatggcagggctaagggaatccaacatcattttacccattcttgggatcttgaaaggtctttctacagtttaacatcgttattcaattaatgaaagatttcgatgacactgtagacttggaaaattcactgaacaattctattccagttatttctgaaaatgttacataaaatcaacttctggtcgctgtgtattccg

SEQ ID NO: 161541 - DNA, 372 bp, Homo sapiens
attagccaggcgtggtggctcacacctgtaatcccagctactcgggaggtttaggcacgggaatcgcttgaacccgggaggcaggggttgcggtgagccgagattgtgccactgggcgacagagtgagactgtgtctcaaaagagtaaaaacctctgtaaatccttttgatgcccaatgactttgatttcaaagctagtatcatctaggtagatttatgttgatcacttgagaaacagaatttgaaaagttaatttatttctcaaaggagatgttgtactatcctgcaaaagtaccagagctttgttctcttccctttgctttgctaaaaatttctgggtcttttggtttattttacggtgcgttggcccaa

SEQ ID NO: 161542 - DNA, 485 bp, Homo sapiens
ccatctctactaaaaaaaatacaaaaattagccgggcgtggtggcatacacctgtaatcccagctactcaggaggctgaggcaggagaattgcttgagcccgggggcacagaggttgcagtgagccaagatcatgccactgcactccagcctgggtgacagagcaagactctgtcaaaaaacaaaaacaaaaacaaaactctaataaaggcaatgtatcattttaatatttcctctctaaatttgcaaagcaggtaaataatgtcttattcataaccatggattaacataaatttaaggcttctgggatattagtaatggctaggtaagaaacaggaccccaaggcagggtgtggtggctcacgcctgtaatcccagcacttttgggaggccaacacaagcggatcatgaggtcaagagatcgagaccagtctgatcaacatggtgaaaccccatctctactaaaactatcaaattaactgggtg

SEQ ID NO: 161543 - DNA, 553 bp, Homo sapiens
gaggcgtctcttcctggcagaggatcgtgagattcgctgacagcgaagaagcacggcaaggggcatgttcgaagacccagagttgggtgtgcgggggccaggacagaggctgcataaagggggtgtcccacggagtatcttgagaggattgtcatgtggtgtctgtgatgagggatcacgtgggtacctatggaagaccaaaggaaagctgggtgggaatctcaccatgtccgaggtagggaggagatgatctcgaaggagggttcggaggcatccccaggcattcccctagggaaatgtatattcagtaggacaggtgggcaagcatgtacatatattcacgttcatgtggtagatagctcccaggatgcagatgcaatagggagaacagaaggaatggaggatgttggtctctattccctgtttccagctgagaaatggggacccatgggtgtcttgtcaggagttgtagaagatgatttgatttgaaaagatctgattattataaaagtttggttcttattcagcaggtctagggtgcaccctgaaattc

SEQ ID NO: 161544 - DNA, 330 bp, Homo sapiens
tttcattagcatcaaactcatgcggccaacagctctgtaactcatgattcagtgaatcttatctaacacacatattttctccataaagcacatcacagccttcttgtgcttagaaacactagacagcacttcagcactacatttgggggtcctttgaaacagcaaaatcaccacaattttgcattttgtatataaaaatgcaaaaaaacatggtgctaaatctaccacaataaggatacttctttacattctgagaggtgaaacaagaaggtagagcatcaccttgttcaacctcagcttgcaacaacttgaattctgcgctgctctgtg

SEQ ID NO: 161545 - DNA, 547 bp, Homo sapiens
tctggaccctccataagtacgcaggataagtatttcattttcgtttagaaaaagggcctctcttacctcaacatcattgtgttcgttatggataggaagacataagccatatctgatctatgagctgttattagaaaatagtacagtaaattggctggaataaaccttggttttaaaacagtgccaaaagtgtcataaagttctttgtctctgacccagaattcttgggtcttctgtcagcatccattgactgtatcagatgattttattgacttataagtagggtaaagtcaatcccttcatgctttttatgagacagatgggatactgatagagatatgaccgtctggaatagagccaattaatgagatttaagggaagtccttgagattcagtggtagacacattgaacaaattatatagtcttttgtccaacaaatagttctccactatgcagccctttttttttcttttttgagatgtagtttcactcttgttgcccaggctagagtacaacggtgtaatcttggctccctgcaacctgcgc

SEQ ID NO: 161546 - DNA, 374 bp, Homo sapiens
gtagagatggagcttcaccatgttggccaggctggtctcaaactccttacctcaggcgatctgcctgccttggcctcccaaaatgctgggattacaggcaggagccaccatgcccagcctggttatacacttttaataagcatctaggtgttatagtgtggcaggactctaacattgaaaataaagaacatagagtaatttagagtcacatttaaaaatcaacacctaatttacaataaaggtatgcaaaatcatctgaagaagatattatttgtaggcaagcaaacccatactgtaacctcttcagtgtcttaatcactagtaaaattaaatcaaattaaagcagaaggagaatgacataggttcatattggt

SEQ ID NO: 161547 - DNA, 237 bp, Homo sapiens
tatgagatgtggtcatggaacagagggacctggtgacgcagacccagcctttcctaggtggcaggcactgcgtgatggttggggtcaggggacaggccaaaggttgctaagaagacctgagcatttgctggttcagaagacagcatcacttcaggatccctgaagaaaaactctaaaaaaaacaggtgacttactctcaccagcgaggttaggtctacctgggttaggtctacctgg

SEQ ID NO: 161548 - DNA, 339 bp, Homo sapiens
gacatcctgagaaggatccgctgctgatcgcatcctgggctgccaaagcttggtgctccccacttgctaagcagctgccacactgagtcccttagcagtgactagtctccctgcacatcctgaccaaattgccctggccttccctctccattcctctacaagggtccacactatcaggacagtggctggtgggagtctgccctctcctgggtctggtgctcctccctggggcaggaggatggaggggccagcgtgctcactcggccctgaggagcattgttgtgggtttgtgatgaaggcctgggaggcttaggagacctcaggagctggcaacatgga

SEQ ID NO: 161549 - DNA, 460 bp, Homo sapiens
acttataaatggggaaacagaggcctagagaacagtaaggagagcaaagccacatggaaaatggatgggaatcagtcccagggccttagcacctgcctgcctgccccctccttggagggtcaccactaccagtgtggggcaggaggctggcagagggtttggctttggaaaaggtgttgagctgtccaagtacaggctccacacaagctgctcaggaaaagtactgagaggccagaaccacccagaagattagtctttgaagaagactcatatctgaccctttgggatatttgacaaagcactctcaaacatatgcttcctctggttcctcgttgggaggaggctggacagacaggggttactctccaagagagggaaatccatggagggttgctgggtaaaatggtggctaagtaggggctcaaactgaggactttggtctcccagaaagaaagctaca

SEQ ID NO: 161550 - DNA, 258 bp, Homo sapiens
gtacgctacacaccatctgtccatccatctctcccttcagccgggtttttgtcctcacattctccaggtttcttgcctctccattactttcaactctagtgaccctgtcttactggcacttcctttactagtaccttcccttataccagctagtaccttcccttatgccagatcccatgatgaactacttaagttactccatttattatcttcacttctcctctcacttttttttttttttttttttgggagacggga

SEQ ID NO: 161551 - DNA, 526 bp, Homo sapiens
gccacgaagacaaacgtcgggggtagggagaaaggggggggcgcttatagaccatcaagcttcagaagatcatgtgacaaatgttccagccagttccagttgaagacaccacccctggccatcaagaagctactctgcctccactagacagagcagggtgacagttccgtgatccccaataggtagggactttgcttcaagccagcatgaggcagttacagaagaaagaccattagtcactccacctcccataaagatttatggggatgacatctctcagggaggaaatgaggcaggaaaataggatctggaggcatagaacataaggcctattcacacttcagctatgccgggaaatattatctccatttacatagggcatacacaaagtaaccaatggaaacctctagagggtatttaaatcccccaaaattctgtaacaggacccttgagcccctatgcttgggcccactcccacactgtggagtgtacttccattttcaataaatatctgcttttgttgctt

SEQ ID NO: 161552 - DNA, 385 bp, Homo sapiens
gtctaccatcatcaggtcctaggcaactaacgaagtctctccaattttactctccacaatcactgttccttatagattatccaagtatctacatgtatttaaaacctaccgctggccattttttggtcaaacttgtggtaaaatacacataacttaaaatgtgccaccaatggcattgaatacattcggtgaactgtgcaaccatcaccactctacagttccagaacattttcatcgtcccaaaaggaaacccggtcccatgggtcccttttacaatcccattcatgacagcaaagcaaaacagtggaccatgtatagttaataatagttttctctcaaatgtctctacaaagaagcaagaaagctatctgggaagctgaatccc

SEQ ID NO: 161553 - DNA, 335 bp, Homo sapiens
cctgtgatgaacgggacgctcgctggcatggctaccgtgtccccactgccaagtgtcagtggtgcacctgacctgcctgtctagaagaagctgccaaatatgatgacatcaagaaggtggtgaagcaggcgtcggaggtgcccctcaagggcatcctgggctacactgagcaccaggtggtctcctctgactgcagcctcgctgtccctgggattacaggcgcctggtaccatgcctcgctaaatttccgtagaggcacggggtttcaccatgttggccgggctggtcttgaactcctgacctcaggtgatccacccgccttggcctcccaagaa

SEQ ID NO: 161554 - DNA, 476 bp, Homo sapiens
actatcgaaaatcagttgattcaacaaaagcttggggttaggagactcaaattccaatcctagattttcattcatgtgacaacgagctttgcattcatcaatctaagccttgagtttccacatgtaaaacaggaaagtgaaataattcctcaggtcccttccagttctgataacctatgaatatgcccaactattaatacaaaatgttgaattcaaacagtcatctataagggtagacacagtcccctggcagaaagctaaagcaattctttacatcacactgaaaactctctcattgaattgagagaaaggtgtgcctgtaattcagtgtggacagagtaatacaggacattttaagacaaggcatgtttgacacaaaaggcagttcaaaaaacatttcaaaaagcttcaatcgaggggggaaaaaaatcaatggaacgacactaaacattttttgtgatccttcactaaaaact

SEQ ID NO: 161555 - DNA, 499 bp, Homo sapiens
gctttccggataggcgagaaagtgctgtgggattaaagtagatttacgcagatgaatatgatagtgaaatggatttcggcgtaggttggtctagggtagtgatggttgggatagaagatgagggaaaaatctgtaatgcctccctggtccctggcctggttgtagagtacaatggtggtatcattaaccaggacagggacaagtggaggaggctcatggcttttgagagagagagagagagagagagagtgtgtgtgtgtgtgtgtgtgtgtgtgtgtgtgtgtgtgtgtgtatgtttatgggtgtgagatggaacgctgggacatgagagggagatgacaagtccagtgaggacattttgaatatgaaagattaagcactcatgggatacctaagtagggaagttcagtaaggagctcaatatatacgactgaggcttaggagaaaggcctgggctggaaatggatatcactaaataggtggtagttcagattatgag

SEQ ID NO: 161556 - DNA, 496 bp, Homo sapiens
ctaaatcacagatgacagagaaataaacacattttcagacaaagtctgagcgcatttaccactaatagacatgactggaaaaactattaaaagacgtatttcaggaagaaggaaattacataagaaggaaaaagaaaagagatatgagaaatggtgagccaaaatactagtaaatgtgtaagaaatcaaaataatcattgactgtataaaacaacaataatactaagttggcaggtataaatacaaggtgaagttaaaacacaaaaatgtaataacatgaaagacataagagaatcattagagataaatcatcctccttgcattgatcagcagaaggaagagatattgatcaaaggcaaacaggtatgttaaaaatggaaaggtaaccactcaaagaacagacatagactacataatttcccaaccagtagagggcaataaaagaaacaaagaaacttgatcagtgcgacagaagtccctgtgtcagcagaacaaa

SEQ ID NO: 161557 - DNA, 300 bp, Homo sapiens
gcatggaatagaagtcacacatctatgacaaactacaagagaggatgggaaaacatattaatagcttctactgtggagtggacaatttcccctcaaagacagtgttcaaaaggggctggtacccaaaatgcatactaaacatccacaagtgatatcacactagctgcttaggtcctaaggcccctgtgtactttttttctcagtttattccctaaattgctccctaagttcagtgttatggcactctcgtagtttatgactagtaaatactattcatagctgaatcctgttgcattctgt

SEQ ID NO: 161558 - DNA, 432 bp, Homo sapiens
ggccccaacaaaaaaaaaaaaccaaagaaaaggaaagaaaaaaaaagccaaaaaactacctgagtctagcacaaagtctggtgcacactgagcacctaattgatatcagttgaaaacacagatgaacaaatgaacagggattgctgggagaatcaaatgggctgacataaaatgaaagtagctcgatctctggcatgtggcaagaggtaagttacttgataattgcactagcagagtcttcaccatgtgtgaattcctaaatataccttttctcatctcaacatttcttaaatcaggactcatcttcacaactgatttgtacacattgtaaataaagttttattggaacacagccatgctcattcatgtatgcattgcctacagctgcctttatgctacaacagcagagttaagcagttacaacagggagca

SEQ ID NO: 161559 - DNA, 901 bp, Homo sapiens
tcttagccttccagggtcaaggggtgctctggaggggatttagggacatgggtcagtgatgtaggaattttatgagggggctgtggacagcccagctgggggaatcgtgccatttaactggaccccaaatgtgttcaatgttaaagtcatcctaccccaaactttgtgcttcaggctccttcttccctggatccctggctgcgggagcccctctgcccagcctgctgtccggaatcttggatgtttgatcgtctccctagtgcagcacaaaccaacctccagagaaaagtctagaaaagatgcctgtggctcagtgggcatttggtgcctggcatttgtagactatgtgacacactctattatagatagggacattctcactatcttgtggggaaactgaggcccagagaggataacttgcccaaagttacccagatacatggtggagccaggatgagaacctccatgctctgactctggccttggagtgtgagtcctccaaggccctgcaacacacactcagtttcccctgtctcccctgggtcccaggaggagtgactgtgacatctgtggagggcacaccctccttgactctggctggtgggacttctgagggggttcgcccacccaagatccttggatcccttttctgttgggtccacaccatgccaggaaacctggcaagatggtcactgtgggtggtcttcgtcctttgctctctcatcccccgctctgcgcctctggcacaggccagtcttgggggtgatctgcatttggcatttgggtctttcgggtctcttagaaaccccttcagccatggacgccctgagcggaacccccttcctcgggcttcctttccgggactttctcctgagcctggctcaggatggattgccccctg

SEQ ID NO: 161560 - DNA, 378 bp, Homo sapiens
agccagtgaggggtgggacccccccagaacagaaaaagcagctgagcagaggcgtgcggtacaggacaatggtcagaagtggcagccccagagccaggactaggaggaaggggaacgggcttgggaagagcttggctgaagcagcaggcctgggtcctagaagggcttgaatgcaggcttaggaagcttagcctgtgtcctggaggcgtgcggaactggcagagggtctggagagcacaggcagaatcgccttttggaagggtcacatggtgacaaaacccaggatggattggagccagaggaactggaggccaggacctgataaggaggaagctggcgtggtctgagcttagaggaagcagctctcgggctgctggc

SEQ ID NO: 161561 - DNA, 402 bp, Homo sapiens
gtggataatactgtctcaaagcatgagttattctctgggttgtgcctcctaattggtgaaggtggccacttggtttatttgagacaattctaaggaataaggagctctccacactagtgtgagggccccagggcaaaagatgtttttctgctcctcagaaagttctcagagaacttggcaaggtttttataaaccctgcaaagctcccgttatgatggggatgaggtagttctgcattaaaaatagtcataacagttaccagtcctcataataatttttattggaactatcagaagtctgagtgcctatttgagaaagagtttccttggatgaatcactgcaggaacatgagaaagaaacatggcactgtgagatcaaatgtgtagataaataatcccccgc

SEQ ID NO: 161562 - DNA, 191 bp, Homo sapiens
cagaaagcctaacttaaacaataaggatatgtactagctcaccctgttgtttggcaaacccagcagctcctacctacattctcttccctggccacctaccattatagagccacatacttatgtttttctagattcctatttctgactagtgaaatgtagagaagtctacttgggggctttgggaaagtttt

SEQ ID NO: 161563 - DNA, 336 bp, Homo sapiens
ctagccttcagacacttggtgcctccctgaggatacaccaacacttcaagaacacagagtgcacctggagtcggctgagtagtcctgtgtcctgaaataactgctcgacgttcccagagccagtaaatgggatttgggacatttttgtcatgaagtcacaatgtgggactataaatgtcttgcctttaagggtagggtcttcccatgacccatccataacatttgtgaaaatgttgtgtgttgtgcgttttggagagaagaattttcattatcttcacaaagggatctgttaccctaaaagatttagaatcactcagcttattggtaagatgtgcc

SEQ ID NO: 161564 - DNA, 487 bp, Homo sapiens
ggagtctcactctgttgcccaggctggagtgcagtggtgcgatcttggctcactgcaagctctgcatcccgggttcacgccattctcctgcctcagcctcccgagtagctgggactacaggcacctgtcaccatacccggctagttttttgtatttttagtaaagatggggtttcaccatgttagccaggatggtctcgatctcctgacctcgtgatccgcccaccttggccttccaaagtgctgggattacaggtgtgagccactgcgcccggccaatttttgtacttttaagtgtagttaattggtacttttgaaaccccaaaactttacaatatatatacagataggatccaaaatgaatttgactgcttattgctgatgcatatttgtgacatacatgcatacattttatctatccttctgtgcttttttaaaatttaattatttttttagagatggagtcttattctgtcacataggctgga

SEQ ID NO: 161565 - DNA, 778 bp, Homo sapiens
attccagctatttatctcctctatactatatgtgcaagaaacagcttgcagactggatctgtagaaaagcatacagtttcagagaaaggtaccattctcgctggtctgtgacttgaatcaagcccttaaaccatgctccctggtaagcattctaattgtctctggtcatttctctcttccattctctataggagctgccatatacctttgcatctttattaagctcctccccataagctccttctccacctcccttggcagttaaatttacattcttcttcacaaagaaaacaaaacctcaggtaagaactctcttgactttcccccactaattgaccagcatctatccaacactttcctttctctccttctcctgttacaatggaaggggtattccctctcttgtgacttcttagaggctttgtctaatcctggaccatgtctaaatctggcccctcaagatcatttcatccacaagggagaaatatattttgttgtctaattccaggccacttgcaggagacatatttaattgccatatgttcccatataaccttgtgcctgaaagcacttatcacactattttacttttcaaaaccacgactacattctcaaatccatgactcacaggtccagcctgtttactgtagtatctcctgtagcacaatacctgagacaggggtcggtcaatggtttctgaatgaaaaaacacaacagctcaggtacccacaaatatacgctcaggataacttgtgataggtgttaaagcaaaaggtca

SEQ ID NO: 161566 - DNA, 182 bp, Homo sapiens
ttaaaaaagaaaaataaaatgtgatgactgaaactgcaagtggtttctatttacccttgtggagagttgccacatctattcacagccactatttgctacacaattatttcagagcttgagtttcggcttaaaaaatgatttgccatgaaagcgaataggagaaaaacaattcctttcagagg

SEQ ID NO: 161567 - DNA, 455 bp, Homo sapiens
ttcagctaatttttgtattttttgtagagagggggtttcgccatgttgcccaggctggtctcgaactcctgggcttaagtgatctgcctgcctcatcctcccaaagtgctgggattacaggtgtgagccaccgcgctgggctgagtgtctcataattattgtgctttctttgcattttgtacataacaacaaatggaggcaggaatgttgtcttttatattttatgatttggaacacagcatgcattaatagaaaattgaaaataatgaaacatgactataagccaacactgtgtttcctgtcccaagtacattttcctgagaaaatttcactgcactctaataaagctcaaaaatccttcaccataagaacttgtaccacagaataaaatctcccaaagccgatatagttattaaccctttttttactcacatctgaagtgccagcaccattta

SEQ ID NO: 161568 - DNA, 356 bp, Homo sapiens
caagggctcaggtaggcagcatggccgggctcgggcacaggggagctttaaatgccccctcagaccaccacgtcagaatctccaggtggggcctgggtgagtcccacgggcgccaggggtgcacctgccagccctggggcagggccagccaaggtgcgagtgtagcggtggccgctgcgcagtctgccccagctgagggctgatttaattagaaagcacccatttctgttaatttgttctggaagatcaccacgcactcctggagagaacagatgttccctctcccccgatgagcatttggggcttggtaaatggctccactcagccttgtttaggagagaaaagaggattttatg

SEQ ID NO: 161569 - DNA, 283 bp, Homo sapiens
aaacaagtgccaagtggacctttggggatgtcatagtcagatggtgtgctcatcttccagttgtttctggcaaagatcaacctctgctggtcagggagaaggccatccttgtcttgaatctttgccttgacattctcaatggtgtcactgggcttgacctcaagggtaatggtcttacctgtcaaggtgttcacaaagttctgcattgtcaatggcaatggcagcagtgcacaagaacaacggctcaactcccagcttcgatggaactctggtaattttcaat

SEQ ID NO: 161570 - DNA, 376 bp, Homo sapiens
gggaggctgcggcagtgacccagtgaccgagggacctagttaggatgtgttttaggccaggatggttgccagggagatagggagatggggtaggattctggatgtatcttcaggaccattagcattccctggtaggttgaagatgggccagtaagggaaacagaggggtcaaaggtgatgccaagatttttgcccaaagcacctgaaagatggagttgcccatgactaagatggggaagcacggggtcagcaccgatttggggggaagatcaggatttcattcttggatgtgctgagtttgaaacatctgagtcatatccaagtgaagagtttgaataggccgttggatatatttaggataaaagcctgggctata

SEQ ID NO: 161571 - DNA, 430 bp, Homo sapiens
gggctcgtcgacttgagttgaaatacttcataagagcacagtttaattttttttggaaagtaggtttttaaaaattattttccaccgtgcttattttcagaggtaacaattaagagggatacatttttttttttaattttgagtgttggaccttttaaaaactccctgttaaaagaatatgaaggaagtagggggaaatgttctctttgtgaacgaattctaaatggagtgcattgtgtgaagctaaaggaaaacttcatttgagtaatattctaattgtattcttccgtatcgtgcaggagaagatgacaacctgtattttactgctcaaaaaagaaaatacaaggctcaacttgtttctgatgcagaactcaggagctcctaaaagagcaagtggaatgaaatgtttcctttttgattttcttctctt

SEQ ID NO: 161572 - DNA, 155 bp, Homo sapiens
ttaaccttcctagaagctacagtgaaaaacaagacagatgcctggagtatgatttggtgggttcaataaagccttaatcctccaaaatttctacctcatgcgcttgctggttaacaacacatttaatgccttctctctttgtaacctaccagaca

SEQ ID NO: 161573 - DNA, 269 bp, Homo sapiens
gacatgcataagtgcccggaatataggaggtgctctgaagatgctgccaactcccccttggatttctttgttcctaaagtcaagctcagtgatcgcacatagtagataagtttggcagttgattgattttctaaatcagaagtgtaaatgcccagtggactttgcaccaaaggacccagagatctggctatgcattctctaagtgtcttttcacaaggcaagactctcccagtccctcttggagaatcacttttgagacacatttacta

SEQ ID NO: 161574 - DNA, 417 bp, Homo sapiens
tcttggactcctgatctcaagtgatctgcccgcagtggcctcccaaactgctgagattacaggtgtgagccagagtgctgggccccatttcaagatgacagcctaagccatacattaaacgtgtttttgttgttgttgttgttattgagactgaatctcgctttcttgccccagccgcagtgcagtagcgccatctcactgcaacctccacctcctgggttcaaacgattctcctgcttcagcctcctaagtagctggcattacaggtgctcaccaagcctggctaatttttgtatttttagtagaaatggggtttcgccatgttggccaggctggtctcaaactcctgtaattaaactaccctttaatagtctggtgtttggctgggtgcggtggctcatgcctgtaatcccagca

SEQ ID NO: 161575 - DNA, 662 bp, Homo sapiens
agtcaccatgctttacattagattcccagaacttactcataactgaaagtttgtgccctttgaccagtatctccccttacaccctggtccctgtcaaccactgttctgttctctgcttctgtgagttctacttttagattccatgtataattgagatcatacactttttgtctttctgtgtctggctgatttcacttagcataatgtccttcaggctcatctatgttgtcatgactagcaagatttctttttttttttttttttggagacagagtctcgcactggttgcccaggctgggagtgcaggggcgccatctcggctcactgcagcccccgcctcccaggttcaagcaattctccgactgggcaggatttcttatttatgggctgaataatatttcattggtgtgatatatgccatattttctctaggacatttaagtggtttccatatatgggctatggtgaataactgcaatgagtgtggaagtgcagatgatctctttgagatactgatttaatttcctttggattgatacccaatactaggcaacagagataatttaatataggaagttgatcaaatagatgttggactaaaaaatcaaagaaggcacaatatgagaacacagagatactgctgcagaaacagtaaccaccct

SEQ ID NO: 161576 - DNA, 220 bp, Homo sapiens
aagttaggaggtagacacatcctatctcctgtcactttcatgctgtattcacctcaggcagctctggcaatgacgacctgctgcagtaacaggcggttgttgtcgtagaaaggaagtaccgtaactgtcctttcactctccactctgcctttcattacttttcatttgagaggacgaatccagtcccgtggcctcaacctatttcttttttctttctttt

SEQ ID NO: 161577 - DNA, 712 bp, Homo sapiens
caagtgatctgcccacctcggcctcctaaagcactgggattacaagcgtgagccactgcatccatccaaaacttaagtagttgtagcatgcagaacattaaaaagacttttaggttcacccccatatgtcctaatatgttgtatttcaaaatgttgttttatttgagattaggcctatcttgtttgccatcatttttagatctatgcattctctgatataatcagaaagcaaaatgacagtcacacattttcttccaactgagctttaaaaaaaaaaaccgaaaaagcattgacataggctgagtttcctacagctacaggctttcagagaggaatcttatactttaaaaaacagaaattaaactaacagctctacagagatcttttcaatgaaaaataactcacaggagttcttttcaaagcatttaaaaattctcataatctactcatccacatcaacacttttaattagagcctctgtttacttaaaaggaagtataaccaaaaaagaaatcgaaagaaaaataagatcaagccaagcatatacgtcaactccatctctcattgacaactgtgtcaattgaaaaaataggccgggggcggtggctcatgcctgtaatcccaacactttgggaggccgaggtgggtggatcacgaggtcaggagttggagaccagcccgacaaacatggtgaaaccctgtctgtactaaa

SEQ ID NO: 161578 - DNA, 385 bp, Homo sapiens
aagagatggagaggtttgtcagagtttatcaattatagaacagcctcctctagaggaatataaagcactgccaaatcctctgagatttaggctgttgctggtagtagtactctggcaaataactttattcagttatttaagtttatggctaagcatagtagggtatctaatcccagtttgggtcttagctattttaaattcagaacataataaagtcactttcatagtttattttcattttagctattgccttttatggcttacagtttagctttagttagacataatcataaacgtgttgggtactattgatttgggttaatcatatgacctcagtggctggcacgaaatttaccaaccctatgggaaattactatagcttgct

SEQ ID NO: 161579 - DNA, 367 bp, Homo sapiens
cgactaatactttccaataattttcttttgataattcctctgacagtgtgaagaaaagtgcctgaacatggattaaatatcacatgacaacattttcccaaatctacgtggcaaactgctacttttctttttctacaaagataataggaggaaaaaagcaatttttcagagcagaaagcagcagacaaggttcagagaactagagttcttctcctggctctgctacccactatccagatgtgtggcctggggcgggggaattcacctctctgggtttctgtttccacattgggaaatgagatgcttagactgtgtgattcccaaagtccctcccagctctgaaatttccagagtctctggtacaaca

SEQ ID NO: 161580 - DNA, 210 bp, Homo sapiens
gagcacaagccatttgtgcaatgaggatgttatctaatacactggacttgtggtcctgttccatggccctcaggccagaatgacagagatcagaacccaggacccacctgcctggtgggtatcacatggaagacgctgcccatattggtttggggcagcacgacaaatacaaaaatacaagccagattttcacacacacacacacacaca

SEQ ID NO: 161581 - DNA, 318 bp, Homo sapiens
ttccctgagtctcactgggacaacacactgagcaatagctttaccagaatgttttgtgaatatggtatgatatcaagagtaataaagttattttggaaaaaaataactttagaataatcacttaaaagtctgctgtttttgaccataattgcacatggatatattgccttatataaactacaaagaattgtctatttcacatcacattttacaacttacattgcaaacctcacttcagccttgaggtacaactatcaataaaagaaacaggtcttatttttaaaactttttattattcatatccttggtgactttcag

SEQ ID NO: 161582 - DNA, 308 bp, Homo sapiens
atggggaccacttcacaattcctctaaataccagggaaaggaggtatctaatggtaaagaaaaatcacatctctaactggctattccagcactcccatttcatggttgggaaattgtattttaccacccatgaaattatgttttaggctgaacctaagttggaatttctttgtgtaaaattttaaaaaacatttacttggccatttccaaaaaatcaattttaaatatcccagtgctctcatatattttgaaccacagaagtcactcagtctggaactttaagtcgggccctgaattatgaattgagg

SEQ ID NO: 161583 - DNA, 408 bp, Homo sapiens
cttccaacagttgactttcccataaaagaaggggagctggagggctctggttcctgttgaacctctcctctcaaggcctctcccgtgcacacctggatccagcccttcattctgttgctcattcagcagtgctgaaggaaagaggagatgggggaacagcacggagttccggagggtccagttgcagtcatacaataagtccctaacaccttggggtgtacgttcagggttctctggctagaaagggtagtttgaggccaaaaccaaagagatcaggaggcatgaagggaaggaagtcgttatctgtctggtggttcagaacttggcttctgaagttcagctccctggcttccatttttggccctccctctttcttgccctgttgccctggaaagtcattcagtctct

SEQ ID NO: 161584 - DNA, 563 bp, Homo sapiens
ttttcctccatccccctacccgtgaatcacagtgtgaatttatcccctgcgtccaacccccgttctgtctccctgaccctgtgttcccgctggagcactggtctggcagcctcttacctgcagttttccctggcacccctgtcctctccctggcaacctcgggcatatcctctggttcccgggtgctttgtccatatcttacccagcgctgacaagaacgctggaggaatcgataacactgacaatgttatttggtccctgcagcttctcacatgtgggtcggagatggtttcggatttatctttggagccgggtgccgccacatcagggtgcagtcggtgttagacaccctttgttgaaagggatctgcttcatggttggagtgagtgcttgttctagaattgagaggcactgtagaggcagtgtctccttaaaagtggatgtgttggttggccggatgctgtggctaaaagccaggctcacaacccaggaactcccaggaaagttccctgttgaaaattagggaagatgggtgactggtgatctcgtggccaatggccact

SEQ ID NO: 161585 - DNA, 445 bp, Homo sapiens
taaatcttggtggtctctccctagggtcttaattggaggagcatcaggaattgggaagctttgaaccatgtttgggtacatttgtacccaaacgtcctttaagcccttggtagaaactgcattcgcgtatcatctcccttccccccaaccttccttccctgagggttttaaaaaacacttcccattgcttttacctttccagcaaatctggctgcagcttggatggatagcttatcttcctttgcaggtttctaggggagagtttaaccaggtatcaggtgtgagcatggctctgattttgtataaacctgaggatcgaggaagagaagcaaaatctattctcacacctctgggtggttaaggttttgccttgtttagagcagggaggatggatttctcaaagactcttctgttcccttctactttggctttggttcagagctgc

SEQ ID NO: 161586 - DNA, 447 bp, Homo sapiens
gatgccagggctcggatggaactatttctctgaaatcgatttactacaacatggaaaatcatatgaaagtcatcaatcataggaaaaaaatgtcaattgagtcaaagcagaagaaagaacggaaaggataaaaatgaaaactgcaacagactaaagtcattgttggagaaacggctatttttaaaaagacttaatagttaaaaaaattaaatccctgaaataggagacaatgaagcaaaacagcgagctttggaggggaatacagaaaggaagagagctttcactaaaaacagccacatgccagacacggcccaggtgctttactccccctaacagcatgcgatggcacaggttcccctttccagattaagaaactgaggctgaactgaggaaccgctctttccagtgcacaggtaggagtcccaagccttgggttcgcttcaaggt

SEQ ID NO: 161587 - DNA, 714 bp, Homo sapiens
  misc_feature (603)..(603): n is a, c, g, or t
  misc_feature (606)..(606): n is a, c, g, or t
  misc_feature (664)..(664): n is a, c, g, or t
  misc_feature (679)..(679): n is a, c, g, or t
  misc_feature (705)..(705): n is a, c, g, or t
tatgtaaagaaatttttgcacagctctctcgggaagctgttcaaattaaatcacaagtccctcacattgtggtgaaaaaccagattatctctcagccctttccgagcttgcagttatctatttctttgtgccattcctcaaatgataagaaatcccaaaaatttgctactgagaagcaatgtccggaggaccacctttatgtcctagagcataatttgcatctactgattagagagtttcataaacagaccttgagttccatcatgatgcctcatccagcaagtgcaccttttggccacaagagaatgagactttcgggtcctcaagcttttgataaaaatgaaattaattcattacagtccagtgaagggcttctggaaaaaataattaaacaagcaaagcatatttttctaaggagtagagctgctgcaaccattgacagcttagcaagccgaattgaggatcctcagatacaggctcatggtcaaatatcaatgatgtttatgaatctagtgtgaaagttttaatcacatcacaaggctatgaacaaatatgcaagtccattcaatgcaattgaatattggagttgagcagattcgagtngtncatagagatggaagagtaattaccctgtcttatcaggagcaggagctacagggatttncttctgtctcagatntccagcaccaggttcatgcagttcancaactcccc

SEQ ID NO: 161588 - DNA, 347 bp, Homo sapiens
gacttgtgaggtaattggctgggtacatggaccagtactcaataccatatacaggtgagagcagtggctgggggattggatattgattgggaactccctgggcaagtgaggcaggtaagggcagatgaggcaggtaagactaggtgagggcaggtgaggacagatgaggctaggtgagaccaggtgaggacaggtgagacaggtgagggcagatgaggttaggtgagactaggtgggggcaggtgacggcaatgagactgggtgagggcaggtgagagcagatgaggctaggtgagggcagctgagggcatatgaggctaggtgagactgggtgagggcaggtgagg

SEQ ID NO: 161589 - DNA, 281 bp, Homo sapiens
cagataggatataaataatattttgaaattccctcaaatactgataactaagtatacactaaatctagtaactataaaaaaactcaataaacctaggtaatgctgtaactgtattacagaggctaaaaatcggaaggtaaacactgtatataacaaccaagaactggtcaacatggtgttaacagattacaaacagactaaatacactggcattatgtgaaagactagtaaagcagtgctaagtatttagtggctaggagggaagggcaataatttctgtt

SEQ ID NO: 161590 - DNA, 151 bp, Homo sapiens
gttgcagcacgaggtgaggtctagaggagtccctggagagtcactggaataactttaaaaaagaattacaatacatggctttttagaatttcgttacgtatgttaagatttgtgtacaaattgaaatgtctgtactgatcctcaaccaata

SEQ ID NO: 161591 - DNA, 287 bp, Homo sapiens
aacaccatgttgatttctcactcatatccatgtcctccatgggaccactctgttctatgctatcttcattctagagccctgtctgaaggaaaagtctcaagctggaactttccgtctccagacaccgaagagaggaaaggtggcagaccccatgacggcttttaaagcttcctcgtggaagtggcacatgtcatttccactcaaagtccatggtctaaagcaagccacatagccatacctgatgtcagtgaactggggacaaaaaaccattctatgtagcaggtccc

SEQ ID NO: 161592 - DNA, 386 bp, Homo sapiens
  misc_feature (45)..(45): n is a, c, g, or t
aagcttttattgtttggttgtttttgtgtttttttctggtgagtnttcttatagatcttacagagaattatgaaagatttacttaagcaaaatctaactgtatgaaaacacaaaaacaaccaaacaataaaagcttgcttatcaaattcagaggtcagtgattcatgcattgtaataactgagataccttgcttgggcttaaatttacctttacataatttgtggaaaatacatgggtagacaaagtaataggaaaaatgaaatggactgtaaatgaatgaatctcaaaaacatgctgagtgaaagaagccagacacagaagagcacataacctatgaactcatttatacaaagttatagcacaagcaaaactaatgttagagtga

SEQ ID NO: 161593 - DNA, 391 bp, Homo sapiens
ctttcaagaacataaaaaacattaaaaaaaatttgtaccattatcatttccagacccttcacagcacatattttatcggggttttatagtaattcatcctttccactagtgcacttagcaaccaagacagctcatacccccacatacagacaaacttgctattaaaagggtcaaagtcttagtttcctcaagtgtactatgaatacccagggaaagactccaataccaagcatgagataaataatgcccatatgagaattttcaacttttaaagaaaagtaagtcaaactgtctcacggtaggaaactagggttcccgcaacccgttctctctctcttcaatttcataatttgctaggagagctcacagggaatcacttttaattccacag

SEQ ID NO: 161594 - DNA, 182 bp, Homo sapiens
agtcccccgtaggcagcgagcactcaagaactggtttgtccagtaaaaaacataagcatactcttcttttgggaagggggagtccttcatctcaaggagaagaattgctgtttcaccaaactaaatagtcataaatactgaactctaaaatatcagacttctgtggtctaggaaaggtcaaa

SEQ ID NO: 161595 - DNA, 242 bp, Homo sapiens
gtctgcatatgtgtatcactgtatgtatgtgggagggggacaaggaaaggggatatagtcacagcaagagatccttattgaaagacattttgctgaccaagaagttttcaatctaactcagaatcccaacagtagtactgctttgtggagataattactgaactttgatctacttcattgttcattcacttgacatgaatcattaaataaactttgacatcaccccaattccaacatgacag

SEQ ID NO: 161596 - DNA, 224 bp, Homo sapiens
aactctcttcagagttggacgtaaaacactgaggtagctagaaatacattctaagttgaggtaatttggggcatggtggcatgcctgcaatctcagtgctttgggaggctgcacagggagcattgcttgagcccaggagttcaaggctacggtgcactgtaactgtccctgtgaacagccgctggagtgagtagccactggaatgagtagccgctggtttgagg

SEQ ID NO: 161597 - DNA, 328 bp, Homo sapiens
gcctctgctctcacctcctgaccctgacctgtgtccacaagggaggggtcaggcagcggatggtggacacgggagtagggaggcttcaccaccctcactgtgtggacttgatgaaatcactcttcctccctggacctcggtttcataatttgtttaaaaacaaacaacagaaaaggatgtgggactttagcaattttcagcccagagtgtgtgtctcttatttgccgcagcaagccactgctatccaggggcacgtgtctaatccctgtaggaggatggggtggaaataaagattgagaaccctggaccggaaggccgggatgtcctg

SEQ ID NO: 161598 - DNA, 193 bp, Homo sapiens
taaattctgtcatgagtagcctgagctccttttttgagagggtgggtcagtgttatgggtcctgtaggacttcagctacacctgggagaaattttggaagcttcagtaggaaagtgtagcttaaaattagcctatatttcccaggaagttgatacagcttatctccctctaccctgttgttgagcttgatctg

SEQ ID NO: 161599 - DNA, 411 bp, Homo sapiens
tattcacccaaacattcaaggggtccctcatgatgatttttgaatatcttcttctgcacaacttcttctccaggacattgctctgaaaattctagctactccctagaaattagatttctcttgtctcttttcagagacagttgggctctatttgcatttcctctctgtctgtgtagtctggaaattgcctttaggcagaaatgtagggcagttgtacttcgtgtatttccctctgtcagagatcacagtcctgtgctgccagttgtttaatgtctgaaaacagttatttcaaataacttgtaaacttttctagctgtttatggtaggagagcgtgtcctgtaacagttatcctctcatgtatagaagcagaattctattgttttgtttgaatcacttttaaactttttctt

SEQ ID NO: 161600 - DNA, 759 bp, Homo sapiens
aaagttaccttcttaaaagtatcatatggactgcctaaaaacagccagaaagttttacagggatatttttgatatccctcaatatcaagactaatggtaaatctaaaaatctaaaaagcagttccaactctcaatactaactgtttttgtgcaaatattttttctctggtctttttctctctctaaaccccagaatacatttggaaacgtgtgtgcaattgatcaatgcctcggccattttgaaaaataaatgttcaaactggataacagttcatcatacataatctataaaatgtgggttatttatccataatcataaacatttagtttcaaaaatccatctttctacactgtaactgaacataattttagaaagctttggtcactacttggtttttactttactatcactgtttgtccatcagtatgaaagtcatttccccttaaataatagccaaactctttaatcctaatcctgaactcactcactcactcactcaatcctttgttcatttaaacatttacaatggtggggttgcagagataatgggatcagcaggctccctgccctctcaatctctgaccacagccagtaacagtccctgttactcaggtctggaatctcaaaaggcatcagtggcattagacttccatctctccccatggcactgccaaggggggcaaggtggggaaggaagtggccacagtcaccattaggtacccccatccctacagccgcaaaccacaccaaataaacgc

SEQ ID NO: 161601 - DNA, 311 bp, Homo sapiens
acgcacataactagatacgcacataactagtacgcacataactagatacgcacataactagtacgcacataactagtacgcacataactagtacgcaataactagtaaagtaattggcaatcacagtagatgaaggaggttacctgcccctttccagaacacagagccaaggaggactctacctggtggtcacgctgcctcctttcaatcacacaagaaaggctgaggggaccacagtgtgcaacaaaatgcagtgcacgttgaaactcggttaacgcctatcagttgactccctctcatccatcactgtg

SEQ ID NO: 161602 - DNA, 122 bp, Homo sapiens
ctatacagttttccacagcagctaaatcattgttacaagattgccaacagtgcacaggtgttccaatctccccgcatccttggttacactggttattttgcttttttgattgtagccatact

SEQ ID NO: 161603 - DNA, 269 bp, Homo sapiens
aaactttgtgggggagaaatatttgagctggactttgacagggggtagagtgttaagaagtggagatagagaagaaggccactggagcaaaagcaccaaagtgggacagtacaggtgtggccagatgacagcctggtttgctggggcaggggagaggcagtgaggagtattgggccagagcgatgagaacctggcatgccagaaagggagcttatactttatcttttgggcagtgggaatcagtgagaatttttgagtaaggaaatagt

SEQ ID NO: 161604 - DNA, 403 bp, Homo sapiens
attgggcgtggtggtgcgtgcctgtaatcccagctactcgggaggctgaggcaggagaattgcttgaactcgggaggcaaaggctgcgatgagccaagattgcaccattgcactccagcctgggcaacatgagcaaaactccacctctaaattagtaaatagaaaaaagcagtttgctggtccaaaaatgtacctaaaatactttgaatatcatggcttttcttattcaactggcaaggacaagcaattactttttaaaagataaaaattacatcctactagttttctgagccgactatcctacctaccatcttcaacatgctttatttaaaaagacagaggttgggcgcggtggctacttgggagactgaggtaggagaatctcttggactcaggtggtgtg

SEQ ID NO: 161605 - DNA, 221 bp, Homo sapiens
cagagactagagcatttagaagatagcgtccttggacgaaaaggagagactgtcaaggcttgctcctcccatgactcaggcaaagaaaagaaggagaagcaagacccagacaaaagatagggtagagattaggagtggtagaacatacccacaagcaaaaaaaaactcacatcaattcggcttccaccttcccccctctcattttcctttgactcctctct

SEQ ID NO: 161606 - DNA, 317 bp, Homo sapiens
aaaatcttcaaagtcccaggagaagcactttccctcataacagacgtgtttcctgcccttagctttcaacacatgggaggttgttatagtcatgtgacacagaaaaagactatgggggacagtagcttccagtggagtgacagaaacagaaagagggtcagatgggaatcaaaggtcacccaggggctgtcatcatcaggggctggcctctgcctcagttctctcacttgtacccaagaaaagtccctgttcacttccccagagataggaaggcagccaacctggtgtcacactccagtttgagttcagtttccctc

SEQ ID NO: 161607 - DNA, 313 bp, Homo sapiens
ttttcattcaagagtcttggatttagtccacaaggcttaccagctgtgtgtcattgggtaggtctctttacccacttctccagttttcacccctgccactcttggctactgctttctaatctagcaacatccaatgtacaacataattccattccacactcatattctttaagttccctcttttgagaatgctctgcccacctccctcgacctgccccataccgctatgcttggccaacatctactcatccttcattcctcctcaccatctctaggaagatcccctgacatcctcaggctgggttgggaggct

SEQ ID NO: 161608 - DNA, 401 bp, Homo sapiens
aggctgtctctagaggatccactctgatgacacgtggatctgtgcgcgctgctctcctgtttgctactgggggagccgtatgactgctagttttgtaggtcaaaagtggtcgagtattgacagctttgtatataattcagtgcagtcgttttctcggctagacaagcggcagacctgagtggttccagacactttgttctcatgcaccttatcacatgactctgcctcagtttcctaatatgtaaaatgaggacctaagcagtcctcaccttctagggttgttttgagaattagaagggtaatagacacagcatccagaaccgtggcattagctatcattatttttatctgtatgattacaggttttcaccatgtgctggtgcaaaccagctttgatccag

SEQ ID NO: 161609 - DNA, 123 bp, Homo sapiens
ctcttccccctctgcttcaccaatttctgccaagacctttgggtctcttctcccctgacagttcccatatatttgtaggcctaatttaaaaaccacataaatgatactatgcataatcaaatc

SEQ ID NO: 161610 - DNA, 576 bp, Homo sapiens
acagcactcattccttcaccagatcacttttgttaagctgtgccatctttactcaccagtatacaacaatagtggctatagccactaccagtttatttccactaccgtacatgctcactaaagtaagaaaaattcaaattgttgtatacaacatacaaaattactacacactactgagttcactaaatgttaaataataaagtaggaggtatgttaaatgtttatattatgcagaaacttgtggtaacttttaaaatgtaagtgtttaagaacattcttgtaatatttaggggaaatagttgggatttttggatgggctgggtaaactatttttcctatttaaagtgatgaaacatagtctctagctgaaatgttgctatccaacatattttcagatacagattacatctgagtaaccagggatcctatatggagtagaaagagaattttcacaatgtttaagtgaaaacattcaactttttcctcttttatttcctttacctttccatttttacttccttttctgtgatcagtctattcatttcctctgcccatttttctaataggtattgatct

SEQ ID NO: 161611 - DNA, 337 bp, Homo sapiens
aagaggacacagcccagcatacttcatctcctggcatgtacaatgggcatgaccagaaactaggggctctggatctcctctaagcacatgctgggaagacatttactcttgtgtcactatcaatgtggttttcttgtttgttttttgtttttgagacagagtctccctctgtcgcccaggctggagtccagtggcgtgatctcagctcactacaacctccacctcccgggttcaagcaagtctcctgcctcagcctcctaagtcgatgagactacaggcgtgtgccaccatgtccggctaatttttgtatttttagtagagacagggtttcaccatg

SEQ ID NO: 161612 - DNA, 609 bp, Homo sapiens
gtccccatgcacatgtttttttgacattttcataccacagtgatttttaggaacacttatactgcattatagaggtatttcaaagtaaatttttaaaaattatgccttaaagtcttagtacgctatgtatcaatacagaagtattttaaatatggtaaaaacaacttagtcttaatcatgcaacaatttttgggagatactaaaaaatacttataattcccagaattctaatgccaggggctgggtgtgtggctcacgcctgtgatcccagcactttgggaggccgaggcgggtggatcacaaggtcaggagttcgagaccagcctgaccaacatggtgaaaccctgtctctactaaaaatacaaaacttatctggccatggtggtgggcacctgtaatcccagctactcgggaggctgaggcaggagaatcatttgaacctgggaggtggaggttccagtgagccgaaatcatgccattgcactccagcctgggccacaagatcgaaactctgtctcaaaacaacaacaacaacaacaacaacaacaacaacaacaaaaactgaatgcctttaacagcacccaagtcacctcttgaatgctttgctgc

SEQ ID NO: 161613 - DNA, 469 bp, Homo sapiens
atctaggaaaaaaaaaaacctcaagaaggaatggcctctggggcaagggagccaggctaggggatccctcaaggctgacaggagagaggaatttcagagagaggagggaggcagtgccagaacttgtaaggagacggagggtgaaggtgtctgtgttcacattctaactatagttacctttgcttcctgagtgacatttgtggctcacattggatctgagtgctacttcctctgcccagttgaagcagcttaattcagaggctaaagggagtttctgatctttctaactcagtttgtgaagccagttaaaataagaaagactgcttatttcattgggcaggaaaaacttgattatgtgaagcagtcaggaaatggagcatatggatgttaattacattttctggatcacacaagatcaaccagaaagagccttttgtgtttgtttcaatcctgttattggaaatctcag

SEQ ID NO: 161614 - DNA, 570 bp, Homo sapiens
ccaaacacacagaggagttacatctggctggtgctaggatggaaggtggggcaggtcaccacctcccagggactgagtgccaaagcaaggaggaagattggaggtgaggctgtatggagacagccacaggctcacagagcttgtgctgagctctctagggggaagcttgatctgcctgggaagcttccagctcctacctcctgcagagcccagaatggtgtccaggaaatatgtggccattgagtggaaccagccttggcatggtagcctgcaggaacccgcaggctagagacatggccacatgagcagtgaggatctcccccgaggagggtctacagtgtcaagagagggcaagtccacttcaggatcaaccttcctgtggccccttactttccttggtccacctttccaggtcacccatccagactgtcaccagggatcactgccctgggcaccaacccaatgcggggacaagtagaaaaagagctctggggaaaataccaaagggaatagtcactcaattttattgtgatgataaactcctggcaaagttccaggcctctctctgtc

SEQ ID NO: 161615 - DNA, 293 bp, Homo sapiens
acttattctcagacatctaaaccactaacatccagactggggatcccaggagggtctacagtgtcaagagagggcaagtccacttcaggatcaaccttcctgtggccccttactttccttggtccacctttccaggtcacccatccagactgtcaccagggatcactgccctgggcaccaacccaatgcggggacaagtagaaaaagagctctggggaaaataccaaagggaatagtcactcaattttattgtgatgataaactcctggcaaagttccaggcctctctctgtc

SEQ ID NO: 161616 - DNA, 257 bp, Homo sapiens
ttacagtgtttccttccaccatctgataaactgtgaggagaatggataacaggaaaggtcaatttttcttccattttgcagtattttgcttgttttccgcatctcacccatctccagcagttggcgaacacagcccacgagctgccctcagagctcccctggccttgtcctgccttggccctttaatcctaatgtgcagctgttctccctgccttcctttccactaggaaccctcctggctctcttcaatgttcctt

SEQ ID NO: 161617 - DNA, 617 bp, Homo sapiens
gcttttcactttcactaacaaaagggtctacggctcttcctttgtgcttggaaattcaggagcacctcccactgcaaagattaggttatgaatctaacaaatgagaacccagtcttcaagtgcaatgtatttgcctatgatcaagtttgctagcagttgagaatctatagttttgcaacaccacgtgattctctctgctgtattctaaatcacagaatatgtggtattattccacttgttctatcacacctacttacagacatctcgatttctgagatgtgggctcatctctcaatatccttccagtgtcatttcaaatgttgcctgatctaactccacaacacttcaaacacagaacaccacctcttgtgctcctaagttaaacgtgatggtggattaatcttggtcctttagttgataaatcaaggtaatttactgctgctatacccatacacagtccctcccctgctggatctcatgcagtgtggctttgttgctttcacttatgattttgctgctttcatttgggtcaatatcattgtagttattttgtagacaaagtagtaaaaaacttgatttttccctatcctatatatctgcagctcactgatttaaaa

SEQ ID NO: 161618 - DNA, 620 bp, Homo sapiens
aaagcaaaaataaataaatgggactacattgaactacaaagatttgcacagcaaactaaataaccaacaaaataaaatgacagcctattgattgggaaaaatatttgcaaaccatgtgtctgataaggggataatatccaaaattaataaagaactcatacaactcaataataggaaagcaaatagcctgattttaaagtgggaaaagaacacttgtcgacatttctccaaataagacatgaaagtggccaacagatatatgaaaaggcacccaacatcattaatcatcaggagaatgcaaatcaaaaccgctgagatatcacctcacacccattaggatggctgttatcaaaaaaacaaaagacaaattttggtggagttgtggagaacagggagccctggtacattcttggtggggttatagattggtacaaccattatgaaaaataatattgagatgtctaaagaaatttaaatgagaaccatcatgatctgatcaagcagtccttcttctgagcatagacccaaagtaaatgaaataatcacctcgtaaagacatccacactcccatgttcattgcagcactattctcaatagccaagatatgacaagagcctatg

SEQ ID NO: 161619 - DNA, 305 bp, Homo sapiens
tgtcaagttaacctaactcgtggaacacagcattctggaatgtgacctggccttccagaaaaatcattaaacaatgtctactgttcataataatactgaaacttccaaaaaaatcacagccacttgtatgttcagtgttttacataaaatgcaacgaggtatgtgaataatgcacaaatttcacagtaagaactgtactatattttccaaaatgtcttctacaaatgcatttatatatgtataattctcatgccaaagaactcagcaaatcactttccaccaacaaatttagtacatacttacgg

SEQ ID NO: 161620 - DNA, 466 bp, Homo sapiens
ttttctaaaattctggatgtaagacaccaaattaagttttctattccccgagtagtgactcacgcgaacatggtggctgcagcgtggggcagtggcacaagtgtggaactcacagtgaaggggctgctctctgttaattgccaagggtttcaaggaagccacataacccctctgccctagccacactggtgttctttctgtcccagaacacatcaagcaccgtgctgcctcagggcctttgcacacactctccctcctgcttgaaatgctctcggcactttatatggctgtgtcctgtacatggcttaggtctcagctcagatgtcacttcttcagcaaagccttcctgaataccttgcctaaagcagtactcctgccactctctccacattaaccctgttacttcttcctagcactttgttcctagaattattttacttgtttgttttcgtctctcaccatacac

SEQ ID NO: 161621 - DNA, 301 bp, Homo sapiens
gttacttccaagcctggcagtcattcagaaattaagattcttgatcagttatgtattcctttgtctctatcctaaatttgagctcttagcctcttaaagtaaatgtcaacctacttagttcaattttctgccttgtcagcatatcattgtctcatgttctgcattaatgacagaaaggatattaaacctattaacactgagcggattctgcttttattgtcaatgaattcttcttctgtatcattctcttggcctaacttaactaatgcagagtgctgaatattgagtgctatgctaactt

SEQ ID NO: 161622 - DNA, 439 bp, Homo sapiens
ccccctcaggggggaagcccctttccaacaactgatgtgaaaaggctcctgggccctgctcgcccaatgcctgggccaaggactggccattggagaggagactgctggcccctgtgatggtgaccttgagccctgtggccctagcctgggacttgagagggctcagctgttgagccagagtccagagatcttacacggaaagcactttgagaccacagatgctccaggaagtgctactgagtagccatccccatacctgccagtcactcagacaatctaggtgtggagggaggggcttgggctccagagtctggaaggcccagaccaaagaggctcctggttcctgcggtccagcctcagtgggatggagccacatggagggtgatggtggaggggaagcacgggtgagtcagtacaggccaggttttgttgcagtgac

SEQ ID NO: 161623 - DNA, 303 bp, Homo sapiens
gactaaaatagacactgctaatcattggtggggggtctggggaggagacagtaactttccctgttctccaggagttcacagagatagaaaaataaataaatgtgacactgtgtcatatgttttactggaaatgaatatacagttggtgagatggaagctcagaagagagagaggcaaattcttggtgagggagggtggtaggttaagagacatcccttggaaaactaatggttctgctgagtgtagatgggtagttgagcagacaaccaaattgattgggattggtgttggggtgcagggaga

SEQ ID NO: 161624 - DNA, 409 bp, Homo sapiens
tccaattcaggcttttgaagacatactgtatacacatgatcaatgagcttgtagtgcagtgcgccacccctttatgaaggcctgtgacgtcctttgtgatccggctactgcctacctttccacccagatatctctgcttcctacttcttgagtactaagttgcagttacaccggtctccaatttcatttcctgatacacaggaagtaaaaagtaggcaggcgttaaattataaagatcatgcactttttgaaaatacctgtggtaactttatgcaactttactttgtgtgaaatccatcaaccttcatcttctccctcttaagatttgggaatatctttcacgcttggagattcataacatcttgctcacacttatgagaaacatctgtaattttagtacaacaatcat

SEQ ID NO: 161625 - DNA, 452 bp, Homo sapiens
ccctcacattcactcaacactcactcactgactcacccagagcaagttccagtcctacaagttccattcagggttaagtgccctatatagttgtatgattttttatcttttatactgtatttttaccataactgcctagtcagtacagtaacatgacgtacaggtatgtattctggaagcaacagaccataactatctatgtttgtgtaagtatactctatgatgtttgtacattcacggaactgccatttctcagaacgcatccctgttcttaaatgatgcacaactatatctactgtcactctaagtcaataatttcatccaacagtgtagtaagaagttaattaacaactacgtgaatggaatagtttagaactggtcatgctttacttaaatttcaatataactgagggtaagtgaaaaggaagctttagaacctgagcgctctcgtc

SEQ ID NO: 161626 - DNA, 379 bp, Homo sapiens
agagccgccatcaggcacacacagagtcccaggaaacttggatccccaggtacccacaatcccagaggctgcagctccagccatggcttcctcatatgactccaagatagaggtggaatccacagggctgagcagcagacagatggcaagcctcacctccactgcatctcaccagacaaggcccactggcctaggaccctgtgcagctagctaccccaaccccacctgaggtctcagctctgcccttccctgggatggggctcccagaggtagcaggtgggccactctttttgctgccctaaagcccttgctcctcttgccctcagacttgggatggagtgcagtgattaggaactaacagggacccacagcacaggat

SEQ ID NO: 161627 - DNA, 311 bp, Homo sapiens
gcaccatcacgcccggctaatttttgtatttttagtagaaacagggtttcaccatgttgaccaggctggtcttgaactcctgacctcaggtgatccacccgtctcggcctcccaaagtgctggaattacagacgtgagccaccacgcctggcctgagtgtatttattttacatatttatatttgaactgaaacttttatgaaccattttatttaatgcattctgatattttatattatttcattttaatttttttccaaacaaaacttctcacatatttattattgaaccaacctactattgtagagctta

SEQ ID NO: 161628 - DNA, 304 bp, Homo sapiens
tatacaccccccacagacattaacatgtacggatgatcagaagccgaaccacctatgtgagctgcctgcctcttgtactcacacattccatccttacacactaacagactcctatactcctagtggtcatatctgtactactcttatgtataaacacacactctttgtagttctcacttgtctgccacactgtggcattcatacccagacccctgttgcaaatcttcacacagagcagtgttttcacacagacacgtgcatctacctgctcacacatgtgtgtatacccaccaacatttcactt

SEQ ID NO: 161629 - DNA, 229 bp, Homo sapiens
attcaaattttcatttgttgtaagtcatttcactgcctgactcagtttaactcggtttagtgccattcctgtgtagcttctgaccaaggcaaggcactgcttgcttcctaacttgcttcaggctcaaaattcctggactggttcttcaggaccccatgcggtatgaccctagcctatttatgtaaattaatgcttattctttatccagttaaaacctccataacacaga

SEQ ID NO: 161630 - DNA, 373 bp, Homo sapiens
taccatcctttctatccaacgtgggagaccgggcctacttagagaaaatgctgatcctataaaaattggcttcatgagactgccaagataaaaggattctcagtgcaggacggggagagaggaagggccaatccatcatccaggctcattaagcaactatttgtaggacactgtgcccagcgtcttagaaacaaagagcagcctaagacacagcccctggctcagcagagagatgaacacataacctcttggagagagaggcgtcaggcccaacacaggccccttgagaggaggccgggatgtatggccctagtatgcaacgtgttggctgggaaagtgaagaaagcttgttctctccctgaccaggctacag

SEQ ID NO: 161631 - DNA, 237 bp, Homo sapiens
tcaatcattttatcatagttcagtattttcctttcggtagctaatattgtcatttgggtcacacattaactgtacccttttagttttttttatagagtttgtttttcagaaaactgtttaaatatactttcactaaagttgtatgtaacatagtgttttgaagccaacagtggcctgattggggaaagatcagataagagtattgggtttacttttgccacacagttagtacccttt

SEQ ID NO: 161632 - DNA, 163 bp, Homo sapiens
aaaaatgactcattgctctaaagtaattatatttccattaaaaaaaaaaaaaaaaaaacttctgcaagtgaatgaggcaggaagtgtcctggtaactgtgcaaaggaaaggctgcagtctttgcataacctgtttccttgaagtgtcagagaaatacacaccg

SEQ ID NO: 161633 - DNA, 633 bp, Homo sapiens
ccgagcctttataatggttcccaggattgaaatgtataaatagttcccagggttgacattggtgaattttgtttggcagtattcagtaagttgtttatgaaatacttttgaaagatttttggacacagtttaacttaaatttgtagtattgcttcttctaaaaattagagcatattccaaagactctaacccaatttgtgaagaaaatagataagtttagacttgagtttgaacgaagaaagtatataaaaattaaaagctatttctatttcctgcctactggagttcagaaataaaatataaacctcagtggaaaatagtaataccttcatatttcattttcaatcttgaaccttgagtgatactgtttttttcccaagtttaaaaagttgtggtaaaatgcacacaatttattgtcttaaccattgcaagttacagctcagtaatactaagtgcattcacattgttgcgcaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcacca

SEQ ID NO: 161634 - DNA, 521 bp, Homo sapiens
ccctattggcataaattgttaacactgtcccttaatctttttaatctttatggtgtttttcaatatgctcccccttttctttcataatattatttctatatacttttctttttgtcttgattaatcggccaaatgtttgtctattttattacaaaactaaaataaccaaaacaggctggtactggcataaagataaacatttagaccaatagaatagaattgagactgcagaagtaaactcatacatatatcttcaattgaatttctacaagggtgtcaggaccataccatcagaaaataatatttttcaacaaatcactttgggtcaattgcatagatacatgcaaaacaatgaagctggactcctaacacatactatattaaaaattaacttcaattgattacagacatgaatacaagagctaaaactaaaaattatagaagaaaaagtaagagtaactcttcatgacctttaatttaacaatgaattatcaataatgataccaaaacacaagcaataa

SEQ ID NO: 161635 - DNA, 427 bp, Homo sapiens
aacccccatcaccctcagccggaaaatctcttggtcccctggtcacagtgattgaagtacccccgaccacaaccacacaacagggagtgatgtgggggagtcctgggcttctagaggctggttgtggcttcctgcctcagtttctttgtgggcaagaaggcaccagaggcctgtgacctcccctgctctcactgggactggcccccatcaggtttatgcagtgaggcgcagaccctcagcaaccgtgtcctgggccttctccatccccaatccctcccatgtcacctcccgtttcccattactgccaagctccagtgcctggggcaggaggacaacccatgcagccagccaggccatgctggcagaagctgctggtgggggcatctgggcatgctcaatggcaccccaagagctaaaatggactcta

SEQ ID NO: 161636 - DNA, 328 bp, Homo sapiens
aatgatatatctaaacattcagtataaacctgatctataacgatactcaaatattgatgaattgataaggaaactgccatattacagttgtaaattactaaggcacacagaaagacagaactagcttcaatttggacagtttataagggaaaaattcaactgtgatacctaggtagtacatatattagataacaaagacaattaacttccctatttgggtcatttaagtttctaattaaaggtgtacgacattctaaaccacttgtctttcttcttcaatccccttcttacattttcctgcttccatttccaagcatgcaatctccct

SEQ ID NO: 161637 - DNA, 773 bp, Homo sapiens
agaaaagacaagctttgctgtgggtcagcaacaaggagacaggatgcagctcacatccatctccccttcctggccttaaggcagtgccgtcattaggaaaggtctggggtgggttctgggattagcgggtgattgccggagggaaaggggaggtctgaaatgtcccctgggcatgtgcagctgtgtcttcgtgcctctgcagggtcacatgtgctgattcaggggcagtgagtatgaacgtgaggtggaaatttgggccgtgatgtcagcaagctgctgcccactccagccggccctttgggtccccaggatctcaggcagttttattctcacaaggagggaatttccagcacgctgctgctgttcttacctgccgtcatgtgagctcaggaatccccgctgtcagtcaccggtctttttaacccttcggggcacggtgtcacctcccctccccggccccagctgcttctcctccagagctggattcaggactgaaggagggagggaggcagcaccgaggccaggtctcccacaggcaatccccagcacccgcgatggatggacgagggaaggatgttttgtggaaacggtatttcccaaacattcctaaaaatcaagttttagtgagttgaacataactggtcttctaactactgtatattcatctctgggtccatagaagagaacagtgtttctgcatctccccagatgtgagacggctcctataaaaccctcaccgaacttccctggtgcagggtcttaaaaggcggcca

SEQ ID NO: 161638 - DNA, 159 bp, Homo sapiens
cttttcttttacccattttagggaattcttaatagcgtgcacatcaagcttttttgccttctcaaggagggtttcctcatttgaacttaatccccttggtgcacaaatgctaaaattactagtgttaatgactgaaggatgcgctaacctggattgaag

SEQ ID NO: 161639 - DNA, 570 bp, Homo sapiens
cagatcacctctctggtcttaaacaaagaaccctgaagtcttcccatcccagccagactacaagccaagaccctaaaaaagggcacaacattccatataatcaaccctctgccatccccccattacccagacagcctggtcccttatgacttccctcatctctcactatgctccagacatgctgatatttttattctgaaagcctgccaaatactcttggcctctgggcctttgcacatgctgactggaatatttccacaccccaatctgatatccaaatagctctcttttccccttccttaaggtcaactcaaaagtcagcttctcagggaggtttttttctggccacattcaaaaaattaaccttctgcccactgtaatgccaaaaccttatactcttttttcctccctatacttgccatcatatgacacaatatatgtctacttatctgttatctctctcttctacaagaatataaaccctatgcaggcaggtatttctgtgtgcactgttccctgctgtatccccagtagctagcacctggcaaaaagagaaaagattagagaaaa

SEQ ID NO: 161640 - DNA, 597 bp, Homo sapiens
ttcaaaatgtcagagttgtttgtacaagtatgccttctagaatatctaaaatagaagcctttgttattgattcttctattatgtttcgtatgatattcaaaattaaagtattttcagaaatactctcatgcaagcaaaatacagagtggaaaatgaacaaaatgtgaaaaacacatgtgaaagcattttattattaagcatctaataagtgcctgcttcttgtttgaaggtaggggaggaaggaagtgggtggcacttgtgtttggtatgttttgtggcacatcaccctctctgattggataacttgtcaaatctcagttgttttttaaaagctaagaggagtgtgactggtgagatctgcatttaggttttgaattgtctgtctgagttcaggcccagttattttatatcactgcaatgttgaaaatcacatttgatgatctcaaaggcaaatgttatagcttaaaaatgaaagaaaaatcagaatcaacccttctcttctccctattttgaaggggtaacactatagcctttaaagctaaaagggggaggaaagcttccctctggtggtaagcagtttgtgtacatttttccagg

SEQ ID NO: 161641 - DNA, 339 bp, Homo sapiens
accaagtctaaaagtggtattggccaggtgtggtggctcacatctgcaatcccagcaccttgggaggccgaggtggatggatcacctgaggtcaggagttcaagaccagcctgaccaacatggtgaaaccccgtctccactaaatacaaaaaggactcaggtggtgtgcacaccacctggagaggggcgtggtcctctggatggcccccgacgggctctatgcgaaaagactgtgccagagcaggatctactgggacgggcccctggcgctgtgcaacgaccggcccaacaaactggagagagaccagacctgcaagctctttgacacacagcagttct

SEQ ID NO: 161642 - DNA, 1290 bp, Homo sapiens
agaataagtatgtatggctcaactttagtttcttaactaatttggtttgagatgatttgataaatgaatgtattggaacaaaatgtaataaatagtaccagaatagtatatctataaagtttatgctgatattttttctttagcttttgtattccagtctatccttccctaactcaccttccaccccgcctgcaaacatggctttatttatttttatttttttaagatggagtctcactctgtcgccgtggctggagtgcagtggcaagatcttagctcacagcaacctccacttcccgggttcaagtgattcttgtgcctcagcctcctgagtagctgggattacagttgcccactaccacgcctggctaatttttgtatttttagtagagacagggtttcatcatgttggccatgctggtcttgaactcctgacctcaggtgatgcacctgcctcagcctcccaaagtgcttagattgacaggcatgagccaccacgcccagccacaaatatgctttattcagtttaaagtgtggatagtcgttctggctaattttgggcttcctttaaagaccatccagggcagtctcagccttagtaacagcggatagacacaaattttcctttataaatggatagaataattcacttgttacattgggagcatttatttgagaacagactcctcaagcacttgtggttacttagactttatttaaaagttttttctctatgtggcggggaaaactctttttaaaatttaagatatgccccatgagagcatttatttctacatcagtggttctcaatggggagcttttcccccaggagacttgacaatgtctggagacatttttggttgtcataactaggagggtgatgctggcatttagtgggtagataccagaaatgtagctaaacatactataacctccacagcaaagaattatccagcataaaatgtcagttgtggcaaggttgagaaatcctgttctacactaaccgtaatttttagtccattgtgctattttgtaaatccattactccctacatgttttctgtttttccattgttacaaactagttggatacttcctgaaaaaaaaacaaaatctcttgggctcatatatggaagtgcagtagagctgtgaggacttctttcgctatttgaggctgatctttatagttggctaaatagctcagtagtaattttagaactcctggctcacttaaaaggttgtcaagcccaaggaatctgatccagtctaataagatccactctaataaaat

SEQ ID NO: 161643 - DNA, 292 bp, Homo sapiens
acttcctatctaagtaactgaactacagcactgtcacaacgctggcatgacatagaaggctcgccacatccttcatgtgtttagatttactcctagtgtgctgtggggccaaattgtggactcttttttcctatctctgttctttctagatgatcttgttcagtcccctagctttaaattctatctgtaggccaatgacctccaaatgtatatccatagcccagaccgaccctccagactccagactcacagagctgactctctcatacaacttctctatttggaatcctaa

SEQ ID NO: 161644 - DNA, 249 bp, Homo sapiens
tcacgccattccccggcctcagcctcccgagtagctgggcctacaggcgcccgccaccacgcccggctactttgttctatttttcctagagacgggctttcaccctgttagccgggatggtctggagctcctgacctcgtgatccacccgcctcggcctcccagagtgctgggattacaggcgcgagccaccgcgcccgcccggcctgctgtaggcttttgtggcttccccgctgcctcccttcccccc

SEQ ID NO: 161645 - DNA, 216 bp, Homo sapiens
gactcccttcccaaggtatagttggatacaacccacttgacttgccttaaagaccccaccctctcagggactgggctggtctatgcagcagtgaccctttctcagtcacacggtgacctttggccctcatgcatcccccaaatctcccagttagaacaccctgtggaaaacctgcttggataacgacctggattccaattaaggctttagtcccgc

SEQ ID NO: 161646 - DNA, 333 bp, Homo sapiens
ttatatgtaccatattttaaatccccgccccacaaaatgctgctaattaaatgatgacaggcagtaggggtaaatgtgcatcctagaatggatggaatacaggatttattcacctgttgatatattatctgtctggcccccacttataaatgtaggttctctgaaagtaagggcctcgactagaccatggctgaatgccctgacaagagaaggtgctcagtaaatccctggtgggtgagtggagaacaccttccaatccccgcagcagctctgtgaggaagagatggggctccccatttcccagatgagcactggaggctcagtgaggagcgg

SEQ ID NO: 161647 - DNA, 527 bp, Homo sapiens
gaatgagtattaaaaaagttgaggcaggatgtccactgtctgagctggaaatagtcttgcaattaaggagggtgaaaagaagcttggcttgagagaaacggaagagggagttgaggtgattgacgttccccaaggaccctcttcatttgtgtttgtttcaaggctttttctggtgacatagataattactggattgaaggtctctattttgctaggctgtttatgaggagattactaaacaaaagataagagaaagtcaagagctgatgaaggaaagtaatctagcctgtcttgctctctgctttagatggaacacgtgagggtgaaaaacagatcattgattccagttgatgtttataatatagaaatagcagagttatcctcctttacagaaatttcttaaatccattagtaccttacttaggtggacttgttcttgtttatgagattgttcacatgagtttgcggtcaagaaaggtgagccttctgcttttaggcttaatatttgcaaatccctgtgaaattta

SEQ ID NO: 161648 - DNA, 427 bp, Homo sapiens
tacatgtgcttgctggatgtggtagccgttttcaggtccctctgggaatcgaacctgattccccgtagcgtgatcccaagtgcgtgtgacattaaatattccttgaaggaggaatatttaagttaaaaacagaaaggtaaatagagtaaaccagaagaggtagggaaaagaatattccaagctgaggaaacagaatgtaaataggaccaaaggggaagaactttctccttttcagggaaaggaatccaatatatctagagaaatggagttcttcagataatgaagtggctttggagcttcatcaataatgtcggactttattttaaaagcaatatcacacgcaattgggatggtcggcagaggtttccaggggctaacgagaagatatgtgaccactagagcagaaagcatcacagcatccgagggt

SEQ ID NO: 161649 - DNA, 123 bp, Homo sapiens
tatcaaaaaaaagaacaacgtacaatcaaagtcctcggccacattgtagaactttgggggatgctcgctccaaccgactgctgtcaccttcaccgttccagtttttaaatcctgagtcaagcc

SEQ ID NO: 161650 - DNA, 470 bp, Homo sapiens
ggggataggggagtgggcacagtttatggagatagaaaaatccacaacagcttagagtggcagaactctactagtcttctgtaactgcaacaagtatatttgaaaacaggttcttcatcctaaaggctatggagcttttaagggttttgaggaagttttgtgtcccctccttctgggacacagagtccagagcttaaattgaatttaaatatttctaagaagaactgaagtccatttcatacttttgcatgacttcaagtttgcatttgcggcagttccattccatattagcataccccaaaggcatacattctgtggagaaggcagagattgaaatgctattaaggaagatcattgtttaccagtgggtcaggtggccagaccccattttacagcccatctgtcagccacagcaagccaatccgggaagaaggaacggaggaagaaaaagttagagtgagaaacacctg

SEQ ID NO: 161651 - DNA, 552 bp, Homo sapiens
caaatagatatgtgtattgtaattaaaaatttaccatactagagttttaaaggacattctttcccaaagttgaacccaaagtcccttgcttatttgtaaatgtgtatatttatattttatctattcttctaaaactaaaaagaagtttttttatttgatgttattccttttcttttttagcaacagcaacaaacaacagttgagtttgtcatttgagctgttactgtctttattgaaaataataatgtctgtgcttaagtatttaccataaagtgctgagcccagtactgtgctcatctattgacccacattatctcatctgtttgcaacaaccctaagagatgcattctcttaatccccgttttacataggagaagactgattcttaaggacgccaactaacgacccctcttctagagagtggggaaactgagattcagctcccagctctttgtctcctaggcttgagctcttcatcttactatgctgctttttccctcaatttctttttcatgccttcctttgattactttgtgctgtttttaattcttg

SEQ ID NO: 161652 - DNA, 329 bp, Homo sapiens
tgagttagcatttaaatgtgagcccttaaaagagaccaagtgtcactgccccattatacacatatcatgatttaagcacatatgaatataactgcaggctgtactctaaataaatataaacaaacatcaactttaggagataaggtgataaggtaaaactggacaatggacatttatttaatatctattatgtgcttggaaatttgaatcctcacaacaactctgtaggacaggtgataaaatatttcaagcccaagcaatggcaatttgaactatgtagtcatagaacaaatagaaaatgttgaattcacatacagattggtcaggca

SEQ ID NO: 161653 - DNA, 281 bp, Homo sapiens
ttccagatgtttccagggcagcagccaactcttgttctggcagccctgatcacactgcagtaattacattatttgtggcttcaattttaaatccattttctggtcattttacagtaactcaatggttcacagtcattgcaggagtccacagcctgaatgctgtccccccactccctttccatggcaattgtagttatggcaaaaattatcccaatcaatttgtgtcttaaaaggaattgagcagcccagagaataagtgaaggcggaggagcctggggagc

SEQ ID NO: 161654 - DNA, 176 bp, Homo sapiens
tgtaaaactgtagtacattgtcacaagcagagcattgatagtgatatggtctgcagatcttatttagatttcctccagttttactgtacttatttgtgtgtatctatagttttctgcaatcttactatatgtttatgttcctgtgttcgccaccataatcaagatattaacagttt

SEQ ID NO: 161655 - DNA, 485 bp, Homo sapiens
acttcccttttggagcagaaagcaggtgcttttaaagggggacttggcatgttagatgaacttgccctgtagggagtagctggtgaagggaggtaaaaggttataattgcatttctgaagagctaagtaggaagttgggagcagggggaaagcagaaagaaaaaagaacaaataataataatttaaaaaataactctttttcttagacaaacgggagtactcagttacactaatatcctatataagcaagcatcatgtttgaggtaggggtgttcctcctcttgctttctgaggacatcttactctttaataagagtagtttctaataaaccatcttaacttcaccagactctgtgattcaccctgaattctttcctgtgtgaggtccaagaacccggtctttgggtctggtctgagacccctttacagaaacacacagacatcaacctgctctcacatgtgggtggaatatgctataccccaca

SEQ ID NO: 161656 - DNA, 355 bp, Homo sapiens
acctgctcacctgcaccgcgggtggaggtgtcaggcagtgaatacgttgacccgacctgtccctctctccagaataacttcacctgtgttcttgtaccagttaaataccaagacagcagttggtgggattttatcatttattttagaaagacaaagcaggtcatgagatggtgttggaggagaagcatcttgtggtctcagccaagcctgcgtccaggggcaggtggcatgcaacgtatcctttagctgacggggtggaggtgggagaggctcacagtggagctgccactcaacagatgggtctgcacatcgtgtttcaaaagccatacttcgtgcatgagcgagatgggtaaat

SEQ ID NO: 161657 - DNA, 470 bp, Homo sapiens
caatccagtgctctcagctgagatggcagatctgtcattaattaaggaaccacatacccaggcaggccaataacatggatatgatcacataacattaagtccatgcactttaaaattatgttcaagttttgtaatcatcatgatcatctctgtgttttgttacctaaggtgtctcagagacatttaaaaggccatgggatattagcttggtggttttaatttgaaagatttaagagaatttgaggtgttcttgagaatcctgatttagttcaaataagtttggtgtatttgatttaaaacagttgtttacgctgggcgctgtgtctaacgcctgtattacagcactttgggaggccaaggcgggcagatcgcttgaggccaggagcttgagaccagcctaaccaatatggtgaaaccctgtctctactaaaaatataaaaattagctgggcatggtggcgcacgcctgta

SEQ ID NO: 161658 - DNA, 141 bp, Homo sapiens
gatttttggttcttatgaaggtgctttcttgtatggatagttgttcaatttggtgttcctgcgggaggatgatcaatacaggcttctatttggccatctttctccacctctgactataatccactcttaagtctttgttaa

SEQ ID NO: 161659 - DNA, 236 bp, Homo sapiens
cttggatgaattcatttttctaatcttcaaagaatcaaatatctttatagtgtccctcaagtgagtaagactttatttcatcataagaaaaaataatacaattttaaaagcttaaggttgccagcaagacacaccctcaatgttcattctccacatacagcttgctctgatttatggtgccagtacttttggccacacaattcactacactttgttctcctggttactggtgtcag

SEQ ID NO: 161660 - DNA, 492 bp, Homo sapiens
atgtcttagacatttgggaaccatctaggcaagatcctgttgagttctgtgatgctacggatggattggagagaagaaatactgtgttacatttcagaaaggctgtgaacccaagtatgctgttctattacagctttagttttccttacaaatactctcatagcagctttgaaaaatgaaagatctcagggtagcagaaaatacagcaaacaacaaaattctttttaatgaaggctgaagtcccacgtctgcatagttagtccctaaatggaattttaatttcaccttaagacctaccacaaatggaattttcaagcagcagaataaacaacttttaaaggaggattaagacaaaagaaaatcatttactaaactccttagggaactaaaacaccttctaaaactatgttcactggaaagctatcttttcagaagcctatagaacacagtctaaattctgatgagcaataactaagttaagctgcctgtgta

SEQ ID NO: 161661 - DNA, 336 bp, Homo sapiens
ttaatcaattatttgttgcttttagaaaaggttgtgcaaaaacattagctaaaactggttaaaattaaagcacagggaaagaacttttctgaaagatattaaacatactattaatttattttaaataggatggattggtaaaaataaaaatataaaagaacttaagtcaaaattcattgtttaagaacctaacaatcataaagtcatataaagtagtatgcagtaaaatgtgggaaaactataaaaatgttaatttttatagtaacttaacacaacaatttaaaaaaatggttgcaaatggctgggcatagtggctcacgcctataatcccagcac

SEQ ID NO: 161662 - DNA, 254 bp, Homo sapiens
atatgaagatcaattaagacaaggtccctgccctcaaggagcccaagtctagtagagccagaggaagtgttaaacacagcatagtaagggagtgtagattctgtgctgggcccagaccagcattaagtcctggcccgggctaggggagacagggagaggttggttctccctggatcagggggtgcctgggagtggatgtaaaggttgatagagaaggtgacctggagctgttttgggagtagagagtagagcgg

SEQ ID NO: 161663 - DNA, 235 bp, Homo sapiens
  misc_feature (198)..(198): n is a, c, g, or t
tactagggatactttcccactggggtatggtgaagggatgattagggtctggtgctggttgtcaagccatcctactgactgctggaagaagcgtcagaagctgggcttcctttcttatttcagtgtagagctggcagatgaggtgcaagctaccccttttgaatgggttagacttcagccttttttttttttttttgnaaagggtttcccctttttgtggccaaggtgcttaaga

SEQ ID NO: 161664 - DNA, 444 bp, Homo sapiens
aatcaaaatataattttcagaagtattcaggaccaagaaaacgtaattgctctgacaactgagagacctggaaaaacttttgtaaagttaacacaagtattgctgccatgctaagaaaactcctttttccacatcagctaccctaccctatctacttcaaataatcaaaacttcttgccatccgctcctagtgccaatactttcccatctaaaaatttgcgtttgatccttcctgtgatggatagtgctattgctaaatctatacttccaggaaactagaaagaattttaaattgccacttctgtttgctaacatcttcatcctatttacctactcccctccaaaaacagaacggcatttcaccttatacactctgacctctgccatagggatgcctttgagttggattaaagaaataagacaacttcctttatatcggtgact

SEQ ID NO: 161665 - DNA, 501 bp, Homo sapiens
tcttttccacaggaatggtaacattagcaaggcacaatggatacataactaagagagtgttactattatctataaagtattattaaaacacttaaattcttctgttacaattggcaagtcatataattatctaatgtaaaaaagtacttaagctccctgaaatacacatattcaaaagtgggtttcctttaaaaatgttaactcagaaataaaaaaaaaggatatattaaactatccttaatcacaatgaataatgtaaatatttctattatccatcacctctctaccacctacaggataaatttcaaactatcttagcctggcatttcaagctctttataaatgggtcacacccacatatacacttcttatattaggcctctgcagtaatcaggttaatctactcatcgactcagtgtctcctaagaacacattacataccacaaacttaggcttttactcatgtctttctctttgcacctctgtgaccctggaaaagta

SEQ ID NO: 161666 - DNA, 366 bp, Homo sapiens
ttgatgggtgtttagaatagttcctatacctaccaactacactgcagaacatgttttactttgccctaacctaaaggcatgggcagtcatagcacattgatgtaaactgcaagtgccctcagagaacttccgtaaattcagagggccataagagtcccacaggtgtgccctgagcctcagcagccaagactgagggccactgccccccatttcagcctctatttgtattaaaattgtgaagaggccctgttgggtctgggtacaggccctttcccaaagctgcatcttagcattctcttcagcactgtttattgagttggcctggctcactctgccaaagcctccttatctttccaagctgactcc

SEQ ID NO: 161667 - DNA, 427 bp, Homo sapiens
cttgaaacatcgtgtctggcttcagggctgccttgcctcactcttgctagctgtttttgctgagtctcctttgctggttctcctctctaaaatgttggaggttcccaagaactcacttcttgcacagctttttcacctgtacttagaccctaggtaatttaaccgggtttcatggctttaaatgccatttatacaccgatgacccacatttctattcccaacctagacctctctcctaaggtctgcactcatctatccagctgcctctaggacatcacgcggtgcctgcacagcacctcacactccaggtgtactcctttccattacaggacgtggcaactgcaagttgctagtcacttagacacacaacagtagatggttcacaactcctcttcttcacaccacatatccaacttgtccacaaatc

SEQ ID NO: 161668 - DNA, 288 bp, Homo sapiens
ggtcgatctagagcgatccctgaagctcacccactcagtcactcactcagtcactcactcactcagtcaatcactcagtcactcactcactcagtcactcactcacccactcagtcactcactcagccactcactcactcattcactcacccatcagtcattcacccagtcagtcactcactcacccactcagtcactcattcactcactcagtcactcactcacttggtcactcagtcactcagtcactcacctactcagtcactcagtcactcactcagtcactca

SEQ ID NO: 161669 - DNA, 268 bp, Homo sapiens
ctgcttcttcctctgctcctggtgatgcaggatgcccctttgcagaacaaaagtgagaaaggcctcatttgttcttaaaggagcagatatgaaggtcaccagttcagtccctctggtgttccacaaaggcgccaatgtgttacttttcatgaaatgtcaccatgaacccaccccttaacctgttcctcatggctcaccattctttcccattctctttgtggatgctctaaatgtgtaatcctgagccagcaggagccttggcaagttg

SEQ ID NO: 161670 - DNA, 213 bp, Homo sapiens
ccttttgaggaggtaagaagaatctcttctctgtgataccaagtgcaagatagggacatgtgtgaagaattgagttataaacaccagccttttcctgaaaccaaaagtttctcaccagagctagaaacttggagagagaaaacagtatcttgcagtagtatcttggtttctttgggcaagttagagagtgagcaaaatggctaatctcaatac

SEQ ID NO: 161671 - DNA, 328 bp, Homo sapiens
cagaacctacggcttccattttggagactgatctccctttatcccacatagttaattaaaatagaactggccatttctacccttgtcccccattcccatccactccagaggatccaaatatggcccatcagagttaactcctggacttctgctgaaactatttggaaagaaagcttttctttgagcttactaaactcagatataagcctggccctgctgtggccgtctttgtcaccacttgaggagataatgcctaaaaatgaatccaatccagaagaaagcagagctaagataaaacgaagaaagacagattctggctaatattaca

SEQ ID NO: 161672 - DNA, 343 bp, Homo sapiens
cacagtgactacctggaccaggaagttcatgaccaatcgaccgttccagaggaaacaaatggtcaccaatgtccttcaccccggaaaggcaacaaaatgtacaagaccacaatggatgtcatcttcatattaatagttggactcagaacccattttggtggtggttaaacaatcgtcacccacattggagtgcagtggtacgatctcagctcaccaaatctctgcctcccaggcttaagcaattctcctgcctcagcctcccccgcagctaggattacaggcacgcaccactactgcctggctaatttttatgtttttagtagagatggggtttcaccttgtt

SEQ ID NO: 161673 - DNA, 222 bp, Homo sapiens
ggctggaaggggcaaatgtggctagaaaagggcaaagggccgatccttgcgattatggaactattcagcaccgcaacacggcagggacgggggcccccagtggtgaacacgcacagaactcaaatcaatcaatctctctctctaacacacacgtacaagtaaacttcaggcaacctgagtaagaccggtcagcgataccgtgtccacatcctggctgtgacg

SEQ ID NO: 161674 - DNA, 404 bp, Homo sapiens
acaatgaaaatgagcatcagcctccagtaattctaaattttatctacaagtgtattcacaacttactttttgttattttttctgatgattagccaaaggtcagggatgattggcaggtacaacagttcaaatagaagtagttcacaaactgcctgtaagcctttcttgataaacgttttgatgaattagtaaataaagtgttttattttatacagaaatctctgtactttttcatatttgatcatttgtgcgtccagtgacatattgtagacatatacattcactgaacttattactggttgccaagatagtaatagcaaaatctcaaaagctgcatgacaggaattattcaaatagttctatatactgataaatcaaggtttaactatacaacaccctctagt

SEQ ID NO: 161675 - DNA, 409 bp, Homo sapiens
gctttccataaggatgcagaggtattacctgagactcaatgactgtcaggaagggcctttcactaatctcagtgttatacatcaagtgactatttttacttgtatttaattaagaaaattgttctgagcagagtattttgaaatgtttgtgacagctacaaaatcactccattactcttgtgtcattctcttttgtgagagaagtactataacttgcacaactaattttttttgtttatcatgtgtacaactatctttttggacttttagaatattgtaactcaagtaactatgctcctaacagtcctttcaaggttcctgtttgccaatgacaaaattatttttatttcagtagcttggtagattgatggtggaaagaataaatattttataatcagatagacctgaa

SEQ ID NO: 161676 - DNA, 600 bp, Homo sapiens
ttttgtatttttagtagagacagggtttcaccatgttggccaggatggtctcgatctcttgatctcgtgatccgcccgcctcagcctcccaaagtgctgggattacaggtgtgagccaccgcgcccagccaaagttacatgtttgtaccaacttctggagtccgtttcaggatgacaaatcttatatcccgggggagtgcttccaaattgaggaagttctcatcttccaaatttgtttctccctgcccttgactcaggccctcagatccagccccatgaggactctccccatccctgctggtccatggagactaggtcctgtagcttctttggagcaaaggatcatccctcccttttcagactagcacatacccagctgggacacactgtgacttaaccctcgttagtggcctactggccagattgtgaggtggaggaagagctgaggggggtgatgtggttttgcaggggagtggcctctgcactgcctacaagcgagagaagaatgcttcctaaatagggaggggggagccagttcggcagacttggaggatttgggaaaatctggtgattcaggatttgagggtgcatctagcccca

SEQ ID NO: 161677 - DNA, 319 bp, Homo sapiens
attggttattagtaactcaatagacttaaaaaataggcacaggttgcaagggaaggaaagataaacatttgaaattaataaatacactaatgatttagcacttgcagctgagtttacaatttgcctagtttgttacttcccggtgatacagcccagggactgctgtaaccacagtgccacaagctggtatggccccaagcaataagaaatgtatttcctcgactgttacgggaggcttgagagcctataaatccacggtgtcacgcagggctgggtccacttctagaaagcctgggagacaagaatcgtgttctaacga

SEQ ID NO: 161678 - DNA, 284 bp, Homo sapiens
cagtgtcgattaacatcagcggatgatgtcaccaaagtttccatcattcctcttaaataagaacaaagacactatggttccttttatttttgaatctcattttatacgatatattccatttcagagtaaataacttacatgcgtaattgtttcattttaccagaaagatatgattggtttcgggtcttagctcaaatagagagcagagaatttattctgttccatagcaatgtgaaaatggttaaaatatgaggtgttaagaaattttacaacatatcatttga

SEQ ID NO: 161679 - DNA, 303 bp, Homo sapiens
  misc_feature (33)..(33): n is a, c, g, or t
tgactagaggaccccatgtgctgggtcttacanagcatgatgccacagtggaggcagaacgtttcagccaggccaggcgaatgatgagggaggctaatacctttggtccagcacggcatcgtcctcgcatatccaagggcggtgtctccctttcagcatcatcactgaacaaagtttactgatcttttctctctcctttactaactagaacacacacaacctctttaacaactggaatctacccataatctgaacatggaatatggtgagaaataaggtatcacagtgccaagcaacagaagg

SEQ ID NO: 161680 - DNA, 296 bp, Homo sapiens
gtatttttagtagagacggggtttcaccacattggccaggctggtctcaaactcctgacctcaggtgatcctcccccctcggcctcccaaagtgctgggattacaggcgtgagccatggcgcctggcctgccccctctcttgagtctttacctgccatcttctctgggtctctgtcttcttctcggctcttcccgccgcagctcccttctctgtgtgcctgtacttcttatgggtctttgacccccatcttttgtagatgtagtttcccctttctcactgtctttttctccctttc

SEQ ID NO: 161681 - DNA, 113 bp, Homo sapiens
aatgaaatcagggtttttatgtttctgcactggtttctgaaacactatttgaatgcaaagttagagtgtctgccacttagttaccatttgttgactattaagagggtagaagg

SEQ ID NO: 161682 - DNA, 933 bp, Homo sapiens
gttgtattctagcatttttggtgaaattgtattagaatacaaagagttttagcactacagaggaaaaacactccggtttctcttcaaggttattttctttataaccttggaaaagtcacttgacctttctaaatgttctcatctacaaaatggtgatatttcctacctcctagggtggttgtcgtgattaaaagggtgaagaatgtaatgtgcttactgtagtgctaaggatataataagtcttcattattgctatattaagacctgttttagctgactccccagtggttggcaaattttgtattgtgccagttagagaggaagaataagttcatgatccctttatttaactcagagattgtgagaggattctccttttgggtcttattgttttcaaaggtgataaagatagactgccctttaaatttaagacctatactctacttctttttatattagagggcttgttctattctagcctttggctatatttttctcttcttactcagagttattcaatgggctttttctttttagtcttctcagaaagtctgaagatccatatagtcattcatgtggtaggtaatgtgtttttaataattaagcttaatttcaaaaatagacttgtcttgctgtctgttttcccaatttataacacttgaattaaaaatactccaagttatctctcagttgtatggttaatgttatttaatactaagattaccatgtccagtttgtcccttatcaagggtagaaagtaaaatattcaaagtcagtatattgaatttctaggctaatctttatttcagtccaccaacagttcaccccacccatggtatttctggtagaatctataatgaatgtcatgctctggttatccataagttacctagagcttcaaatccctttacagataattataaacctggagtt

SEQ ID NO: 161683 - DNA, 429 bp, Homo sapiens
ccagggatttctccactataacatattgtctgtgaatgagtgtaattgcaaattagaaaatgtaattcattttaatattttttgtattttgttatatttaaatgcaaactacctctgtgagattttctattagtattggaaactgatgtttatactaattatagtgtgaatctattggtgagctttgtcttagcttagtctttgaagtagttacctagggagaaagtaaattttttagtaacgctactcttcaggttttctgagactcaatttgagaatttccttttgagacctatagcatgttcatttttattacattctgttgtggcccatctttgtcatttgtgggtagattaagttttcatatcaaaccaaagtgcttccaaactgtggctagtgaataaaaagggaacaaatctggaatatacc

SEQ ID NO: 161684 - DNA, 305 bp, Homo sapiens
ggacacctaccaccccagcccctcctaacagggccctattcattcatccaccgaatggcaccgtgtccaagccaccttaaccagctctggtcactggggtggtcggggtctgtcaccagcctggacagtaaccgttgttccaaacaaacatgacgaagacgaagactatggcggtgccttaaaaccctggcagcctgtggtgttggctttccagatggcttcaggactttcccacaagcagcaggacccagcgctgttcggctcccggttcagcatgatggatggtggaagatgactctgggggg

SEQ ID NO: 161685 - DNA, 336 bp, Homo sapiens
gtactccctactgtatcctaggctctaccatatagcctaggtgtatagtaggttgtcccatctaggttcgtgtaagtacactttatgatgtatgacaacaaaatcatgtaacatcacatttctcagaatgtatccttgtcgctaagtgacatatgactgtaatttgttgatatccagattcttagaagtctgcttcacaacctaagacaagctgtgggaaattccaagggtatctaaactgaaaaccatgagcatgagctcagggtaatgcatgccttcctcaagccacagtgtctaccacccaaatgtttaggatacagtaggagagatcagtgc

SEQ ID NO: 161686 - DNA, 332 bp, Homo sapiens
gcctcaagtgatcctccagcttctgcctcccaaagctttgggataataagtggtgccaccacatcatttatccacctaatattttcttttctttctttctttttttttttttttttgagataggagtctcactctgtcacccaagcctggagtgcagtggcacgatcacggctcactgcagcctcaaccaggcaggttcaagcgatcctcctacctcagtctcctaaagtgtgggaattgcaaatgtgacccattgaccccagcctctatacttatatccttttaaatggctgctttgtatcccatggttttccacctgtgccctattgagg

SEQ ID NO: 161687 - DNA, 278 bp, Homo sapiens
aaatcaaaatcctacccactctttggatcccacctcctgcagaaagcttcctgggattcctccaaagccacaatgatcttttctaaattttctccctaaattttcactctgtacaagtattttcgattgggttcttttcttttttcttgtctctaaaaaaaaaaagaaataaggaaggaaagaaaaaaacgacttctcaacatttatccagtgcagtgcccccccaccccaacaaaggggtgccattgatatgcctcccttccacagtcagcccagtt

SEQ ID NO: 161688 - DNA, 144 bp, Homo sapiens
tgcccattcccctcaaagtgtccccatagtgctcttacttttttctgtcaccctgaattgtaataacctatttgtctgctttactggtttgaatgtaagctccttgagaaccttgctgtatccacagagttagcatagtgccct

SEQ ID NO: 161689 - DNA, 490 bp, Homo sapiens
tgaactaatttacattcccaccagaagtatattagcattcctttttctctacaaccttgccagcatctgttgttttttaactttttaatactagccattctgactggtgtgaaatggtatatcattgtggttttgatttgtatttctctaatgattagtgatgttcagcactttttcataggcttgttggccaaatgtatgtcttcttttgaatagtgtctgttcatgtcctttgccccacctaaagatgaatatttaaagatattattttccttgagctactttttttctcttgagacagggtctcactttgcactccagcctgggtgacagcaagattccatctcaaaaaaaacacaaaaattgtttggacattgaagttgaactttgggcaggtttagggtgtaaacacctccatgtgttaatccatgatcctttcttgtcaggagggttattttagaataaaacgcatttgtggccgagcacggtg

SEQ ID NO: 161690 - DNA, 485 bp, Homo sapiens
ccatcagggctatggcagggctggtgactccggcgcggtcaccaccagagggcagaaagcactcacatcagctgcactgctaccatcctcaagagccaggcagcccgaaccccttgcctacgtcctggtaacctgtgctacattctagatcttacttctactattttttttatttatttatttttgagacagggtcttgctctgtcacccaggctagagtgcagtggtgcaagcatagctcactgcagccttgaactcccgggcacaagcaatcctcctgcctcagcctcctgagtagctggactataggggagcaccacgatgtctgactaactgtttttgtttttttgtagagacgggggtctcactatgttgcccaagctggtcttgaactcctggcctcgagtgatcctcctggcctcagcctccccaagtgctgggattaaagacgtgagccaccgcacctggcttacatcaactatgaa

SEQ ID NO: 161691 - DNA, 948 bp, Homo sapiens
agctgactctagaggatacacctccataatgtgagcccatagtttgtttgtgcctgtatctgggaagttctggatgacctttgactgtatcaacgtagattataatcgagaatataaattacagctgagggggaaaagtggttactcctggtagatcaatctggatgcaatcaggaggacagaaatcacaaaataacttagagtctagtataaggaattattaagctatgataggagagtaactaaaaatatgaagtgacctctaaaggacagcctggggctgagagaggacccaaagaagacaagcttagaaggagatgccctcctcatggctgggggtaggacctttttggagaaagtggtttcagcccactaaataatagttctctgtgttgttgaggttccgcggacaaggcaacaattctctggaatgcagacaagattgatgggtgagtgcacagaaagagttgggtgccgctgtgggcacaggcctggaatacacagtacccatgtcatgaagcaaggtgatgtgaagttcctaaggtgatgtgaaggccccagcccgggatgtgaagttcctgagggtctgtgcactctggaagcacagctggggcagaactccaccagttgtctccacacacatgcgctctgatggaccacacagaaaaaaacaaatgcaacacctagatccaggaagagaggccccttctggaatagtccttctgctaccttgggacaaagcatcatgatcactgtaaagtagaaatgattaatatcacaaagttggtactgaagagtaaatggtgcaatttggatgtgcaagtcagtaaattgataattggcactcttgaatgcaaaatagaaactagattctcaactatactgaagcttccattatccagaatgtcactgcatatacttggtgaattataaagtcaaacaagaaat

SEQ ID NO: 161692 - DNA, 897 bp, Homo sapiens
cacatgcttccattgcttgattcctcgaaaagggcggggactctgggcagcggttgtggagtgccgcgggtccacagtgctgcactgagcagagaggaaggggcgtcccgggatatttggaggataaaggtgtgggcaagggtgatgaccacacctgccggctccggcagcggcttcggctccgtgtcctggtggggcctgtccccggcgctggacctgcaggctgaaagtcctcctgtggacccagactcccaggccgatacagtgcacagcaaccccgagctagatgtgctgcttctgggctctgtggatggacggcacctgctgcggaccctgtcccgagcgaagttctggcctcgcaggaggttcaacttctttgtgctggagaataatctggaagctgtggcccgacacatgctgatcttcagcctagccctggaggaaccggagaagatggggctgcaagagcgaagcgagaccttcctggaagtgtgggggaacgcgctgctgcgcccgccagtggccgccttcgtgcgtgcccaggccgacctgctggcgcacctggtccccgagcccgaccgcctggaggaacagctgccctggctcagcctccgcgccctcaagttccgcgagcgggatgccctggaggccgtattccgcttctgggctggcggcgagaaagggccccaggcgttccccatgagccgcctctgggactcgcgcctgcgccactacctgggctcccgctacgacgcccggcgcggtgtcagcgactgggacctgcgcatgaagctgcatgaccgcggggctcaagtcattcaccccaggagttccgacgctggcgggacacaggcgtcgcctttgaactcagggactccagcgcctatcatgtgccca

SEQ ID NO: 161693 - DNA, 973 bp, Homo sapiens
cacatgcttccattgcttgattcctcgaaaagggcggggactctgggcagcggttgtggagtgccgcgggtccacagtgctgcactgagcagagaggaaggggcgtcccgggatatttggaggataaaggtgtgggcaagggtgatgaccacacctgccggctccggcagcggcttcggctccgtgtcctggtggggcctgtccccggcgctggacctgcaggctgaaagtcctcctgtggacccagactcccaggccgatacagtgcacagcaaccccgagctagatgtgctgcttctgggctctgtggatggacggcacctgctgcggaccctgtcccgagcgaagttctggcctcgcaggaggttcaacgtgagctgggatgaagatgagagcccagattcccgagtccttgagggaggaagggattgaaattctaaaacctcagttctttgtgctggagaataatctggaagctgtggcccgacacatgctgatcttcagcctagccctggaggaaccggagaagatggggctgcaagagcgaagcgagaccttcctggaagtgtgggggaacgcgctgctgcgcccgccagtggccgccttcgtgcgtgcccaggccgacctgctggcgcacctggtccccgagcccgaccgcctggaggaacagctgccctggctcagcctccgcgccctcaagttccgcgagcgggatgccctggaggccgtattccgcttctgggctggcggcgagaaagggccccaggcgttccccatgagccgcctctgggactcgcgcctgcgccactacctgggctcccgctacgacgcccggcgcggtgtcagcgactgggacctgcgcatgaagctgcatgaccgcggggctcaagtcattcaccccaggagttccgacgctggcgggacacaggcgtcgcctttgaactcagggactccagcgcctatcatgtgccca

SEQ ID NO: 161694 - DNA, 554 bp, Homo sapiens
ctgaaaactacaatgttgaggggtgaaaggaagggctaaacatttttcattgtggtggattctgccagcgtagactgctaaatgtttgtggtttggatcttgttcactctgaacgctttaggccttgtgtaggttttccccagagtatgaggtggttgtgaactgcttttgctaatggtgagaatgaactatcatgatgttatataacaaggatggcattctgggagacgcaaaatttaaagtaggggaaaaggaggatggcaaaaactaagtaaagtaacttgaaaagttattctttctgccaggcgtggtggctcacgcctgtaatctcaatgctttggtaggccgagtcgatgaggttgagagatcgagaccatcctggccaacgtggtgaaaccccatctctactaaaaatacaaaaattagctgggcgtggtggcatgcacttgtagtcccagctacttgggaggctgaggcaggagaattgcttgaacccaggaggcaaaggttgcagtgagccaagatcatgccactgcactccagccaggcgacag

SEQ ID NO: 161695 - DNA, 436 bp, Homo sapiens
caatagatgagatctccttgtggatatctcttacatatatgaatgtcttcatctgggtgaagaaaaagtagattcaggagccatataccttagtctctatttttgggaggcataataatggctctcccaaatatgtccatgccctaatccctagaagctgtgaatatgttaggttacagatcaaaggcaaattaagcttgcaggtggaattgatattgctaataagctgaccttaaaatagggacagtatcctggattatcaagaaggacccaatgtaattacagaggcctttaaaagcagaagatggaagtggaagagagagtcgggggagatataatgatggaagaatgatcagagagaggcaacattagggttaagggctcccgggagggttaagggctcccggagggttaagggagggttaagggctcccgg

SEQ ID NO: 161696 - DNA, 549 bp, Homo sapiens
gagtctgtgtgaggagctagagacacaccacaccccgcctgatacatacacacactgcctgctgcacaccacctgctgtacacacacacacgcctgctgcacacagtctactgcacacctactgcacacccttgctgcacataaacacacacacactacccgatataaacacaggtagcctgccgcacggcacaccgcacacatatactgcctgataacacacacacacactgcctactgcccacacactgcctgatgcatatgccttgctgtatacatagcccataaggtactcactacctgcttaccaccacaccacgcactgcctgacgcacacacgtgcacacaaacactgcgcgctgcatacacagcccatacagcatgcagtgcctcctgcacacactgccccttccccactgcctgatggtaacgtgtgcgctgaccgctgcacaccccgttctgtgcgcacagcttgcaaggcagcacccctgctgcacacactgcaccacacacttcacacaaacactgccttaaacatggcacacaggg

SEQ ID NO: 161697 - DNA, 477 bp, Homo sapiens
ccaagtagctgggattacaggtaggcaccaccatgcctggctaatttttgtatttttagtagagacggggtttcaccatgttggccagactggtctcaaactcctgacctctggtgatctgcctgccttggcctcccaaagtgctaggattacaggtgtgagccactgtgcccggcctctagtacagatattttcttgaaattaattgtttgacctcccagcctatccatacgagtcaggactttttgggtgaactgaaatccaaaaaggagaaattgataaatttttataactagaccatgtacaatccaggtgcagctggactcagggtttcctggagccagcatgctatcatattctaactttccagaacagggctcaatttctatctgaattttgctaattctttcagattctttcataccatgaagtaaaacatctttcattctgaaattgatgataaaggaaatacctttg

SEQ ID NO: 161698 - DNA, 732 bp, Homo sapiens
aacctgggtctctagggcgtctgcgcaggaaggtgcgttgagatggcagttgccggagttggaggccgggcggcgacgaaattccatggaattatagttggtctactctgcaatgtctctatttaaaagcccaagtgaggacagacaagatgaacgtagaacatgagagatatctgcaagccaacaacaaagaattcaacagtatttttggatatccgaacaatgccatcaagacctcaaaatatagtgtctttaatttcctgcccctgaacctatttgaacagttccagagacttgcaaatgcatatttcctcattttgctatttttacagttgattccccagatctcctccttgacatggtatacaactataacacccctgatggtggtgctgtccattaacagctgtgaaagatgccatcgatgacctgaaaaggcatcaaagtgacgatcgagtcaacaaccagcctgttctgctactggtgaatggcaagataaaggaggacaaatggatgaatgttcaagtgggagatataataaaactagaaaataatcagcctgtcatggcagatatactattactctctagcagtgagccatatagtctgacatacatagagacagcagacctggatggtgaaaccaacctgaaagtgaagcaggccatctcagttaccagtgacatggaagatcgcctggagcttctgtctacctttaatggtgagttagga

SEQ ID NO: 161699 - DNA, 848 bp, Homo sapiens
aacctgggtctctagggcgtctgcgcaggaaggtgcgttgagatggcagttgccggagttggaggccgggcggcgacgaaattccatggaattatagttggtctactctgcaatgtctctatttaaaagcccaagtgaggacagacaagatgaacgtagaacatgagagatatctgcaagccaacaacaaagaattcaacagtatttttggatatccggtgagtgtcatccctctggctgtttcagaaggggaacaatgccatcaagacctcaaaatatagtgtctttaatttcctgcccctgaacctatttgaacagttccagagacttgcaaatgcatatttcctcattttgctatttttacagttgattccccagatctcctccttgacatggtatacaactataacacccctgatggtggtgctgtccattaacagctgtgaaagatgccatcgatgacctggtgaagtagcttcctgggcctctacttcctcactgcacctagtcagactgtgggcatgaaggacttcccagaactacctagtgctaacaagaaaccctgaatggaaagagatatttcctttcttctttccttattcatcccagagtaatatgcagtacctttaggcccaagattggtggtctgtgtatggccagaaaggggcaaaacaaggcctttctctatcttcctactgccaccacttttagcccctctcctgagcctccttccatctttaataacccactctttctttactcctctcttagctttttctagctttgttctcatcctttttcctctgctcctccttctcctactctatattccctttgccttcctctat

SEQ ID NO: 161700 - DNA, 518 bp, Homo sapiens
aacctgggtctctagggcgtctgcgcaggaaggtgcgttgagatggcagttgccggagttggaggccgggcggcgacgaaattccatggaattatagttggtctactctgcaatgtctctatttaaaagcccaagtgaggacagacaagatgaacgtagaacatgagagatatctgcaagccaacaacaaagaattcaacagtatttttggatatccgaaaaggcatcaaagtgacgatcgagtcaacaaccagcctgttctgctactggtgaatggcaagataaaggaggacaaatggatgaatgttcaagtgggagatataataaaactagaaaataatcagcctgtcatggcagatatactattactctctagcagtgagccatatagtctgacatacatagagacagcagacctggatggtgaaaccaacctgaaagtgaagcaggccatctcagttaccagtgacatggaagatcgcctggagcttctgtctacctttaatggtgagttagga

SEQ ID NO: 161701 - DNA, 334 bp, Homo sapiens
ctacagcttaaaatacatacggcatgggtcatgtagcatttttacttattcatatttcaacaaaatggctctgagttgagagccttttaattgatgggcaagttgaaagtgcagaaagagtagcgctgacccaacacatacctgaatccagctgacctaactaatgtcatacctctcccctacaaaataattatacacatactattataattatgtcccaggtatccaagttaaattctaaagcaataattcttatagtgcccaagttatgagagaattttctaggtttatgtaatgttatatatccttttttttttttttttttgagagatag

SEQ ID NO: 161702 - DNA, 415 bp, Homo sapiens
aagctttaccgcctgggccagggcgtgcaccagaccagaatcctgcggatttagtattgtgagggtagaagaccagcaagcagcatgacctcgtggttactgatcttatgaagaacacttgtctttcatatttgggactgtgttaaggttttctggaatatttttggttgtagtaacgattctgctttaggagctttcttctctagtgttgcacagacctgagtgatttgaccagcagtgctgcggtaacggaagaccactcgtgtcttcagactcgttctgttcctgggggtgcttgcttgttctaggccccctttgtatggagaggttcaaaccttgattgaatagtcgctacccaggtgtcataacctgtggcctcattggtgtcacctggactttttgtctgctgtttgca

SEQ ID NO: 161703 - DNA, 461 bp, Homo sapiens
cccgctagtggtacctcaaggcgggcagaaagcccatgaggggaaggggaggcacctggggaaaagcaaaacaaaaaacaaaaaacaaaacaacaacaacaacaaaaaaacgccgcggagaagcagagcctgggtccccaaggaagaaagtgtcttcccatcagcccttgcgctgggccccggggaacctagtgtcccagtttcgaacccagggtgtgcgtctggccactaggggtaccccaagtcggacagaaggcccatgaggggaaggtgaggcacttgtggcagagaaaaagaaaaaccgccccgcggagaagcggggcctgggtcccccacggacgaaagtgtccgtcagcccttgagctgggccccgaagacgctgacgtccctggttcgagcccacagtgcgcctcaggctgctaggagtaccccatggaggaaagaaggcccaaaagtttcag

SEQ ID NO: 161704 - DNA, 211 bp, Homo sapiens
  misc_feature (43)..(43): n is a, c, g, or t
  misc_feature (46)..(47): n is a, c, g, or t
gcggcgtttagaggaccccgtggcaggagggccgggagggagntcnngggtgaatcatttgatgtaaaagacttgactccataatctgcatctgtcctaatgctgtcatctggagtagagactcagccagttccacttgattcctccatgtctgccgtggtacaggaattatactctgaactcccagtaagtgtctccagagagcttcatg

SEQ ID NO: 161705 - DNA, 131 bp, Homo sapiens
ccagaccatcttccacagttgtgtgttttgatgtttgatgcttttgctaatgttgtttcgtaactttgaaatatccttttctgtcagccgcctgctctgcctgggggatcatactcctgtcagccgcctgc

SEQ ID NO: 161706 - DNA, 236 bp, Homo sapiens
ctcctgttgattctgtttctctggagagccctgactaatatataagcctagtcttttattgccttacttttgtctcatttcaggtttttcagagtgctcctaatctctgagaacttctgcattactggcttaattctctgcattgacgcagtctgtcatgaaatggctatcttcatgacaaaccaagcaaaaggagaggtgcttgggttttcataaacttggcagctgttttggaa

SEQ ID NO: 161707 - DNA, 372 bp, Homo sapiens
tttttcaaggatctagccacggtagattttgttcacttgtcactggagagttgaaggcaataattgtaaaggttgggccagatgtcttcatgtgctcacagtggtatagcctgctcctgggttgcttagcataaattgggtggaagacaagaaaaagataatatggttttcttgtgccatctctggggtgaatgttacgtattttcctggctgggaataaagtcttcccggtcgtctgattagcagggtgtctaccttttggtactttgagtttgtccagatgagtggttcttaaagcagggggcaatttatttccccaggggacatttggctatctctggacatatttttgattgtcacaatgggggcagg

SEQ ID NO: 161708 - DNA, 171 bp, Homo sapiens
taatgaagtaagtcctacatttttctaggaaggaatcaatagatttaaaaggaaaatcaaatatagatgtaaagacatatttaaaatagagtgagtgacaccagaaaaaaaagtttaaaattgtgattgtagggtcagggttaaagaatgttgctttgctggacgggcgcg

SEQ ID NO: 161709 - DNA, 271 bp, Homo sapiens
tccatgtctttgctattgcaaatagtgctgcaatgaacatacacatgcatgtctttatggtagagcaatttataatgttttgggtatacacccaataatgtgattgctggatcgaatggtagttctgtttcaagtttttggagaaattgctataccgttttccacaatggctgaacagttccactagcagtttataaatgtgttccttttcctctgcaacttgatttgacatttctgatttggctctcagtttggatgctgttggtataca

SEQ ID NO: 161710 - DNA, 368 bp, Homo sapiens
aaacaacggagtctccggtcattgctgatacttgatgacccagtgtgggtacccattaaagtgaaagtatccattttactttacgttcaaatgtaaaggctgaaattcggaacatttttaacaaagcattttaatgagtgctttgatacaacaacattttggctcttctgagggctctgtttttattgaagataaaattaccttaaatgtttattgctctgagacagcccaggatgagagaattacaaaaaagaatggatttatagagaggacacaatgttttgaacagtagagtctggagacaaacacatttaagagttaaatattttttaaaacagttgttaaggctgggcgcggtagctcacgcc

SEQ ID NO: 161711 - DNA, 348 bp, Homo sapiens
gcagtgaaggtacgggagctgctcctacggactccaggaggagaaaggagctggcaggacaggcctggaggtgtgagctggtggtgcaggatggggagagagcagcagagatgagctctttatcttctcatctaagtttaagccccacaatactggctttctggaaaccatcttgaggtgttcccatgaaggagggaggggcccactctgcctggggtgccctaaggacagagggacagtctgtgtcagtctggcccctggccaagcgtattcacacatgcctgtaatcccagcactttgggagtccaggtgggaggactgtttgaggccaggagttcaagaccagcc

SEQ ID NO: 161712 - DNA, 424 bp, Homo sapiens
gtatgagaggggtcacttctctgaaggatccaattgtagacaattagcaaattatcagacagttaacaagcaacaaataccaaacaacagatggcttagtgtcagagtgagtggcagagacagtaggtatcacaggaagggcaaaatagaggtcattttagactggaacaatatctgacagtgttgtgagagtgatttgagtgaggaatgtgctcttaaaggaattacagaaattggttttaataaaatctacattattggaaacaaaagtttaccaattaaattgtattttgggaaacacatgggggaaccttttttttttttttgggacacactttttcggggacccctctaaatccaccctgagggtttgaactttggccagggcccgtgttttacaccttcgtgcctggaaacccggggg

SEQ ID NO: 161713 - DNA, 190 bp, Homo sapiens
cccaaaggtgactgacctcacttttttcccatcctcactatttcacatacagacacaacctacacacacttcccctcttctatttgtgtgtttaaattctcttttcttttttttaaagagatggggtcttgctctgttgctcaggccagagttcagtggcatgatagctcactgtatccttgggctcaaa

SEQ ID NO: 161714 - DNA, 587 bp, Homo sapiens
caggtagctagccccatccctgcccggagtgtgtctgctgctcttctgacccagcgtttatcagaacagcataacaagagcacaggctttaccgtgggcagctgtgcagccccaggcggatcccctatctcttcccgtcctcagtttcttcatctgtaaaatggtcatcatgacggtgggtactgcaggggttgttggagcagcatgtgaggtccttggtgtgcttagctcatgcctggcaggtggtaaggatttcataaagctttcttgttaccactgtgagtgttatttccccagttccgcctttgtcttggagagagctgaggtttcacggaatacatttggaacaggcagggatggttatcaattctgcagatggctgtgcccagaatgatatagacacgaaacttaaatagatccctgcggtgcccaatggacatctcctttctgacgtcatgaaagaggatagtttttaaatgaataaggaatctacacatctgagggataacactgataattacgatcattttggaactgtggagacggcatctttagcagacggattctggaggcggactgagtggttg

SEQ ID NO: 161715 - DNA, 304 bp, Homo sapiens
aacttcaacatttctcaggaatgaaacaatgcaacaactttgtggaaaatgcctccgctgcctaagaccatctcaaatgaatgcaaaaccttgaagtttcaaaacttaaacttctgaaacacgttagaaaataaatttggggagaaaattagacgtaagtacttcaactgatcaaacacagtttctacctgcacaagaatatacgattcctaaaagacaagcgatatatgcatagcattgttactgtcttatccacctaaataccagaaagacaacaaaatgaataatctgagctatcatctct

SEQ ID NO: 161716 - DNA, 481 bp, Homo sapiens
tttaagcagaaatcgcttatcatattttcttagataatttgagattttaaactttggttagattatagttacctacaatgctttgagaatataatttttaaaagtggcacatatgctttatcccaatagtattctatgattaatatgcacacatctatgaagtatcatgtatgatacataaactattctgcataagtattgtattttgtataaactatattagtatgacatttagtttgtgtaaaaatatgcatgcatatttcatagatagcatatgtatattacataagtgggaccctaactgcatctatatttagtgaaatgtcaggatcgcgatgctgcggtgaatagcatgagctttctttcatgtccatgttaggagaggcagcttcctcccatcaaaagcacagctggggcagaggagggggttgagagcaaggttttctatctatctaattgtggtgacttttaaagtttagtt

SEQ ID NO: 161717 - DNA, 276 bp, Homo sapiens
gtatctctaacattaatacaaaaattagccaggcatggcggtgcacacctgtggtcccagctacttttgaggctaatgtgggaggattgcttgagcccaggagttccaggctacagtgcgctatgattgtgccactgcactccagcctggatgacaaagcgagaccttgtctctaaaaataaaaagtaaaaagagagagagagaaataaatgttggtcaggatgcagagaaattggagccctgtgcattgttggtggtgcagataatgttaagatg

SEQ ID NO: 161718 - DNA, 218 bp, Homo sapiens
gctcaaggccttagggtttcctcttccctgctcctgaactatctatatattcagtaagttaccaaacaatgttaattctacttccaaaatatgatttgtatctgaccctctctcacctgtcccataaccactacagtggtttaggatattattactttcctagaccatggaaatgaccttcttcatctaatctttcctcccacatactgtgttataca

SEQ ID NO: 161719 - DNA, 470 bp, Homo sapiens
agcttaaatagggcagcaaattcagacctccaatcaggctaattatgctttgtatcaacctgagacaatcctattcctcctccttcctcccatttgttcatgcaagatgtaggataaatattaaacttaagaaaattctcaaatctgaatggtatatgaagaaaccaaatttcattctaagacttaattttttccaagaggctctttggtgcctactctgtaggatcatacataataatgatagagaaactgtgtggttttctagctttcccaatagtataacgttattattttgcagacagtggtttcccagccaaagttatagccatgttcaaatataagcataaatctgcattcacaagactctaacaagcattagtgtgcatcaagggtcttcttcctaagcatgtgttataacttcattaatgatgataaaacattcttattagtcagattttaaatattggact

SEQ ID NO: 161720 - DNA, 364 bp, Homo sapiens
ttggctattatgagccctgctgccataagcattcttgtatgagtctcttggtgcttatgtgacggttgaagccctagaaatacagagttcgtactagcagtgaaattactgagtctctctctctctctctttttttagacaggatcttgttgttctgtcacccaggctgaaggccagtggtgtgatcccaactcactgcatccttgaccttctgggcccaggcaatcttcctacctcagcctcccgaatagttaggattacaggcatatgccaccacctgtggctaatttctgtttttttgttttgttttgttttgtaaagacaaggtctcattatgttgcccaggctggtcttgaactcctgt

SEQ ID NO: 161721 - DNA, 587 bp, Homo sapiens
  misc_feature (400)..(400): n is a, c, g, or t
gaagaaacagaggccagaagagcttctgtaacttgccccaggtctcacaaccagcaagtcgcctgctccagagcctcccctgtgagacagaacccgttaggagatgaggcctgccctgggtgaccctgcccggctgtgagattagagcttgagggcagggtgtgtataaagtcatctcaggctgctgtaataaaatgccatagctaggtgcctcagacaacagaaattgattttctcacagttctacaggttagaagtccaagatcaaggtgccagtgtggctcatttctggtgagggttccctgcctgtcttgtagatggtagatggccaccttctcacactgtgtccttacaaggcaaggcagaaagaaaagagagcgcaagagagcccaagccctcntggtgtcccttctaataacggcactaatcccatcaaaaggtcccaccttcacctaaacctaattatctctcaaaggctccacctccaaactgggggttagggcttccacatgtgagtttgggaggtacacgatttagtccatagcagtgagtgaaaccagctgatgactggctggtggaactgggct

SEQ ID NO: 161722 - DNA, 240 bp, Homo sapiens
cacagggagaagatagcataatcactgtgaaagtattatcaaatgcaagcacgcatttgcatttttggcaaacaaccacttttgattttacattgtattgttccataatatttaaagcacaaagtcctgaaattatcaaacctacttgagtttgcgatagtcagatactagtttcattgtgcttttaattaataaaatgtggattgtctaaattaaaattttcattatgaaatattttgg

SEQ ID NO: 161723 - DNA, 887 bp, Homo sapiens
ggggcccatgctgaagaaatgatggatgaacgcatgttcaagctatgcgaagctacaggagtggcaggggagcgagcacctccacctggctctctgcaattattcctggttagctggtcaccaaatctgacggtggcctcctgggaagcaggaggaactgacattctgggagcagcttctaggtttcagaaatgagctagagaattcaaaggaattgccccaagaagcaaatcaggaaggcagcggggcctcgctttgcagatgaggaagctgaagtttgggaagctgaaatggacttcccaaggccacggggcttcctcagaatccaggtccacattcccaagcttccttgagaggtcaagcaagagtttccagtttagaagtgcagacacctgggctaatctaagatcccggtcttgttaacacgtgtgccaggctgtcttcagtgactcagagagacagagaaattgtgggtaatttgcaaaaccagcggtgggcctatgtggctcctcactcccccaggacctggtcacccacagaaagcagcggacaaatgaaaatctctctcattatcacatctaggaaagactttctaaactgcctcatcctacctcttcatggtccagatggggaaaccaaggcccagagaggaaaagacttgcccaaggtcactagagaggtgggacacagccaggtgaggagctgtgactctgtcactccacaaagctgcccctaggaggctgagggcattactgcccagcctctactggccaggatgagcttaggccagtacctggaatgtaccatgggcatgccatgggctcttgctctttctgacatccaccccagccctttgcacatgctgttccctctgcctggcacacact

SEQ ID NO: 161724 - DNA, 416 bp, Homo sapiens
aagagacaacttgcagaatggccaaaaaaattgtaaactattcattcaacaagggattaagatccagaatacacaagaaactcaaacaattcaatgtcaagaagaaaaactacaagtaatctgatgtaaaaatggataaattagctgaataaacatctctcataagatgacacatacatatggccaacaggtatttttagatgagatctggcacgttcagggtggtatggccatagacaccaacaggtatttttaaaatgctcaacatcactcatcatcaggaaaatgccaatcaaaaccacattcagatatcacctcaccccagttagaatggctactatgaaaaagacaaaagataccaaacgctggtgaggaagcaaagaagagggaactctggtgtgctgttggtgggaatg

SEQ ID NO: 161725 - DNA, 385 bp, Homo sapiens
ttcatttgagcaaactaaataaataactgcaaagtagtcaagaacatgagattccttctgctgactatggaaggggtgggtggagtgaaggatctctcatgggctaaggagcttttcagtcactcaggtgttagatcccatgtctgtttaagtctgtctggactttggactccagaagccagtgagcattaccaccgtggtggtgtctgtagtaagcagtgcacaccacattatttatatttactgaaacaggacgtggtaagttggtcctgtttcagtggatatgttgtttttatttttgttcgctgaagtagaagtagatcgctttctcctgatgcctttttactttttctggtttaattagatctaaataatggtgcacaaa

SEQ ID NO: 161726 - DNA, 278 bp, Homo sapiens
agatacgtgcatttctagacacacatgaaagctcttaggaacaaaaagaaagctcagtcatgaattcttcctaaaaaattgagataggaaatctaatttcaagaggtgaaagtagatatggagggatgcaggccaacaatttaattttagaagtgaggaaactgtatcccagcgaggggaagtgacttgccccagtatacaaagagatagtaataataagaaagctaaggtcagaactcaggttttctgagtccccgtacagtagtcacttaactgtc

SEQ ID NO: 161727 - DNA, 502 bp, Homo sapiens
agtgttgggattacaggtatgagccaccgaacccagctagttgttactgttattgctgcagaaaagaccttgcttctccagtgaccataagggaagatggtaatacagaggcttggattggaggtagaagcaaagggagctagcagaataggagaattaggttgcctctttctggcctttggttggggcactctttaaaaaagtgccagatccaagagcccagggggctggctgtgagtgccctcatgtggatcagctatggtcagactgcttcacgcctgtgacctgccctgtataaatatactgccatgtataaataatggccccatatatatgtaatctggaaggataaacatcaagcttaacactggcaacctgcagggagggaagtggaattgggtgtgtatgtgtgtgtgtgtttgagaacctgtattttattactccgcacgtctttattgtttgatttttttcataatgagaatgagtttgtgtgttgggtaaa

SEQ ID NO: 161728 - DNA, 327 bp, Homo sapiens
acatactactaactgtccattcagttgatggtaaattctcctaaaatcaggcctcttgatgtgaactaaggcaaagagttgagtttcaaaaacttcaataccatattcaataggccatgtcagacttctttttcaaacaattactaggacttctccagacactgtcatcttggtaaatagcaccttcaatgcattcatctgatcaaacccagaaacacctctccccatcatctctctgatctctcatgcaattccactttcttcaaaatatatctcattctcttctttccataaccactgcaacagctttaattggggggtgggtgg

SEQ ID NO: 161729 - DNA, 143 bp, Homo sapiens
ctggcaggatgtggagaaactgaaaacctcttatactgctgctagggatgtacaatggtgatgtcacttcggaaaacagcctggcagctcctcaaaaaaggttaaacatagattaccatatgacctagcaattccattcctag

SEQ ID NO: 161730 - DNA, 533 bp, Homo sapiens
taacttatttcctcacacctgtatttcctgtaaactggtattcagcatattctgaatccaggctgacatttctagatcaaatggaagattattgataccttttttcccttaggttgaaatttttgtttctaaaaatgttaacataattacatatttgctttatcccaaacatatgtttccaaataccaataccaatcttactgttaacaaaagaatgctgaaatgcgaagtgtgatttctttgcatttctttttgatcttagaatatatcacactaacaatataaagtcaaaatatatgtttaaattattcaaagttattcctttctctgtgtggttaatgccaccaccttaatatatagttagactcttttgttttcatttattttcagtacttagggactgcttttctcatttagattcgatttaatttttttaattatgtaaaaacatttacatggttcaaagtcacaactataaaacaaggtacatttggagcatcttgttttcgttttttgttccccagctgccttct

SEQ ID NO: 161731 - DNA, 464 bp, Homo sapiens
caacgctcagagaaacatgtctgttctcaccaaccctacaatccagccaccactgcaggctttcctttgcctcctcccttctaaatgccctctacccagccaggtactttcccctagccaagacaccctcaagtggccttcggttctcacaaatgggtccaccagcacctcccccaacctccaaatgtgtcccctgactattccctccctggtatcaataggctctggcagagggaggagatgggcactgagttagaatttggggcatgcagaatggcctccaaaatgtctcaggttttctcaggccacatcttcttccctgtgcctgttggactctttctgcctccaccacttcatctgcatcagattccacagcagacccacatcacaggtgccccttcagtccacggctgccacctcagacctccagccacccctccagaatagagaggtatgtctgtggc

SEQ ID NO: 161732 - DNA, 219 bp, Homo sapiens
ctgggattacaggcatgagcaccgtgcccagtggttatttagattattcccagtttttcaatattataagcaatgtggtataaatatcttggtacacgattttttgcttatcactcttaaggatccttataataaattccttctattatttttatttctctttaggtaatacatgtacatagttttaaaaagtcaaattgtgctgcaaagtccaacttc

SEQ ID NO: 161733 - DNA, 100 bp, Homo sapiens
tgctgggattacaggcgtgagatcatcagtgatctcagccggatcttagcagatgacttaggccgtcttatatctgcatggagagtctggcgggtgcagc

SEQ ID NO: 161734 - DNA, 98 bp, Homo sapiens
gccgcagcccccacccttccccccgccccccagcctatcacagacagctgagataaccccttttaaagtattcctagagaggtggtttctttctcgga

SEQ ID NO: 161735 - DNA, 375 bp, Homo sapiens
atcaaccctgaaaacttatgctatgtgaaaggagctagtcacaaaagaccacatattttatggctccatttatataaaatatgtggaataggcaaagtccacatatttttcagaaactgggggaagaggggagtcagtagtgatgggtaatgggtgtggggtaacttttgtgggtgatgaaaatctgtagtgatggttgtacaaatttgtgactaaaaagcactaaattatatatttcaaaggggtaagttttatggtaaatgaattatatttcaataatgttttaaaacctcaaaaaattatatcttcctaccaatcctgacatagttgaccccatgaatgtactcttgaaaacataataaatgaaaacctaca

SEQ ID NO: 161736 - DNA, 455 bp, Homo sapiens
gcacaaggaaaaatgaaaggtcctatagtagaggggcaagtagcagctatcatattgagggctactaggaatatcttcgtggaagaggtagagtttgagcagctgtttgaaggatgaggagaaggtcagtagattgaggagtgggcaatgggaattccagcaagagtaggacagaagaggcaggacccatccaaggagcggcaagtgcctagtgtggatggagaggtatgaggtggggctggtgccagcaaggtaacatggggtcaggcacagaaaacgtggcccccacgatgagggttttgggcccctgttgaaggagctcatgcttacctgcgccgaatgccagtgcatggtgcaagggctgtgtgtgacttctgaacagcatcaagctcatcttggtgctttgtgggtgctcactgccatgtatgtgtctttcctctctgcatgctcacagc

SEQ ID NO: 161737 - DNA, 287 bp, Homo sapiens
gggtccggaggcagggtgaccacctgggaggtcatggcagcagtgcaagctgaggccgcttcatttcccaagagtggtggcaatgaaattgggctattaattcagtacggggagcctggggacagaagccagaggcagaaggttgagggagaaatgggaggggaggaaattgaaaaaatatgttttgaccatgagtttgagaagcttgactgtgaagggaggagataggaagaaagcggagaaacgtgtgtgtgtgtgtgtgtgtgtgtgtgtgtgtgtgtgtgtgt

SEQ ID NO: 161738 - DNA, 567 bp, Homo sapiens
cgtgatctttaactagtcacataagtggtatgatcatatatatctgtcccatagttaagaggcatcacccaacgtgaaactaaaatatgaaatgccacagtttataaattaatgtaaaataagttatgatacttctgtgatagtgtttgttatgcagccaataaaaatcacattttatataaaatttagttgtatggaatatgcttaagcaacaaaaaagaagtattttgaaatgtgatattttaacagtgggctgtaacagtgcaattatgaatgatttttattttattcttttgtatactttgcaaaatttgtaaattaagtatataaaactttaataagcagaaaaattttgaaacgcagtaagaaggctgtaataatatgaaaatggtatacactaataaagctcaatgtcactccaaaaaatgcagtgaaaaaagactgaaagaaacatgcaaatatctacactggagacctctgcgtggtaaaatgtgaggtaaaatattttctgcattttcagaggatcttttcctacttttatgtaataaacatatttatcataggctt

SEQ ID NO: 161739 - DNA, 155 bp, Homo sapiens
tagtggactcaggataatgtttattttgttcgcatttttaaaggaaaatgtaaataaaccttaaaatggttttgataattcacttctataaggaattcagcctataatgtttacttttcactttctattatcaaggtaactggcctctatgtgtg

SEQ ID NO: 161740 - DNA, 183 bp, Homo sapiens
ttaagtaatttgcccaaagtgacatgggtagaagtgttgaaaccaagcagtcttatctaaattctatgcttaactgctatactgcttctttctttgagacagggtctccctctggtgcccaggctggagtgcagtgagcccagatcacaccactgcactccagccggggcacacattatggag

SEQ ID NO: 161741 - DNA, 303 bp, Homo sapiens
ctaagtgtgtgtttggatgtgtgtgatggggatgtgtgtctgtctgtccgtgagcttgtgtgcaatttctgtccagcactttctgaggtaggcagccaggtgctagtagataggttttcccttccccatgtagctgagttctgaagaccttttccatccaggctgggccttcatttccctgtctgcagagtgggactgggcttggacaggtggttagagggaaacagagcagcttagctctgggaagctgcccctcccatgaatggttctgacctcttcctgacccccagctgagggtatgcc

SEQ ID NO: 161742 - DNA, 178 bp, Homo sapiens
gaaagcagaataagtagatattcactgggggctttctggaggttaacatccacccacccattttccctttgcttttacacaaacatgatggctcagtcttgcagaaataacatatatcagtgatggaaaaccccagaaagccccagatataaaggccctaattttgttaaatcacaga

SEQ ID NO: 161743 - DNA, 537 bp, Homo sapiens
caaaagtaaaagaactttaggaaatcttgagttcagattttttataagatcttcacttctagtctgttcccatttggtaatattatggttgaactgaatttctccattgcccttgactctaaagttctggactttctgctcttgttttcctccattatggaaaaatgacaaatcattctgaaaagtctatatgtttcaggtcactgctttgtacccagaaaaaaatacaggataggtaagatgaaggctcacagtctcaaatcctcacaaagggcatggtaaattaatgaaggagtcggcgtagcaaatgtaagaattatattttttatttgtattgtactgtggtataagcatgtaacataactattttggagatttaattttctgatgtaaaattcaaatatccaattaaaaataggtattttgattatatttttcttctataaatatttttgccttgaaccagagaaatgtgacagtttctcctgccctatttgggatcaatattttattcaaataaataaaaaagtttttcac

SEQ ID NO: 161744 - DNA, 253 bp, Homo sapiens
tgccgagttctggcccggaggcttctcagctggttcaaattgtcacaaagttcagctggaggttttcttctccctgtggtgtttttctcgtgcctgtggctgccctccaaaaagatccttgtgatgccaggaaggaatggcctgcttggggacccagtgagctcctagggccttttctgctgcttcttccaccccccatatttcacttggctctcaattgactcacctccaggtaaggtcggcatcttctccc

SEQ ID NO: 161745 - DNA, 411 bp, Homo sapiens
aatcttgaaaatccatatggccacctaatgtttgcatcctttcttcatctcagtgcatatgcagtttctgcccgcaaactgcctgggctttataccagctctacaaattactagctactcaacctttctaggcttcagttttgctcttcagtaaaactggagtaataggagcatgtacttcatagcactgttttgagaataaaggagagaatgtatataattaaataagatattgcctggtataggcgatgcttatatatgtttagtgatgggggcctattacctcctgaaatagcacaatccataatggggcaactttccatctattgacccaaaatctgtattcctcaaacattcccattggtcctagctttacagaccatgggactccgttccacagaatcagaatga

SEQ ID NO: 161746 - DNA, 274 bp, Homo sapiens
cagattttgacatatgtacttaacttttttacagtagtaacctaattgtgagtgtttttaaatgccatataaatgagggactcctagttgttagggaaaatcagtatctgatctctcaaactaggtcagtgcttttaaactgggctttcagggaatatctataggttgtataaaatgtgcttccactaataatgtataatggtaaccttttcccggtatgtggaaaagtagttttagatcttaaacattttcaacccttttgtgtaaactgatt

SEQ ID NO: 161747 - DNA, 456 bp, Homo sapiens
gtattttttgtgtggcccaagacagttcttccagttgctgaggaatccttcagtgtccaatactgtttattataagctctggctactggcagaagaatcagttttagcttggagaaactttatgtaaggaagtcattttatttttttaagttatacttaaaatttttatccatttatttatttattttgagatcgggttatgagactaatttttgtatttttggtagagatggggtttgaccatgctggcccaagctggtctcaaactcctgggctgaagtgatccacccgcctcagcctcccgaagtgatccacccacctcagcctcccgaagtgctgggattataggtgtgagccactatgcctgaccaggacgtcattttagaatccatgggaatactactacaatagtagtattgtctagtgcaagcttgtccaacccacagcctgaggacc

SEQ ID NO: 161748 - DNA, 484 bp, Homo sapiens
ggatggtctcgatctcctgacatcgtgatctgcccgcctcggcctcccgaagtgctgggatcacaggtgtgagccaccgtgcctggcccagttcaaggaattgttattgggacctgtgatgtgccaggcactctgccacatgctggagatgcagtgatcctgatcttcagtagttgacagtctatgcttgtagatgtaaacagataattacagcatggcatggtaactgttataataagagatgtgcactgctgctctgtggaaatgctggagaaagatacttagcacagcctgagaaggtgaaaagaagtccttgtttaggaggtaacacctgaactgaatcttgaagagtacttggaaaacgcccaagttgcgaggtaggtagaaccagcagctcataagagagcttagagaacttcttaatattctgaattaaaagagatggaggcaggaaggaatgtgtgtctgtcgggggagctagagc

SEQ ID NO: 161749 - DNA, 284 bp, Homo sapiens
ccacctcagcctctctggtaactgggaccacaggtgcataccaccaccgcccagctaatttttttttgtagacatgagatctcactttgttgtctgggcccatctcaaactcctgggctcaagcaatcttcctgcctgggccctcccaatgtgctgggattacaggtgtgagccaccatgcccagcctgtagttcctttattaaattctcctcagttacccagtgtgactgagctatatgacaataaaccacccaagttatggcctactaccaggcaaacaata

SEQ ID NO: 161750 - DNA, 231 bp, Homo sapiens
tggtcgatctaaggaccccggcatacacagagcagctctgagaaattagtttctactaaaagcacattcgtgttacattcagagaaatggaaaatttaattatattacttttctgccctgaataaataggacaacagcagatgttgtcctatttgagtagatatgacaccctactttaaaaagtacaggtgaaatgacacttggaaatgccacattgtagataacacattt

SEQ ID NO: 161751 - DNA, 415 bp, Homo sapiens
atgggaactatataggagcaaagttttgtataacactaaaattaagttgctattaatctgaactagattgttataaattaaggtgttaattataatcagcacagccattaagaaaataactcttaaatacacagtaaaataaatgacaagggaattaaaatggcacactagaaaacatatctatttaccacaaaagagggcagtaatggaggaattgaggaaaaaaagagactacagaaaacaaatggcaaaatgacagaagtcctttcttattactaattattattaaatgtaagtagattaaactctccaagtaaaaggcagagattggcagaatatatattttaaaacattcaagtatgtgctatctacaaaagattccctttaaattcaaagacacaaatagattgaaagt

SEQ ID NO: 161752 - DNA, 328 bp, Homo sapiens
ctcgacttccgtaacttttcttttttcttttttaacaactaagtcttgaatacgcttcctagaatcaattattgttactactccatctcaaaagtaaagaagtaaataaaagtatgaaaatgaaaaatgaataaagcaaaagatctcggtaatcatcttgaataaactgattatttaaaaacctaaaatttctttgctaaatatttacaattatgtcaaataatatggtcatcattaattgcattgattaaaagccacttgtgctattttctaagtattactagagctgaaatatacataataaaaactatgtttaatctatctaaaa

SEQ ID NO: 161753 - DNA, 361 bp, Homo sapiens
ctagaggatcccccactgtagactaaccaaggtcccccaggctcatggtcaaatgacatgtaagggacgtatcaagcggtgtgggtatgttaggagggaatgaatgtaaggagagagaggtgatgcacaggagagacaggatgagctttaaaggtagacagctctcgggtccagccctagctctctcccattctaactcttgggcaaggttcaaaacctgattaagattcatgcataaaactgagatgtaaggtctacctgaactggtagactaagggaagtggagtggtcttacttaaggaagggtagaagccaagtgggagatacaggtaaggaagctgtgacaagaaagggaaaccta

SEQ ID NO: 161754 - DNA, 239 bp, Homo sapiens
tccagctacatgaccgggatgtccaccaccagctcctacatgtctggagagggctaccagagcctgcagtccatgatgaagaccgagggaccctcctacggtgccctgccccccgcctacggcccacctgcacacctgccctaccacccccatgtctacccgcccaacccgcccccgccacctgtgcctcctcccccagcctccttccccccacctgccatcccaccccctactcctgg

SEQ ID NO: 161755 - DNA, 798 bp, Homo sapiens
  misc_feature (28)..(28): n is a, c, g, or t
  misc_feature (48)..(49): n is a, c, g, or t
  misc_feature (51)..(53): n is a, c, g, or t
aaaaaaaaaaaaaaaaaaaaaaaaaaanattaaaaaaaaatagaaaannannntaatatctagagccgctgccaccgggagccctctactatcagccatggtcaaccccaccgtgttcctcgacatcgctgtccacggtgagcccttgggtggtatccccttcgagctgtttgcagacaagatcccaaagacaccagaaaactttcatgctctaagcactggagaaaaaggatttggttataagggttcctgctttcacagaattattcccggggttatgtgtcagcgtggtgacttcacaagtcataatggcactggtggcaagtccatccaaggggagaaatttgatgacaagaacttcatcctaaagcacgcaggtcctggcatcttgtccatggcaaatactggacccaacacaaacagtttccagtgtttcatctgcactgccaaggctgagtggttggatggcaagcatgtggtctttggcaaggtgaaagaaggcataaatattgtcgaggccatggagcgctttgggtccaggaatggcaagaccagcaagaagatcaccatttctgactgtggaaaactctaatacgtttgacttgtgtttgatattttatcttaaccaccagactattccttctgtagctcaggagagcacctctccaccccatttgctcgcagtatcctggaatctttgtgctctcgctgcagttccctttgggtgccatgttttccttgttcccttccatgtctagctggattgcaaagttaagtttatgactatgaaataaaaac

SEQ ID NO: 161756 - DNA, 1013 bp, Homo sapiens
attacagcttcatatcagaggaaagcagagtttatcttaattcagtcagctgtgtgaaacacagtaccctaattttagcctgccggttctgcagatccctatggagtaagagaatggcaggtcttccagagagaaatcccagtgggtccctgacaagtttcacttttgcctccaacagcatccctggtggggcttgctgaaggtatcccaggacactgagtggcatcttttccaccattagcaattcagattcgaatgcgaatcctccaagcaacacatgaaagcagccctggttagctctggggcttcgaggggggcacaggcaagaggtttcttcacagaggaggctgacagggacccaggctccgacagagcagaagtcttggaggatggtgttaaagttggcgataaacaccagacaatctcagtccaaaaggggaagcctaacagtcttaactgcaacagggccaagcaggtgcgagggcaattagagtctcaatggctccggttgggagccccctggagaaatggcatggggcagaacagaggcagatgatgtcaacacgggttatggtgtggctcccacttaagacctgcaggatcaccacagtagaaaggaagaatggctgggggtgcagggcaggaggtgcgccatgaatctgaggaacactcctaataccccttcccttcttgccatggccactctgggactcgcctataagacaactatgtatccgctttattaccctgaaatctactcaagctcagagtggtaggtgggagctaccttcccaatacccattattccgacactttacttctggcacttagagatggaaacccaggcaataactactcaggaattcaggtgatgggaaaggacctggtggggtgctctcagtattggcccccagatccctctgacaaccagaggcagattactcctagaaattaccagagttaggtgatcatcaagacccatggttcaagacagccccaaaggctccaaggtc

SEQ ID NO: 161757 - DNA, 553 bp, Homo sapiens
cctcttacctgagtcctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgcttt

SEQ ID NO: 161758 - DNA, 431 bp, Homo sapiens
caatacaggaggacacccgtgtctggagggcatgtgctagagcagggaggtgggccgtgcagcacagggttagtgactgtgggctttagtgacatcctcatccctcactgcaggacacccggggccaatggggctgccatgcagctctgtgggtctgtggatttctgggccctggaggtgggggaggccatctaggacccaggctttgggggtatggggactcagggatgtaggtggagaactcggaggctgggccacagcagaagctgggccaatggcaggggatcttggggaatgccagcagggccacagggcacaccttgggcctggcagagagaggccactactcagaactatgacctgtcctcctgatgagtggaggggcgcaaggctggcagtgtgtgccgggtggacacgtgggttgccacatt

SEQ ID NO: 161759 - DNA, 458 bp, Homo sapiens
tgacgggaggagaattatgacaaggcatgtccaaccccctccttcccatcatgacctaaattagttttccatgtttattttggatcctgttggccaacaggggagtccactgagtcagttgtgggggcttagaattttatttttgtttttttttttttgagacaaaatcttgctctgtcgcccaggctggagtgcagtggtgcgatctcggctcactgcaacctctgcctccccagtttaagcgattctcctgcctcagcctcccaagtaactgagactacaggcgcgagccaccacacctggttgttttttttgagacagggtctcattctgtcatccaggctggagtgtagtggtgtgatcttcttggctcactgtaacctccacctcctgggttcaagtgattctcgtgcctaagcctcccaagtagctggaattacagacatgtgccatcatgc

SEQ ID NO: 161760 - DNA, 343 bp, Homo sapiens
ccccgttactcacgtggcagtgactcaaatgggatgtgtaagaatgaagagaatctgattgaaaaggaaaatcgtcagtggaaaggagagagaacgccttgctataaataatgtcatttatatttttaaaatcacacatatatataacccaaggaaggaaaatgcttcaataaaataataataactcaaggacaggtggaataatggaggctgctctgtctgagttctgcggttgataattgtacaaatgaaagattctcagcagaaggggggggcctgctgtgtgacccctggaaatgtcagtgttatgaatgagccccagagttcctgctcaaataccagt

SEQ ID NO: 161761 - DNA, 435 bp, Homo sapiens
cacacaaatatacacacacatacacacacacacacacacacacacacacacacacacaaagttctcaggaagcagtacttaatcttactagaggtgatgcattacaatatgttctcatctattatattctattcaattattttaaatttggtgctatctgttaaattgatttgacagcctactgctggttgtgactcaaagtttgaaaaataatgctctagttcaattgttagggtttctttctgttaaggatcttgttgaaaataacagaaacccactgtactttctaaagtaacagagtctactgttacctagagctgccataacaaaataccacagactgggtgacttgaactacatacatttatcttctcacagttgtacaggctggcagtctgagatcgaggtgctgtaagagtaggtttctggtgacat

SEQ ID NO: 161762 - DNA, 395 bp, Homo sapiens
tctcaatggttagagacactgtggtagaatgcacagcctggcacctagagatgattctgtagagggagcagctacaattacacatagaaaccattttgtccagttctatttaagttaaaaattctttgcatgtctcctgtttctctcaagagcactttcttatactgtaaccagagaggaggattgggagtttctgttagatgaggagagggaagggtggggtcaaaatggaagtgtgggaggggaagtttctggacagcgtctaggggacctcagagtcagatgcagtgaggggctctgtaggccacatagagagagcacaggcagaaccagccaggataggtctgggcacaagccgacgaggagcgtcacgctgaagcttaggaagggaagcc

SEQ ID NO: 161763 - DNA, 338 bp, Homo sapiens
atgggggaaggagtgaggagcaggaagcaatggagactagagaagacacatagccaggggaaccatcagaatgaccgaggctcctgagctggagatggtattgtcagtgaaaggcaaaaggttagtggatagaaccagtcgaaggcagataaataaagcaggaatatgcgtttgtcttcagaaagttgctgagcagatggaattctctagcttgtcttgtctccagagtgcagactgctctctgcatgctgggcagaacagctgggtcttcactactccagtctttcttggctagagccgacaccactttggtcactgggggggggccttgcctgccc

SEQ ID NO: 161764 - DNA, 191 bp, Homo sapiens
gacaccaaaagcacaggcaagaaaagaaaaaaatagatgtttgacttcatgaaaattaaaacttcttgtgcattgaaggacagtaccaacagggtgaaaaaaatgagagaaaatacttttcaatcatatattttataaggaattgctgtctagaatatatagagaatttaaaaaatttttttatttccata

SEQ ID NO: 161765 - DNA, 505 bp, Homo sapiens
aattgctcaggtaagagggagagagccgcccatatcagggcctcgggatagtataggatgtggcagcaaaatgcagcaggaggggtcactgagcctggaagaagaatggctgaccccaagggcacgtgacatatagacagctgcagaaaggaccttgagagggaggctgagtatccaggctgagttagaagcctctactctgacccgagaggctcctgccagcctagggaaataaagccccagcctgtggaggcgtcccccaagcaggctagggactagggaagaggctgccccccagaaaaggtgtaagaaggagaaggattactggctcagactacccagcaagtgagaccagagggaggatgtagagcctgggtgtgaggtcggtgtcctgggaagagatacaaggcccttcacctttaacttccaaacttgctgtcagaaaggcttggcccttctgtcctggctctgctccctggagcaggaagggagagcaggggaccaa

SEQ ID NO: 161766 - DNA, 798 bp, Homo sapiens
ggtgatctagaggatcccgtccacggtagatttaacctcctgactcaagtgatcttctgcctcagcctcccgagtagctgagactacaaggtgcccgccaccgtgcccggctaatttttttgtatttttggtagagacggggtttcaccgtgttagccaggatggtctccatctcctgacctcatgatccgcccgccttggcctcccaaagtgctgagattacaggcgtgagccaccgcacccggccaggttcaagttttagagatttcgtatttatccaacaagcctgtcccttgataacaaggtgcggtgattaagatgactgaggaacctgctggaactcgcccccggcattgatgctgaggtttctgatgcctgcaacttttgcatccttttcccatacagttcaattcatctcattacactgatctgagctggtttaagtatttttttttttagaaaggctgttacaaagcgatagaggcacctttatttagagttgtctatgttcaaaagccactacgtttcctgtgtttcacattaagtcactgagctagagaaggcagcttcctgtcagataaacataagaacgaggcatttgggacagtctgggtgacttaatctaactgggccagaatcggggagaagatttgagaactcgctgtcctctgcgggtgaggaggtcaaaggcggggtcttctttcatttctgtccctatgctgtaactccgtgtttgggacagagtcagctcctagtccttattgcacaaatggggttcaggtctcattggtgtcttca

SEQ ID NO: 161767 - DNA, 279 bp, Homo sapiens
cacccaccctcacacctctttatcagaagctatcattgcatctgtaaatgtcttagtctgtatcactaaaagaaaacaatattcctttttatttttttaaaactgagtcctttgtgttaaaacaatactattttaaaaagcaaaatcataataccattatcacacctaaaaaattaataatttcttgatactcagtcaatgctctctctaaagaactctcccaacaagactaccatgctccagtgctatttaatgaccacctcagaaagctggtactag

SEQ ID NO: 161768 - DNA, 171 bp, Homo sapiens
ttcaataaacctccccaaaatgcagatctgatcatatcattgctgtgctcagaagccactgaattgttataatgatcactctatcttacaaaacactcaaaggattatgtgaacaaactttaattatacttatcaatcctcaaaccaaacccatttgatctagcttgtgat

SEQ ID NO: 161769 - DNA, 528 bp, Homo sapiens
gaaagacaaccaaaaaacccaccaaaccctgtgtaattttctttgaagagaaaatatcttcacatggttcaaatataaaaaaatataaaaatatgtttattgaaaaatttacactccttttctatcctgtgtcagcctggttcccatctcccccaagaggtaagcactggtgtcaactcatttattcttctaacgattttgtgtagtttcaaacattctcttccttttaaacaaatgacagcattatgcacagtgttctatacctctatgcctttttaaattaaaagagtatttcagaaattatttaatattggttcttctttatagctatataatattccattgtgtggatgtactatgattaacaaatcccctgctaataaacagttaggtttttccctcttttcccttggccaaacaaagcttcagaaaaacatcttaaagcattatgtgtataaatatattagtaagataaatttctagaaatggaattattaactcaaagggtatatactttttttttttttt

SEQ ID NO: 161770 - DNA, 471 bp, Homo sapiens
gagaacatatccttgatttgcatgaaggttgagaattaaaagaacaagctagatagttctggtgagctgtctgatgtagtcaccactagccagatatattggtatgtaaattaactaaaaataaaatttaaaatgcagcttctcagttgcacttgccacatttcaagtactcagtagccacatggggctagtagctactgcattggacacaacacagagagaacattttcatcatcacggaaagttctactgggcagtgtgggtttagagcaatgatgtaagtcttaaagggctagacaaggatcaaaaggagaggtaagaaaaagaaaaagaaaaaaaatcaacccatagcatatgtgagtactaaaaccgaaacgggtgcttacatctaactaaaaattattgcctgctgaagaggttgaattgtctttctactcataaaacaccgcagggcctgatctatatttaggg

SEQ ID NO: 161771 - DNA, 321 bp, Homo sapiens
acatcccattatacatactcacatatctatagggccctcagagacccgtcattcaagcaaggcctactctgtcagtctaatatagtgtattagtccattttcacactactgataaagacatacccaagacttggtaatttatacaggaaaaagggtttaatggacttacagttccacatggctggggaggcctcacaatcatggtggaaggcaaggaggagcaagtcacatcttaaatggatggtggcagccaaagagagagcttgtgcagcaaaactcccccttatagaactatcagatctcatgagacttattcactat

SEQ ID NO: 161772 - DNA, 277 bp, Homo sapiens
attcagtgtaagaacaataactctatttcttctctgaatttcagtgggggcaagagtccctagtgattatctatcttacccttagagaaaaaggaagaaaagggaaagaaaaaaaaggaccttttggtttgacctgatctagatatctgagtatttttcctttgtattgatgagcgtgggagtggttttgatgagctttggggtgtgtgtgtatgtgtgtgtgtgtgtgtgtgtgtgtgtgtgtgtgtgtgtgtgtgtatgtatcatccctcaactg

SEQ ID NO: 161773 - DNA, 558 bp, Homo sapiens
ctccttcctaccaatttaaatgcttctcaaaatctctctcacatcccacttctttacaaagtctttcaatgctcattttcgtagctaacaaaattgagtctcagagagtatatgacaatgactccactgattaacagcagagccagtaccacagagttatttcacctctgtagccattactttctgcatagcaaaggtaggagtttaatgtgaaaatttctcaggtctccctggctctaacagctatagatgcaagtgggatggctctgcggtgagaaactgggcaggtcactatgggggaacagagcagttcaactttcatcttattcacatatggtcataccaagtaaaattttgtgtgaaccaaaatttcaagagcttcagaaaaggagcttgaacaccaaggatttagcctagcctcatcttatggattagaaatataaggacctttcttactcaacatgtccaattctgggaagtgagatgaaagccttaattgaggggttgatttgagtcagtacagagaacaatgggcttctcacaaaagtaaagcacaca

SEQ ID NO: 161774 - DNA, 488 bp, Homo sapiens
tgagctggcaccttgcaaatattgtacttgtctcatgggttctgttagtttgagaaataaaaaatagaaatctaatttaaaaggatttctaataactcagaatagctaatgttggtttcctctgaggtcatatgagcctctcgtgttggtgcttttctcttcattgtgtattatagtgattagatattggctatgaaaattattacttttcatttgtttgtgtgtttggaggttgattacctagtcacttgtttataacaaaagctgtaaatgatactctttgacagagttaaataaggctatcttcatgcccttgtgaaatggaaattgatgaaaatgtaacactgagtaccttttatcaacataaatttcaaaacatggaattcagaaggattcatccaacacatactcttttctattatctggattaatatacctcacttcattcattcactctaatcaggttcatgacctgaagatgatttggc

SEQ ID NO: 161775 - DNA, 291 bp, Homo sapiens
gcatcacccaacctgcagtggggcaactccaagctgaccggttacatacttctcaataggcaggtaggtctcagtgaataaagaaaaatggtcctcactatgcacaggctataaagggactagtatttcagtttaatcatgagaaaggctctctgctttaagaagcactctacatgcgtttcccaagccaaactgctggggctcaactgtgggttctgctccttcctggctgcccaaactcaggcaagtgactttatttcctccatttcctcatctataaaatgggagtag

SEQ ID NO: 161776 - DNA, 288 bp, Homo sapiens
atccttcagtttttgtagaaggaacagctttctctcagcactgttattttttctgttcacatcactaacaggataactgccataaacatacttggaaccaaaacatatgacttttggtaaaaatatcagctggtgggggagaggtaaactccttcctaaaaagtgagccctggccaggtagagtgactcacatctctaatcccagcaccttggaagactgaggcaagagaatcacttgtgcccaggagttcaaaaccaatctaagcaacatagcaagaccctgtctct

SEQ ID NO: 161777 - DNA, 320 bp, Homo sapiens
actactaacaatgaaagtatgaaaacagtatataatgtattcttgccgaaaaaaccaacttgatcaaccttccagatcaaactaccattttacaggaaacacaaggtagcaggaaacagcatggggatgcaatcagtaaaatctagagccagagaaatgctaaagaacaaagacccagtttctccacaaataaaatacaaagaaaacaaaatataaatttagaaaggaagaacttacagattaaattcaaattaaaaggtatattagcctactgctaagatggcaacattgccaaattaatctacagattccaacaattc

SEQ ID NO: 161778 - DNA, 269 bp, Homo sapiens
gtccgcctcagcctcctaaagtgctgagattacaggcatgagccactgtgcccccaacagatctgactttttagaaacgttttaacttcaaaataattatagattcaaagttgcgaaaagatttacaagggtcccatgcacccttccaagccaccccttacctggctgtctttcctcattgggcaggtgagagatggtggctctctgtcctgagggccaacactccaggaacccttacctctacatgctcagtcctcaccgacaaggac

SEQ ID NO: 161779 - DNA, 627 bp, Homo sapiens
tagaagatcgagtggggatacggcatgcgccacacgccggctaatttttgtatttttaggagagacgggtttctccatatggtctggctggtcttgaactcccgacctcaggattcaagaagcatcctgagttttcattactctccaagtattaagatcttctttaaggtctatcaataagctttagtaattttctctataaaaattttatacttcttttgctaaatttattcctaggtaccatatgttaatactttttaatgaaattgtgaatggcacctttttaaaaattacgttttcttaatgtggcatgttcactcttactcatattctctatcatctctcctggtgaatcctgtatagagagggttttttttttttccatccacctatataaaaataatggcttttttctagagaatatatttttaaatttcaggagcaatacacgcgggtaataaataatttaattaaactagtagtttacggatttaaaagtaaaagtctcttttcacaggctctcactggctcttatcccattcttctctccagggataacgctattaacagtacatggtgtatccttaaaggctgagagcttgtcatcagaactcaggatgttctgga

SEQ ID NO: 161780 - DNA, 348 bp, Homo sapiens
tagaaggaaaatttctttccaaatgtcttcttgaagcatatagtgtatataagaatctacctgtatttttgtcattttcatacacttcagaaatagttgtagaaactttatggtgcgatgtgcatttaccatgaagaacaggctttgttagcatttacctaataagttcctagtcattttgattaattcagtcttgttgacatgatctcatataagatctaaccacaagaagctggtgcttaacctcgatcctctcatttatcattgggattttagtaggatgctgattttgaataagttgaacaccttctaaacttttttccaaaatccagtgctgctaaaaacagt

SEQ ID NO: 161781 - DNA, 594 bp, Homo sapiens
tcttcgttggcatataataaggaggggggttaaaaatcagtaatacaaacgaattccttatcttagaattcttaaaggtgacactcctaaacaggttttttctcccctaaaccatgaataaataaaactgctacagaaccccagtggaaataacaaaagcaatgctatagtgctactatttagctttagttataggaaaatgaactctgctctgagacgataaaacactaagcagcaaatcacagtttttgtttgtttgtttgtttttgagagagtgtctcgctctgttgtccaggctggagtacagtggtgtaatcatggctcactgcaacctcagcctcccaggctcaagcaatcctcccacctcagctctctacccacccctaatagctaaaggaactgacttagttcttaaatgtcctcagcttctctctgttttcaagtccattcagcatttaacctaggacccagaaaggctgaatttaaagttacacagaacctgtcattcagattccttctacaaatgaatttctcaagcttttctaaatatttgacttccagcaaaaaaaatgcatttcgactttaaaacaatct

SEQ ID NO: 161782 - DNA, 273 bp, Homo sapiens
agagcagaggcccaaggcaggaatgcacccagcaagtccgagaagaagcagaaaagccaatgtggccagagggagagttgagaaagagatgtaggaggtgaggtccccgagccgcgctaggcagagacagggactcgtgcggacgtgcctttggctttgggcgaaacagggatctggagggctctgagcaggcagcactgtgccctgactccacatctccctggctactgctggagaacaaaccaggcagcagggaccagcagggtgacctgc

SEQ ID NO: 161783 - DNA, 354 bp, Homo sapiens
agtaaccaaatcaaaacagggttcggtcagcagagccaccaggcggatgtgagtctagccagaggcactgggaggcaggcaggagaccccactcacttgttctggaaggcttccctgccccctagacctgagctcttccatccctggcacccaggcacgagatttcctttcttctttttttttttttttttttccctgagatggaatctcgctctgtcgcccaggctggagtgcagtggtgcgacctcggctcactataacctctacctcccggttcaagtgattctcctgcctcagcctcccaggtatctgggattacaggcacatgccaccatgctcggctaattttttttt

SEQ ID NO: 161784 - DNA, 473 bp, Homo sapiens
tcgtaattctgttccaccgctgttctcggcctttctgatttctcggtgattctgttccgccgctgttctcggcctttctgatttctcggtgattctgttccaccgctgttctcggcctttctgatttctcggtgattctgttccacagctgttctcggcctttctgatttctcagtgattctgttccgctgctgttctcagcctttctgatttctcggtgatgctgttccaccgctgttctcggcctttctgatttgctgtcttgtgtctccatccatttccttctctacatgggtatctggggtgaggtatgtcgggatcactggctgagagctgggccgggggcaaaaatgcccagaggacacttcctctgagtgcagggggcagcttctgccagagctgaggggctgcagtgggttgggaggacaggcgccagtcttgcccatctggctggttgagaaagaagtaatgaa

SEQ ID NO: 161785 - DNA, 389 bp, Homo sapiens
ttggctagggtaacgtgaaggccgggtaaactacacgtcccaccatgcattgctgccttgttcagagtaggtctctacggaaacaggaaaaaaaaaaattctacaagtcccacctgttacttcgtttctaaacacctcctgcactttcggctccaacaccaaacaaaaacaaaagcctcgtgatctctcgtctgctccgggagccagacaaacagggggcccggggtcacaggcacgtccgctgtaacgggtaaattctatccagctccagcgctcccctctcctttccggggctggatgcacgcacaagccttctcctatctgcatccaatgggggctctccagccgcacaagggagaagaaccggttaccgtgcaagcaccacagac

SEQ ID NO: 161786 - DNA, 385 bp, Homo sapiens
cgagggcgtcctggtgcttaccacctgcaaactggagaggtggtgggagaactcctggagagaccctagtgtaagccttccagtaattaattgaagctgagcgctcaggtgagtagtgcgacatttagcgcccgctggatgaagggcattgcagacaggaaggaagccgagcctcgtgatctctcgtctgctccgggagccagacaaacagggggcccggggtcacaggcacgtccgctgtaacgggtaaattctatccagctccagcgctcccctctcctttccggggctggatgcacgcacaagccttctcctatctgcatccaatgggggctctccagccgcacaagggagaagaaccggttaccgtgcaagcaccacagac

SEQ ID NO: 161787 - DNA, 206 bp, Homo sapiens
cttgatgtcactgctcttagcacttggcaatactcaggttcagagggactgagtacagggaccagtatggcatttggcatagagtctggcctggcgtaggtatacaacaaaagctggatgaaagaatgaatcaacaggtggataaatgaaggtgtgaatcatacataggtgcccagcaggaaaagagctggactccaaatgactac

SEQ ID NO: 161788 - DNA, 419 bp, Homo sapiens
ccttctgtcaataaggtaaaagaggaggtaatatgatatgtgtaacttccaggaaaaagctttcagatctaataaacaatttgtcactgtttgagagatcaaggaagcaagtgttgagttgaaacctctttgagccaagatctccttgccaaggcacattagacatgtagtatgaggaagaaacaaacttttggtgtgttaagccattgagagaattggtggatatttgttatacagtacaacctaaattagcttgattagtcacctgtcgatatctgtttctgtaccctcatttcttcccatcagaagctgtgtcttctacacagtcctaggcttcagaagacactgactccagctccagctccacagggtggttcagtataagaatcatggtaatattagttcctaatcactaactg

SEQ ID NO: 161789 - DNA, 193 bp, Homo sapiens
aggcaaaaggaaaggaatgttctgagtgggtctcaaaagtgattcacaaaacgtacttcagaggggaagccaaacaaataagcaaccctgagagcccagcagccaaagacaaaaatagcagcaaagcacaccacttctccctggagtgttggctgacggtttctctgggaagtggagcggaaatggacttttg

SEQ ID NO: 161790 - DNA, 295 bp, Homo sapiens
tggtatcagattagatatagatacaactaaaccaaagggtcatttattttagaaaattttccgtttttttccaaacaagaaagttattgtctactcacataattgtttaaattgaagtccatattcgtaaatgacattttatgcttgcacttgaatattgtataatttttaactaaatttggttattgcattaaatgcttttgaatattacttttaaattgaaaatttagttaattctatgtagttttacaaaaatatagcatttaagttttctatccatctaacatcaatgtta

SEQ ID NO: 161791 - DNA, 139 bp, Homo sapiens
gattttctgtctggatggtctgtctgatgctgaaagtagggtgttgaagtctccagctactatttttattggtgtctgtgtctctctttggctgtaatagttgctttatatatcttggttttccagtgttgggtgcata

SEQ ID NO: 161792 - DNA, 461 bp, Homo sapiens
tagctgttctagaggatacaccaacgctgctcacattccagaggatgacaagatgcccagagaagtttcggggtcttgggtacgaattgaggatgatgtagtggtgactcaggactcacctctcatcctttctgcagactgtcccaaagagatgaatgacattgaacagatatgcagccaggcttcttgaccttcactgcggcccacatgcacctcaggttcaaaatgggtgtcttctggcagccctgcacgtgtgctttctgagtgtctctgtgtgtgcattaatatatgcattccatttgggagcatagcagctgtgtgaatgtatgtaattgtgtgctgagagcgtaggccaaccttcacacactttaaacataacaacatgtaaacattttgcttgctacatgcttgttctgtagcctgaaaaatatattgtcacagacacagtaaaatcagctcaa

SEQ ID NO: 161793 - DNA, 453 bp, Homo sapiens
atcacgaggtcaggagatcaacaccatcctggccaccgtggtgaaaccccgtctctactaaaaatacgaaaattagctgggactacaggtgtgagttgccacccctgactaatcttactttttttttctgtagatgaggtctattttacctaggctggtctcaaaactcctggccgcaagtgatctcaaagcaaaggaatcacacgcatgagctgctaggcccagccacttccatctttaaagtggatttttgggagaatgttagaaagatttaattcttgaaggtatacactgttgagcatttgtcacgtttcagtaaataattgagttcttggagcccagtggttttctagaaactttggtgagaaatctagacttaaaccttttaggtagagctggttacattatccaaggtggatttattctagcaaatacttatgtgactactctgct

SEQ ID NO: 161794 - DNA, 406 bp, Homo sapiens
tgatcctcccacctcagcctcccgagtagctgggactacaggtgtgagttgccacccctgactaatcttactttttttttctgtagatgaggtctattttacctaggctggtctcaaaactcctggccgcaagtgatctcaaagcaaaggaatcacacgcatgagctgctaggcccagccacttccatctttaaagtggatttttgggagaatgttagaaagatttaattcttgaaggtatacactgttgagcatttgtcacgtttcagtaaataattgagttcttggagcccagtggttttctagaaactttggtgagaaatctagacttaaaccttttaggtagagctggttacattatccaaggtggatttattctagcaaatacttatgtgactactctgct

SEQ ID NO: 161795 - DNA, 432 bp, Homo sapiens
tgggagcggggaggtcagttaggaggcggctcttgcagacatgggaatgtgaggtgatggtggcctgtaagagaggggtcaggacatattttggtgttaaagccaacaggacttgctggtggattggatgtgagatgtaggggaggtggcattaaggatgaccctaggttttggcctgaacagttgggtaagtaggaagattaacaaaggcgctgggttaaaagggagatcagtagctctgtttggggtgtgtcaggcctgagatgtcatcagacagtcttctactggagccagcactcgagagaggtgagctgagggacaggccatttgtgagcatcatgtggtcctctgaattgccccttcttcccatggcttcttgtcactcttcctctccttttgatttttttttactcaaatagatggtctgctttt

SEQ ID NO: 161796 - DNA, 399 bp, Homo sapiens
tggggcagtgaagtgatggtagaacccgaggctggaaaggtgattgaggttcatagtttggaaagcccaatatgtcatagaccataaaatatttttgacagagcttgcatgatctgggttttacctggggaacattaatctggcaatagcataggacagtgtggagtggaaatagattgaaggtagagacaccagaaaagttattctgcttgtctgttgaaaaagtttgggagaatcaggactgggagatgcaagcggtgtgaaaagcatttgccccatagtgggtgtgtagtaaggagattgtgaatgaataaaaggaagagatggatgccagtgacattgcaaacacagaaatcacaggacttgcaacaagttagatatggaaaataagagatgaag

SEQ ID NO: 161797 - DNA, 636 bp, Homo sapiens
ttgctttcagacttcagaaaagaggagtttttttaaataaaaccttgtctggccctcccgcaatggatgcagaaggtagactgttttctttcttttaattcacactcagacgttttcgtaaggggcttggtcctggcaaagtgggcctcacatacaaaccacccactttcctgaagcgtgattgattagcaaagctgttctgctcaagggcagcctgttttccccagcctggatgctgacaggtccgacatgcacagattttcaagcaggtcgccagtccccaggctgcaggctgtaggccaggacgcttgttcttgagggagaagagaggagaaggaatccactccgggggcaagaattaagctatattatagaattcccaagacacagcagggcaggccaacatagtccttgtttagagagcccctgatggtgttgggtgccaagaaaaccatggctgcacaagacacacagagtgaaggtgaatataaagatgtttaggcaaagcctgtgcatatggtactgatccccatttgtctaagaacctctaaacatcaaagagagttaaagaaagatagaaatttgatgcctaatcaaagtagcctatgatggaagtttggaaatacagccaagcaa

SEQ ID NO: 161798 - DNA, 454 bp, Homo sapiens
ttgctttcagacttcagaaaagaggagtttttttaaataaaaccttgtctggccctcccgcaatggatgcagaaggtagactgttttctttcttttaattcacactcagacgttttcgtaaggggcttggtcctggcaaagtgggcctcacatacaaaccacccactttcctgaagcgtgattgattagcaaagctgttctgctcaagggcagcctgttttccccagcctggatgctgacaggtccgacatgcacagattttcaagcaggtcgccagtccccaggctgcaggctgtaggccaggacgcttgttcttgagggagaagagaggagaaggaatccactccgggggcaagaattaagctatattatagaattcccaagatcgtgccactccactccagcctgggtgacagagtgagcgtatgtctcaaaaatagataaataaataaat

SEQ ID NO: 161799 - DNA, 413 bp, Homo sapiens
tgaaatcaagagagagactttggtccaaagacttttttttgtaaccttcttgggctccattcttcacatttgcttccgagtcaaggagaaggagcacagacctgagggatggagtgaattctaatccaagctctgaaactgaccagctggggcctgaaagcaagactgtgacctcagtctgcaccacttcccctcccatcagtaaagtgagaggatccattgtgctaccttctgcagtccctttcagctttggtgttcactgattctgtgatgaatttcctgtaatttctgtgtaggaacagaaaagagcatagaagatcctttttttgttttttttttgttttttgttttttgtttttttgttagggagtttcactctgtggccctggctggagtgcagtggcaagatcttg

SEQ ID NO: 161800 - DNA, 158 bp, Homo sapiens
  misc_feature (120)..(120): n is a, c, g, or t
agctcctataatctctctggtctgggagatgtgctgaatgtttgttttttgtcacattcgtgaatagggtgcagatttggcaattgttttctacacatttcctctgctaagaataaatancaggccaggtgcggtggctcacacctgtaatcctagca

SEQ ID NO: 161801 - DNA, 114 bp, Homo sapiens
ctgtgggcaggtgtagctccatattccttcaggaagcacccaggtggtggaacaggcgattccacccactcccactcctcctaggtgggtaagactcacctgcttaggaggcac

SEQ ID NO: 161802 - DNA, 187 bp, Homo sapiens
ttcaccacagggttgaagcaacttccaaggggaagtgtctaattagaggtatgtcatctgcgtgggatcacactgcctgagtttgccacactttgctgaagccaaagggagagatcggctggtgttgtcttctggaataagcccagaaaaggtcaatctaatatcgcaaatattcagcccatacaag

SEQ ID NO: 161803 - DNA, 247 bp, Homo sapiens
gggagagccacaggacgggtggggcactcaagatgtgcctgttagcaagttttctttctcctcattccactaattacagcattagctacctcctgcatgctattgcttccccagcacctgagctggaattggttaagtggacaagtcaagtgtgtttatttcagtgtgatacagtacaggtattgagttgctatttctggcctaaataggcagtcacttaaggaatgtatggcaaaaatgatagctt

SEQ ID NO: 161804 - DNA, 575 bp, Homo sapiens
tgcatcttagttgtcagagtcatctttcctgtagtttcgcacagtgtaagctttgcagatggcatcctcatggcattatttgttgggaacagggcccctgaaatctggccataaactggccccaaaactggccataagcaaaatctctgcagcactgtgacatgttcatgatggccatgatgcccacgctggaaggttgtggggttaacggaatcagggcaaggaacacctggcccacccagggcggaaaaccgcttaaaggctttcttaaaccacaaacaatagcatgagcaatctgtgtcttaaggacatgctcctgctgcagataactagccagacccatccctttatttcggcccatccctttgtttcccataaggaatacttttagttaatctataacctatagaaacaatgcttatcactggcttgctgtcaataaatacatgggtaaatctatgttcaaggctctcatctctgaaggctgtgagacccctgatttcccactccacacctctacacttctgtgtgtgtgtctttcattcctctagcgccactgggttagggtctcccca

SEQ ID NO: 161805 - DNA, 482 bp, Homo sapiens
gttgtattcctaggtattttattcccttcataggaattgtgaatgggagttcactcattatttggctgtttgtctattattggtgtatatgaatgcttgtgatttttgcacattgattttgtatcctgagactttactgaagttgcttgtcagcttaaagagtttttgggttgagacgatggtgttttctaaatatacaatcatgtcatctgcaaacagagacaatccgacttcctctcttcctatttgaatatattttatttctttctcatgccagattgccctggccagaactgtcaatattatgttgaataggagtggtgagagagggcatccttgtcttgtgccagttttcaaaggaaatgcttccagcttgtgcccattcagtatgatattggctgtgggtttgtcataagtagctcttattattttgagatatgtcccatcaatacctagtttatggagtgtttttagcatgaagg

SEQ ID NO: 161806 - DNA, 543 bp, Homo sapiens
caataaagtgagtcaagaactttttggtttctcagtgcatataaaagttacgtttactaaagtatgcaatagcattatgtctagaagaatatatataccttaaaaatactttgttgctaaaaaatgctaacagtcacctgagccttcagtgaattgtaatgtttttgctggagaaggttttgcttgtgtggaagctgatggctgctgtgactatcagggtggtggttgctaagagttggggtggctatggcaatttcttttttttttttgagatggagttttgctcttgttgctcaggctagagtgcaatggcacgatctcggctcactgcaacctctgcctcctgggttcaagccattctctggcctcagcctccggagtagctgggattacaggcatgcaccaccacgcccgaataattttgtgtttttagtagagatggggtttctccatgttggtcaggctgctctcgaactcccgacctcaggtgatccgcctgcctcagccttccaaagtgctgggattacaggcatgagccactgc

SEQ ID NO: 161807 - DNA, 493 bp, Homo sapiens
aggtgcttttctagatatcttgggtgattcatgaatgttgagaatgtcacaggctaatccatggatcctctccaaggcagaggggtagctattatttgagaaggccccactgggcttgaagccaacaaagaaagggactccagcaggatataggatgtggaaatccctgaggctgaggaagcaggcacttgccaagttttactccaggttccagaattgaatcctacatgcttgctcaggtaccctccaggcaaaccgaaaacccagtaaacatcaagccttgagtgacacaaatatctggttttgttacaatctgccagattccccatcttctgttgacgagcagtttaccatgaactgcagtataaacttgggcccagggagactggctccgatttattctgacagtttatggagtttagtatttcagccttcattctcacatggtttctgtggatggttgagttactggggaactagcagtgagtgacct

SEQ ID NO: 161808 - DNA, 486 bp, Homo sapiens
actacatacttccgtgagggccaggaggctcagacactgaagcagctgggtcaggcagtgggagggatgccgcccgctcaaatccctcaagaatctcttctgaaaaagtgagcaatgaaagtttcagaccatgaattaaaacttcaggctgtgagggcctggtgcagagagagacagcctggtatgatgctaacatgtacactgtactcaaatgtttataaagtgctttttcagagtaatcagttatctcacacactttaccttggtctctggtactcagaggggtcccaaggacttgaagcagggactgccttgcctagggacactgacgtatgtgtcctgctgcccctaatttgtttcatccttcctcctttaggcttctcatgtccccattatcatggctcagctcacagggcacaaggaggccgtgagacagtgtttggtgtagttttgtatggttttcggaagtatgtagtcgggtaccga

SEQ ID NO: 161809 - DNA, 229 bp, Homo sapiens
gaagtgctttcacagtcaaggatgtggccttcctgtgagctatttcacatacctgcattgtaaattcatgagagcgaacagtctttgtgcagcacaaattaatgcaacagtttaacacaaacaattcaaatagaagactgtccttcaaggaaagaaaagtgaagaaatgtggttaatatttgtcttctaaacttgagggaactcttatgccgttgcctaccatatttgt

SEQ ID NO: 161810 - DNA, 425 bp, Homo sapiens
ccatcagctgttttttgaccgccagccaccattgggcctggggaggggaggttggcctctgagctcagtcttccccactggctcccccgagtcccctcccctgctctggttatcaaatgcattcatggttcttgtagaaaataaagtgtcagggaacacaagaaaaattatgcatgatgcttctctgaaagcagctggtccactgtcagcactgccatgatctgcacatgccctctcctgcttccagtggattctctactccacagacgggggagtcttccatacactcctatttttctcaaaatgaagacaaagctgatctctcagcatctcctgcaggccctatgttcatgctctttgagccctcacctcaccgtgctccttcctgctgcagggactgcaagagcctgggaccttctccccct

SEQ ID NO: 161811 - DNA, 590 bp, Homo sapiens
acctactatgttccaggagctttctagagtctaaagatacagcaatgaataaaactgaccaagaagctgacattctagtccagggaagatagtcagtaaagggataagatacatatattgcatttttaaaaggtaccactgtatatagggtaggcaggaaagccctcattcaggtgacatctactctcagaaggggaaggagagagccatgcgtgcatctgaaggaagagcattccaggcagcgtgagcaacaagagcaagggccaagaaggaggagggtgcctggtattttccaggaagaacagggaggccagtatgcaggagtggaatgaggaaagggaaggtcaaagaggtaatggaacagatcgtagccagtttcttaggttattctaaagacttaggcatggactgtgagtaacatggggtatgaccatacacagcatgacacatcatcaccagtgatgaaataattatgatattagagcaaggtttaaaaggtaatttagctacattagaaataccagcatagactcaggacccttcttttttttttttttttttttttttgagacagcgtctcattctgtgac

SEQ ID NO: 161812 - DNA, 643 bp, Homo sapiens
acctactatgttccaggagctttctagagtctaaagatacagcaatgaataaaactgaccaagaagctgacattctagtccagggaagatagtcagtaaagggataagatacatatattgcatgtcagatgacagtaagaaccgtggagaaaaataaagctccaaagaagtcaaagttttaaaaggtaccactgtatatagggtaggcaggaaagccctcattcaggtgacatctactctcagaaggggaaggagagagccatgcgtgcatctgaaggaagagcattccaggcagcgtgagcaacaagagcaagggccaagaaggaggagggtgcctggtattttccaggaagaacagggaggccagtatgcaggagtggaatgaggaaagggaaggtcaaagaggtaatggaacagatcgtagccagtttcttaggttattctaaagacttaggcatggactgtgagtaacatggggtatgaccatacacagcatgacacatcatcaccagtgatgaaataattatgatattagagcaaggtttaaaaggtaatttagctacattagaaataccagcatagactcaggacccttcttttttttttttttttttttttttgagacagcgtctcattctgtgac

SEQ ID NO: 161813 - DNA, 369 bp, Homo sapiens
aggctctaaaggtgaattttctcctgcgtcgcagagctgaaagttaagcttaatgtacaaatctttattttccaaagaggcaggttggccttcttgtatcgacagactccagagcttagatttattacagaatgataatcaggcaaaagaataaatacgctgcatctttaattcattaatcacctcggaaagcaaaatgaactacagtaaagaggacaatatgttttcaaatgttgggggtgggggaagagggagtctgtttctcaataaaatccagtcgctaaaatccattttgcatgcagattagagaaagggcattttacctctgcggctgtagttcagataggagctggaagctctgcaaaggaa

SEQ ID NO: 161814 - DNA, 462 bp, Homo sapiens
gcttggctggtttggggcgtttctgtgggtggtggcccacaggactcttttggacctgggacatggccatatagctgctcatccaacctgtgggcatatctgcccaaggggctgtttctcaggtctggaatataagtacaaggctgcttggctggctcaggtgtgtgcccaccaggagcagcctgcagggctgtttcatgcctggtatgtaggtgcgcagctgcctggccagcctagggaatgtccacaaggagtggctgatggggctgttcaggttcaggacatgggctgttggctgcttggctgttctggtggtatgcccaccagggctgtcctgtgggacagtttctcatgctcttttagggggcgtagaactattaggcaggccagggatatatctgtagtgggtgggggcactctggagccagttctcaggtcctgtgcataggcatgcagccattc

SEQ ID NO: 161815 - DNA, 559 bp, Homo sapiens
gagtagctgggattacaggcgcgtaccaccacgcctggctaattttttgaatttttaggagagacagggtttcaccatgttggccaggctagtctcgaactcctgacctcaagtgatctgcctgcctcggcctcccaaagtactgggattacaggccttagctactgagcccggcccattctcaattccaaccactgccatcttgtccctggcactgcttttggtgcagctgtgacctctgtggcttgaagctgatggatacttcttagtcattatcttacttgactctcctagcagatttgaaccccattgattcctccctcctcaaaaccatctttccttggcttctgtggcatttttattcttttacttgccttcctccctctggctgccccctcatagcctcctctgtcatcttcctctgtgtgtgctgtgaatgtttgtgcacctcagggtggtctcagaagtcagctgtcacggaacacacttgctccatatgcttcaactgtactcaagtctccagtgtccatctgcatactagtgagtcccaagtctctgt

SEQ ID NO: 161816 - DNA, 361 bp, Homo sapiens
agatgccagagtattccaaaaattaagcaaaaagaaaaccaatgggaagggacttcaagattagtatggggtatgtcagccagtcacacaaactaaaaagatacctttcccactgtatggcagatccatgaagagcaaccacacctttatttttgacaccattcacctccaccaccctccaaatataccaacaggttacaggtcatttggcctatcaccagcaaactagatccatcatattttcctgaatgtgaagtgaaaggtctatcaagtaaagattatgtgggaaataaccaaacataagaatgatggtagggttgctaagcctggtggcataaactaatagtcccagctactcagg

SEQ ID NO: 161817 - DNA, 377 bp, Homo sapiens
actcttgattgttcatgctactgggggaaaaaaaaataagtagaaattagcctaatagttgtggcttattttgagtgaaggccttagcccttaaggcaattaaatttactgtggagagaagagctaatctaatggggagaaggagcctttgttacaggtgtggtagtgtggttctttgagtgacaagatttctgtttgccagattggttaggagaagtctgtgtgtctgctttctctcttatggcctaggatcactgtggtgaatgaaaaacctgtctcagggcctgactcagataattcccttaaaacccggctaaggtcatagatgaataatcagtaattgaacagaagctctgcaatagaaaagaagccagata

SEQ ID NO: 161818 - DNA, 326 bp, Homo sapiens
ctgggattaccaccgcatctggcctcattcactcatccttatacagggcaccactgatttgattttggcaaacagaatgagctaatacaacagtttgctggtgatagtctttttaaaagaagcattttccaaagtttgattagatagtacttttggttcaccaaaaagttatgatgaaaaaagtattcagtgctcgaattaactggagaaaaacagaattaaatgaaatcaaaaaagattctttacagccaagtttcttagaataataacctattttgtgagtcttttgaatggtgagaattagatttaataaagtagtatacata

SEQ ID NO: 161819 - DNA, 425 bp, Homo sapiens
aggcagacactctatcctaggaaaaggtgcataagtagaaagcaccctatattgagggaacacaggtaataacccagtgtcttagccaagatgcccagtgggtgctaacaggccagggagagaaggaagggggaagccagggtccggcaggatcaagtcatattctagatttcttctgaaagaagagcacataggaatctaatgattggatgagaaatcaagaacaatttcaaggtttttgactgattgactggaagaatgaggagattgttcactgtgatagagagacccaggtgcaaatgtgggggaaaggagatgaagagctctgttttggacaggttaagtttgagttgtgaacccaaggagacttgtaaagtaggcagttgactacacaagtctggcattcaggggaagtccaggttgga

SEQ ID NO: 161820 - DNA, 322 bp, Homo sapiens
tttggtggctccatttaccagaaggtgagtaagaagttggagaccactgtcaatttcacctggacagcaggaaacagtaacactaatacggtttgtctgtgtccccacccaaatctaatcttgaattgtagctcccataattcccacgtgtgtgggactgacctggtgggagataattgaatcatgggggcagtttccccatactgttctcatggtagtgaatgtctcacgggatctgatggttttataaggggaaactcctttcacttggctttcattttctctcccgcctgccaccatgtaagatgtgcctttcgccttc

SEQ ID NO: 161821 - DNA, 374 bp, Homo sapiens
ggaggggatgaactagagaaggaaatggggccagaccctgtgggggcttgtgtgtcatgccagagagctagggctttatcctcagggcaaatggatttgaaacaatttgacatgaccaagtttgcatgtgtaaagcatgaagtagagggatgaaaccagagaaagtgaaaacagagggactataatttatagatgacaatgggtatgtatatttttaggtgggtacagattaccaaacaaatatgatttctgagactgcataatcatgcactaagtggatatttcttaggggccgtttaagaaaatactgtaaatggagttatctataatatttaagggcttactactatattgtaatcacaaagtaacccaca

SEQ ID NO: 161822 - DNA, 1375 bp, Homo sapiens
ccccagcatcctgggcgtgaacgcacccagcttgattgtcacatggggaatagagacctcgcgcctgcctggcataggccaacccagtaatgttcatttaaagctggctttactagtccttcttccacaatgagaggtgacccttcacttcaccgagaaaggaaggaagaaagcataatatttcatcgcgtgaagaggccatgatttctccgttccgctgaggatcgattgagctgtttccagtttggggcgcgatgaacaatgccgcagtgaggattcttgtcagtgctggcgtatctcatgataggtttggaaataaattctgatgggaattaaaactggtgtaacctctataaagggccatttagcaagaactgtcaaaatgtaaaaaacatgcgcccttctgggaattacttctacagatctgcccgaacatgcaaaatgtctcatgcaccaggttcttctttgcagcatttgtttgcaaaagctgaggtgtagcaacaacctaaatatccatcaataaatatttatccatccatagactagaataccaggcagccaccagaaggaatgagaaagctcggtaccagcaggacctccaagttaagtaaaaaagcaagatgctgaacagtacatatagttctccaccatgtagattaaaaagggacggaatacatttgcttgtatttgcataaaatatctatgagtatagtcaagaaatagataatatgatctatgtatgcgggatgcggggaaggaagatgtttccgtgtatattccttggtaatcgttgaattttaagccatatgaatgcattgtctactcaaaaactcaatttattgtgaaaagactaaaaaccactgaactgtacacattaaaattctatggtatgtgatttagatctcagtgaaaaatatatattgaggatgggcgaggtggctcatgcctgtaatcccagcattttggaagtctgaggcaggtggatcacttgaagtcaggagtttgagaccagcctggccaacatggtgaaaccccgtctctactaaaaatacaaaaattagctgggcgtggtggcgagtgcctgtaatcccagctactcaggaggctgaggcaggagaatcgcttgagcctgggaggagccagaggttgcagtgagcccagatcacaccactgcactccagcctgggcagcagagcgagactgtctcaataaacaacaacaaaaaaaattacatttaaaaaaacttaggctatggggcccagcgtggaggctcacacatgtaattccaacattttgggaagctaatgccggagaatcgcttaagcccaggagttcaggaccagcttgagcaacagtgagattccatctgtatatt

SEQ ID NO: 161823 - DNA, 299 bp, Homo sapiens
gaattggtagcaggcaaatccttaaagtcaatgaaagaagccttaagaaagatcaatttcctttgcttcacaataattcaaacaaattattttcttggtaaggagtaagtcctcaatgcctgatgaaactacattggccttctagttgttagattctagttaagaatattttaagtacatacacttaacaactaaaaatatttaaaactacttcagatagtagtttacagagtggccaaaaatctccacatatttattttacattcatgtgcttcttatctctaaaccactgtcatttt

SEQ ID NO: 161824 - DNA, 209 bp, Homo sapiens
acaggtgctgagacaacatggtgaaacctgcctctactaaaaatagaaagctactaaaaatagaaaaggaaaaattagccaggtgtggtggtgcactcctgatcctcccacctcagcttcccaaagtgctgagattataggcatgagccaccatgcctggctaccattctcattcatcattgaactcagactaggttccatggcctggc

SEQ ID NO: 161825 - DNA, 198 bp, Homo sapiens
cccccacttctaaaactttgctcctgtggtgtcacctgccctttctcctgggtcccttttgcatcccatacagggtcctcagggcctaaaacaaacccccttccacgtccctcctctgggctctggcagcttctcctcagcttcacaataatgacaccatctatgcacctagcggtgctgcatgtcttgtgatgtgcc

SEQ ID NO: 161826 - DNA, 355 bp, Homo sapiens
tttttgataggtagtgaagctaaaacagtttccaaaagtgaagtggtcaacactatcatatgtttcagagagagccactgtgatattgcgatgtggaagtcattggtggaaatggtgcaaatagttttagagtattggaggaaaagattttgcctgagttcctttatctccttgtaattcatgtcagtcctctgtgaacattaatataattcaacaggtacccctatcaaaagacgatcgtcttttgataggactcactgtctctccgtctctctctctttctgtctgtttctctctgtctctgtctttctgtgtgtctgtctgtctctctctctatttgtctttctccctccct

SEQ ID NO: 161827 - DNA, 300 bp, Homo sapiens
aaaataatgataataattgtagtagtagtagtggtggtggtggtggtggtagtagtagtagtgaatgccctgactttggggtttgcagtaagctaggattaagtgcttcacagtgaggcacagtggggagctactctgaggatgaattgcctagtaaataagtgaggtttgtataaccgaggccagatcttagaacctcctgctatctgtacatagaagaatgttttagtcagaggcaaggcaaggtcaccaggattcactgagagtgttggtcagcatttcatctgcatatacaggact

SEQ ID NO: 161828 - DNA, 720 bp, Homo sapiens
ggtgtctaactagtcaaggagcaggacagagcaaatacatagttctgcaaggctccgtagcccactcctacagccacatggacctctgggcctctgttctgatctcatctagatttttcatctagtatactagtgccgtttctacctagaatggctgtcatctgacaactttttagtagtttagaattcacgtaacttgaaacttggtacagaacatccctgttgtctttactggcagtcgcagcagaaaccaggctgttgtctaactgtgaaggtagtgtctgagcacaagcctgaagctccaggggaggacagatttttacatttatttgtggactctggacatttggcaaaatccattgcactcaatagacagcagtcaaattaacagggagattgttctccacttatcgaaactgtcaaaaaactgagggaaggggggattccaaagagctgctcctagtgcattctttttatattaatggttagtgaataccagtgtcagaagttcacatcacagtacgaataagatgattggattttaatttttagacaaaaatagtctttccacattctaggtcatgctgataaaaacttttttgcgaaccaaactattcagatagtctgtaccaagccttacctatacgcagctagaaaatacctagagggctttattcattaacaaattatcacacatgcatgctgctcagagagtatgtt

SEQ ID NO: 161829 - DNA, 381 bp, Homo sapiens
aacactccatttcaaaaaaaaccaaacaaacaaaacaaaacaaacaaaaaaaaaaaacttgggaccatagtgaaattataaatagttttcttatttaacaaaattctatgagcatctttccatttcattagatactctttaaaaacaaaatggctaaaggttgcctaggttcaccatatgggtatatggttacccagtaatctatccatttatctcattctctattgtggatattgaggttatgagcatttttgccattataagtaactgcatgcacatgtgtttcagcagatgttttgtgggtgccttctggtgccaagggggctgggggagagaggatgaataactacagtgcccaactcactgctcatgtgaaaagga

SEQ ID NO: 161830 - DNA, 326 bp, Homo sapiens
tctccctactgtatcctaaagaatgacaataaagagccatttttgggctctcatccaacactacccatctactaactggtgtgtaacatccatcaggctttccaaacatcaccaagcagagtataagtttatacaagtacttacatgctttgtgtataaaggtacaatcaattaattcacacaatgcatttgtttattctaaagcaatccttaaatatcttgaaatgtgaagatagtacttccaagttacaaagtcacactcataatgagtcttaattatcctacctctttaaaaattaagaggtagatacgtaggagagtccgcg

SEQ ID NO: 161831 - DNA, 399 bp, Homo sapiens
aggatggcccctggtggtaggcacaagagcagctccaaagatgtctatgtcttcgccctgatccccagaacctgggaatgtgccatctgacatggcagaagagacgttgcagatgtggttccattaaggaccttgagatgggagattctcccagattgtcgagttggtcccaatgaaagaggaaggcaaagggtcagagagaggctgggagatggtacacaggtggctctgaagatggaggaaggggccaagaagccaaggaatgcaggtggcctctagaagctgaaaaaggcatgggaagttcagagaccggacctgctcagcaatcttgctaactaaattctgacctcactaatgtgtagaccaaaagcacaggctattaatttgcagggttaaggg

SEQ ID NO: 161832 - DNA, 723 bp, Homo sapiens
gctgggattacaggtgtgagtcaccgggcccggacttagtgttcttaacacagtttggtttataattttcctttctttggtttttatatcaggataatgctggattccaattctctagaagaatttgataaaacttctgcaaaatcatcttgtgacccatctttgttttttctatgggaaatttttgtgtcatgaattcatattcttaaattcaataatagaattattcagatttaggttttttattatgtcagtctttgcccatcatttttccagaaatttgccttttgcatcaaaatttttaatttattggaacggtgtttattatatattctttttaatgcctgtagtatctcttctgttattccctgttaattcatgataatgataattttcctctctttttttcttgattagtctttttgaagtttattgatttcatcagtttttttatataatgaggctttgggtttgttgatttttctccttcaaattagttttctatttaatcattttctccttttttctaatttccatttttctcagattttaatttaatatgctactcatttttctatctttgtaaggtatatttttagatcctttacttttaacctgtctttaaaaaaaagtttgaaggaataattttacttgtaaacagcattagttgcagtcctgaaattttaatattattaggttttcattttcttttatttgaaaagt

SEQ ID NO: 161833 - DNA, 332 bp, Homo sapiens
tcaacagacgtgactgtccatttctggtccctgagagaactttaggcacagggctgccttgccagtgcttcaaagccaacatctgagtccctggagcttgctctacccttgagacttacccctgcccacctcttggcccaggcaccaagctagaggggcagaacctacactgaatccttcccctcctctgttgattcatagttctttatctcctctgttatcctccctcccctttggggcacggctgatttttatcctctctacaggatacaaggttggctggtcccaaaacagtatttgaaagtggtgaaagggagttgataggaaagaga

SEQ ID NO: 161834 - DNA, 555 bp, Homo sapiens
gagaaattcaaatctcaaaatattattcctctgtcaccaatcagacttccgggattcactttcctggtgtcaaatattcttttttcagaaaatgcatcatgagtttatattaataattttaaacataattagtaaagtaaatcttctgaaaaaaatctaaattattttggagcaatattctattttgagatcaactttattaatatgggtatcaagagataaatttagattaaaaatattaccatttaatgtacatgattaatagatatggttatccaaagtaactttgataatcaatccagattttatagaagacaaagttttcatccgtctcattcaagttcacttttatacctaaagttgcaaagagtattcaagttgaaaaaaggatatgatatcaagaaatctgactgatatacactcatccagaaataaagaggttatggaaggctctttctacagctatttctcaacttacatacaaataaccactgtcaattgttcacttaaaattccaaactccaaccaatatttcacagagatattataaataaa

SEQ ID NO: 161835 - DNA, 186 bp, Homo sapiens
aatctttttaaaaatagcaaacatgttatagtttaaaacagttgaaaaaaggaagggaaaataagatggacttagaaagcagccctttaatttgaaaaagttttacaagcaggaaattcagtctcatctactgatttatagcatccataaatgcatgaaaacacatggccaaatcgaactgttcca

SEQ ID NO: 161836 - DNA, 496 bp, Homo sapiens
aagcaagctgaaactcaggaaaggaggtgcctgctctccatcatcaaagaagcaggaaaacttgtccttccttgttggaaatgagtaaaacttcagaaaaggagttgtacagcaaaatcaaacttagatctcaaccagattttgggagatcagggactctttgcaggggagaagctccacaacctcagcaaattatcctgttggtttgggcaataaagatagcccaggttggtatcaatcaataatgagatttatcaaaggtcaggaccacctttgtaatgtccttctctgtctttttttatctttattggtatatacgttttgtcgaaaataggagtgcaacacctgatttcttctgttttccatttgcttgaaagatttttcaccattccttcattttgagcctatgtatggcactgcatgtgagatgggtttcttggagacggcatagtcaaatgggtcctgatttccaccttgccaggataccgagctcgaa

SEQ ID NO: 161837 - DNA, 187 bp, Homo sapiens
gatggctcaccggaggaaaactccaccggcggatgccctcccacgcaggttgtacccgtgaaaccaagataatgaacattcataatcccagtagtttcctagtgtccctttgtaatcttgcttctcaaaactatagatcttctgtcactatagatagaaaatttactagaattccatatgaatgtga

SEQ ID NO: 161838 - DNA, 477 bp, Homo sapiens
gtcactgatgttttttagctgtttgcttccattgtagctctttgacatgctttaaaatgaaatggccacatgtgcctcagtattttcaagggatcatgtgctggtagttagttattttctctagctattctgtttcactgaacagaagctcagacacagcaaatagtttctggccaccaaaagtgcctgctgaatgcagtccttcaggacagtgtttgctggtgcccatgccaggacctgcccagggacacctgttcttagaagaatcgggcaccaggtgcggtggctcatgcctgtaatcccagcactttgggaggccaaggcagaggcggatcatgaggtcagaagtttgagaccagcctggccaacatagtgaaacccggtctctactaaaaatacaaaaaattagctagggcgtggtgatgggtgcctataatcccagctacttgggaggctgaggtaggagaatcacttgaa

SEQ ID NO: 161839 - DNA, 368 bp, Homo sapiens
tcattgtgtaccgcaaatctatgcttcgctgttctggcccatttactaaacagcagccagccagatcctttataagaaaaaaaaaatctaatattgtcaccacctgcttataaaactttaaagaattattgttcttaaagtttgtcagaaaaaactgtggaagactttgaagaaaaattacatgctataagcaaaattaaaagaccaagaaagaattgggaaaaattagaagacaaggttctaaaggaaccctgaaaaacataacagagggttcaagggtaaagaaatcatacactatgatctatcctcctctctctccaccagaatgggcaaaggccctaacagattaactagaataaacagtgaat

SEQ ID NO: 161840 - DNA, 694 bp, Homo sapiens
cactggtcattatttcctgggtcaaatctgcttgacattcaatttaatacagtctttcatcaagtcaaaaggccttagagagaaactttcactggccacccacattttcagcagggctgttgcctggtccgattcacttttgttttccaagtctttaccatcattgcatattacgcctacttctattgaaacagctactgcttttgatgatttccacagtggtgaacatatattgttcatccctgtaatgctagaagctggtccagtgcttggcatgtagtaggtgctcaataaatatgagatctgtgaaaaacaaattttcaccttacaaaggcattctcaaaatgaatttgacacatcctgctctctctacaaagttacaagctaagatagatcacagcaaagcagagatattgcagacacagattgaaaaccaagtgaaataatgatttagattgccttaaatcaaagtgactaaatgcatttttagaaagtacatgttgaaagttatcttgactagtcttccatttagccaggaagttttctggaagaagtataagtttagggattttttgtgaggtgagagggagaaatcataaataagtatgtgttctagaaagtggggtaagaccacagaggagtcctaaaggtattaatagaggtcaggaattggactttagaaaaacagaagagg

SEQ ID NO: 161841 - DNA, 1125 bp, Homo sapiens
agatggctcatgttggagcatggatgcctatatgagtactgacattcctgatgaaggagatgtgcacaatggcacttactgtgcaccaaacaaagtctgcctgaattccgcctgcacagataaaaccccagtgatttctgcctgcaacccagaaaaaacgtgtaatgggaagggagtttgtaatgatttagggcactgccactgtaatgaagggcatgccccccctgactgtgttactgcaggaagtggaggtagtgtggacagtggccctcctggtaagctaggtgggacaccttcaggagaaggtgaaaatcacaatatgactcattccagacgtgaagaacatgctgtagacatgatgatattatcattcattatactttttataatattattattaagtacaattatttgatctgcttgcttaaaaaatcaccagaggctgccccggcagaagctcctccagcagtggctccaccaccggccccagaaataaagccagaagcagcagaagtggccacagaagaaaaagaagagaaggaggaagaaaaagaagaggaggaggaggaagaagaggaggaagaatcagattcctaaggttagaaatagggagatgaagccaagtatatcaaactcctcaagtactgagtgggaatgagatgtttggtgaagtagaaatagatagctttagtggctctgactcagatatactgatgtagaaggaaggattctttcacttttattatttattttggtaattaaatttacattaatttaatatgttaaatattttagtaccttttgctttttcacatttcatttgaaccattaacatgcatctttggacatcaatgtccttgtctttttggcccaattgttttagtcaccagaaactttttcaggacatgctatcttctatttgtttgacatacagaatcatatgtacctgaatttattactaactctgggattttcattttaagtaacaactacctattatgtgaggacagttgtttatgtgattggttgttctaacttgccctataaatgtgcattcatcaaaggagaagtttttaaatccaaaaacaaataaaacccgattcatattagacaactcttcaggtt

SEQ ID NO: 161842 - DNA, 354 bp, Homo sapiens
cgctcacgctgtatacttcccttattcagcatctaccatgctgtactgtaattgtctgtctgcttgactgtgtcccaactataacaaacctgaagaagacatcgtgccgagaacagagcaggaacctaataaattttgttgaattaaagaccgagtgaataaacaaataacgttctacttcagtgtcctctttggcaaattattaattgctatgtctaagattctttttacatacagaggtgaaaaaatattctgacaaaaactgagaaagctacagtaatttttaaattagagttcaaaaaataagacaatctttctgatcgaaaagagtacactgaagtataaagggtgcag

SEQ ID NO: 161843 - DNA, 208 bp, Homo sapiens
agggctgtgaggcccgggagagggccagagctgcagctttaaattggagggtcacggcatgtggaggccaaggaagcagatgggatgtccggggagagagtatggactgaagcagctaaagaattgcagcatctaatggacaggaagaggggcagcgacagcgatggagcctgagaaggagggtgcagtgtccccaagccatgtggag

SEQ ID NO: 161844 - DNA, 578 bp, Homo sapiens
aatcccattcacgacgtttaaaagtgtctgtgcgcagctgttaaaccatgcccgtttaggatccatgcatgggagcatcacgccacccttaacttccaggtgattcaaatgaggctgtaaatcacaccccaaccattcctctggccacagtgatgggcatctaacacaggcctggccaatcatgcacccatcttcttaaaaatagggattagacctgcttgctcacccagggactaaactaactgcttctttggatatatggatgctaagagaaagactttctctccctctggggtttcaaagctgagatggtggaagccctgagatgctgacactcacctttctcagaagaaatggctgacacacagaaaaacaaattatggagtggagaaatgatatcatgtgaccctctggatccacccatactgaagctaattccctttctgtctaacctaatttgaactgggctcaacatgcaactgaaaggcaactaataaactcagtatagctttaatataaggcagtacagcctataagccaaatgcaaggccatgtgcagggactcatgcctgtaatcc

SEQ ID NO: 161845 - DNA, 521 bp, Homo sapiens
cagtttggatttaattttaagaaataatgaggtaagcatttaattttggggttagtgctttatctggtaactctgagaaaaggccatatatgttttaaaaatttacagggaggtttatatattttttttagcatattaactttttattcaacaatttgccagattttgaggtaggtaggggttagctgatttctcacgtcttgaatttcagtcagtcctatgacctgttagtctggacccagcattgctttttaaaagtttgtcttttgctgagtactttttcattgctttttcctggggcagagagccgagaagagatttcaggagatttgtgttaatagttaattgatccacatgtgaaggttgtgagtttaaattcccaatttgctgttccattgctacatctcgaagatttttcctgcaattagaaactacttaaactgttaacttttatctattattttgaaactagacatttttagtgtttaaacttttttaacattaatgtacaaatgaattgt

SEQ ID NO: 161846 - DNA, 386 bp, Homo sapiens
aggtgggggccgccctccgacggcgttagagacgttgtgcagcgtggccctgccagctacgtgaaagcagccgcggggcttgcagggctgtggaccttgtagggatgaccctctaaggtcatgctcgtcttcctccccgataagaccatacccaaatcctgttgccgtttcagagactcaatatgacggtttcattcattcattaacatcttcagtttatccataaacagatatacacgtgtctacagcactgccgagttagtagatacggcagtgaccaagagggacttgcacggtcctgactccatgttctagtgatgggggagaaacaatacgctccctatccatgagttccgcatgtgtgaattcaaccaactgcggataga

SEQ ID NO: 161847 - DNA, 183 bp, Homo sapiens
ttttgggtgctgaggatacagtggtgacctctggcgggtccctggctgctctcctagaccttccatagggtagcagtgagggtaggggaggaggaggaggcaagtggtaaatagtagttccttccatggacagggtaggtaatgtaccagattgtgttacatgcaatgaagatataaaacagg

SEQ ID NO: 161848 - DNA, 318 bp, Homo sapiens
aaaaaactgatgccactacacacctgttagaatggctgctgacatacaaaacattgactgctgggtgaggtgtcaaagctccagcatcagaaagtggtccactcgagggttggtaagaaaaatttactggcgacagtataggtttgaaaaaggaacgtttggcctgatgtggtggttcaggcccgtatgtaattccaacattatgggagtccgaggcaggcggatcacttgagatcaggagttccagaccagcctggccaacgtggcaaaactttgtctctattaaaaatacaaaaattagctaggcgtggtggtggg

SEQ ID NO: 161849 - DNA, 357 bp, Homo sapiens
taatgactggtaatcatttaactacacctacatcttggcagaattcaggcccctctcatcctcctaacctggtgtcctttcattagttttacaaaggcagtttcattttgctgtcatcatttaaactataaactatctacaaaagttagcttggcccactgcaggaatggctaagggagtttgggggtgaaaggcaagatggagttgtcaggtcagatctccttcaccatcataattttctcactgttacaatttctgcaaaggcagtttcacattcatccactagtgttagcatttttggtgattcttacctttgaattattacattagtagtaaccaaagatgattattctaatt

SEQ ID NO: 161850 - DNA, 496 bp, Homo sapiens
tcacaacagatgcaaaaataataataatgagctattttttaaattttttttaaattttttttaaatttcaaaataagtaatatattttagtaatattttatataatagtcattttaactgtggtaggccaaaaaatgaccaccagaagatatacacatcaaatccctggaacctatgaatgtgaccttatttgggaaaagggtctttgcagatgtgctaaggatcttgaaataaaggagatgattctagataactcaggtgggccctaactccaatgacaagtacttataaaagagaggtggtgaagaaacccagactggagaagacacagacacacagaagagaaggcagcgtgaagatgagcagagaaagatggggccacagccaaaatgtgcaaacagccaccagtagctacaagaggcgaagagtgggctctgccaggaggagccggagaggtaccccactgacaacttgatgtcagatttctggcttccag

SEQ ID NO: 161851 - DNA, 443 bp, Homo sapiens
aagcagttctcctgcctcagcctcccaagtacctgggactactggtgtgcaccaccgtacccagctaatattttattttttgtagagatggggtctcactatatttcccaggctggtctcaaactcctgggcccaagtgattctcctgctttggcccctgaaaattttgggattacaggtgtgagccaccacaactggccttctttttactttcatgatgctatgttttgatgcacaaaagttttaaattttgctgttttgcttatgttttttggtgtcagaagggttgcctaatctcaggatggaagatttatgcctatgttttcttctaagagttttacagttactcttacatttaggtcttttatctgtttgagttcatttttgtatagggtgtgagatagggctatacttttttttttgagtctgtaaaattaaatctg

SEQ ID NO: 161852 - DNA, 483 bp, Homo sapiens
acctagttgtcaatctttctactcctcattctaagacctcactacatcctgacaacttataaacaattttgactcttcattctcctctgcctctatcttgatgcttaagctctattacatagtcccctgtccctgagtaattctacccccaacccctggcccaaacaatcacagtcactgttgatggtttatggctgggctgtgttctcactttgcttcttttgaggttggaggaatgaagacaggaaagttctcactcctactgacagggctgctatagaagaatgagctctgggactcccagcttggatctggcaaagcacgctacctttataggcactgctattcatgttggttttgttggatagcagcatgaggactggacatatgatgggttaagttggcttctgtgggctattctgggaacacacccaacatttgtagctttaatttttctattgaaaactacctctaagttccaaa

SEQ ID NO: 161853 - DNA, 171 bp, Homo sapiens
taccattttacatttccactagcagtgtgtgaaggttccaatttctctacctccttgccaatcttgtttctgattacagccatcctagtgttaagtggtggtgttcttggttttctagctggattctatgacgtggcctttgggtaggatagggtggaggcagcaacagaa

SEQ ID NO: 161854 - DNA, 639 bp, Homo sapiens
aatttagctcggtaactgaatgggcacagaaatttattactttttcttgtatgatactgcccatacggtccagggcacagatattaacctgtgctatttaatttattccagaataaggaggatagaaagcttttaaatccctgattaaatcaattcataactaaagactctctcttaaggttacacacatgcaaattttcaaaaatccaccaaaggtggaaggatgtaatactttatgaccataaaagatgttatccttatatttcaaaatgactcagtacattaacaagtgaaaggaacaggagcatatgatgatcttggtgaaggcccaaaagtcatttggtaaaatttaaaaatcctgcagtattttttccagctggtttgactgcttagtttcatattccttatctcataaatgaattgaaggctatgaaagtttttcatttcggccccatccacaagacgtgccccacagtgccatctctgccactcatctctactacacttgatttcctctttatttgtaacttgggatgaaatggacaggactttgggctctttctcagtgacttcaattttttattacattatagtcagagaatatgacctgtgagatttctacattttggaatctggtga

SEQ ID NO: 161855 - DNA, 483 bp, Homo sapiens
actctgcagggcttagtccaggttgtgcgcagtgtcgtagtaccccctccgccccccgcacgcctgccacatgaggatggtccccattgttccagtctatgaactttcatcaaatccttctaggtcagggtttctcagctatcagcactattgacatttgggctagatagttttgtgagtggctgtcccatgcactgtaggatgtttagcagcatccctggcctgtacacactagatgtcagtagtacacatttaccttcttcagttgtgacaactaaaaacgtccgtagacattgttacatgttgcttgtaggacaaaatccacccccaattgagaatcaccactgctctaggtagagagggttaacagtaggcctgagtccttttcttcgtggaaaatgaccttgggttttccttctcctggcattcttttcctggacacatactggattaagaattaaatatagaatatctccaggtaat

SEQ ID NO: 161856 - DNA, 469 bp, Homo sapiens
cttctatgctggctgccagtgttttagtagcccatttgggaaagaagggttggaacatgaggatggtccccattgttccagtctatgaactttcatcaaatccttctaggtcagggtttctcagctatcagcactattgacatttgggctagatagttttgtgagtggctgtcccatgcactgtaggatgtttagcagcatccctggcctgtacacactagatgtcagtagtacacatttaccttcttcagttgtgacaactaaaaacgtccgtagacattgttacatgttgcttgtaggacaaaatccacccccaattgagaatcaccactgctctaggtagagagggttaacagtaggcctgagtccttttcttcgtggaaaatgaccttgggttttccttctcctggcattcttttcctggacacatactggattaagaattaaatatagaatatctccaggtaat

SEQ ID NO: 161857 - DNA, 219 bp, Homo sapiens
ggaattcaaggctgcagtgagtcatgactgcatcactgtactctagcctgggtaacatagcgagaccttgtctcaaaaaaaaaaaaaaataaaaaataaaaataaaaataaagtaacctcacagagccaatcaaaatatcacttttccaagtgaaattactgtttttttctaatagaccaaaatacttgctcaatcacaaaaaatttattaaatactgg

SEQ ID NO: 161858 - DNA, 152 bp, Homo sapiens
gttggcatctgcagcaagttcttttgttcagagaaaccttcagaaaatctaatgtgctgaaaaaacatgacttctaaatagtaggaaaatatttacctccgaagtctgtgaagcacctggcacctaaagcacactggacacttggcaagact

SEQ ID NO: 161859 - DNA, 177 bp, Homo sapiens
ctgactggaatgtcagccttatgaaggcaaggattttgacctgctgtgctcactgctgtatccacaacccttagaaggacctaaacaagtgttcattgaggccaggtatggtggcccacacttgtaatcccagcactttgggaagccgaggtgagtggatcacctgaggtcaggagt

SEQ ID NO: 161860 - DNA, 586 bp, Homo sapiens
atacaaaaacaaactcaagatggattaaaggcttaaatgtaaggcctgaaactatataaatcctagaagaaaagctagaaaatactcttctggacattgcctaggcaaataatttatgattaagtccccaaaatcaaatgcaacaaaaagaaaaactgacagttgggacctaattaaagagcttcagcacagcaaaataagctatcaacgaagcagatggacaaactacagaatgggagaaaacatttgcaaattatgcatctgacaaaggactaatatccagaaaagaacttaaacaaatcaacaagaaaaaagcaaatagccccattaaaaagtaggcaaaggacacgaagaagcagccaacgaacatgaaaaaatgccgaacatcactaatcatcagagaaatgcaaatcaaaaccacaatgagataccatctcacaactgagtcagaatgactattaataaaaagtcaaggccgggcgctgtgactcatgcctttaatcccagcactttgggaggcaaggtgggatggtcacttgagcccaggagtttgagaccaaactgggcaacatagtaagaccccttt

SEQ ID NO: 161861 - DNA, 578 bp, Homo sapiens
taggcatgaagatttctgtgagattttgagatgttttgaaattactcaagcaaaagaaagatatcctgggcaagctggaggttactgtaacctccaaccttttagctggaagtctgaaattctcccctactttctttcctggatgggcggagctttatcaaggctttcttattcatttgaaattgtcttctctcaggggctcagtcaacagtggctttggagaactgagctctttttctggcttatctccaggcccttcgagggctggtgcctgcacacaccttctacaggcagcctaaatgctaaggtggaggttgaacttaggtcatgaggtcttttcattttctatcttccttgttggtcctggcatctcctcagcacagggaccaggtaacactaaggggaaagcattcagattagcgcatgcccatcgcggcacaaacccaaccagattaggcagggaccaaagtctcccccttcttcactcctccccggcagcctgaggctcattttcccttcctgcttgttttcaccggttgctaagcagcgtgtaacatgctggcagggcttgcggccgc

SEQ ID NO: 161862 - DNA, 294 bp, Homo sapiens
agaacagggcagggagtttcacagtgttcttctacacaatgtctggaatctatgaataacatcagtttctaagttatgagttgatttttaactactgggtttaggccaggcaggcccaggcctgttttcgggcctgacaccgggctgcctgtctttggttttactgccttgttgttttttcttaaaacaggtactgagtataaaacaatataaaacaatatgagaaggtctctctcttccctcaatacacaaattttctaaacatatatatgaagcattttataataggaaaca

SEQ ID NO: 161863 - DNA, 386 bp, Homo sapiens
ctatccacctgtctcagcttcccaaagtgctgggattactggcatgagccactatgcctggccatctttcttaacatgtttttcacatttgtgatacatatacacacacagacatttgtatgtacctatatgaatgatactctacatgttgttttgctgcctttttactcagcagtggacacaaaaatcttttaatgccactgaatacagatacatcattcttttaatgtgaaatgtttctctatttagggtatacctgattgattctgatcagtgaaacggtagaggcaactctcaaatggactttggctatgggtagtaatcggttggaaactccttttgaggacattaacaggtagttgggagttaagtggctttttctggca

SEQ ID NO: 161864 - DNA, 538 bp, Homo sapiens
tttgagacggagttcactttgttgcccaggctggagtacagtggcgtgacctcggcttactgcaacttcctcctcccggattcaagcaattctcctgcctcagcctcccaagtagctgaggcaggagagtcacttgaacctgggaggtggaggttgcagtgagccaagattgtgccactgcactccagcctgggtgacagagcaagactccgtctcaaaaaataataataataaatttaaaaatattatatatgggtatggctaaaggctcctttaaccacagtctcacatatacatcttgccatataaaaaacattattttggccaggtgtcatggctcacatctgtaatcccaacactttgggaggtcaaggccggaggattgcttgaggccaggagtttgaaaccaacctgggcaatagtgaaactctgtccctaaaaaatttttttaaaaatcagccgagtgtgatggtgtgtgccagtagctacttgggaagcccaggcaggaggattgcttgagcctaggagttcaagacca

SEQ ID NO: 161865 - DNA, 357 bp, Homo sapiens
ggcactctgcattttataaccggttttatttctcttgtaatcactactgcagcctgcaatttcttatttattgtccaattcttccccactagggggtcagctccctgaggacagagacaggcttatgttattcatggctgtctccaggccttggcacaaagaaatagataaataaaggaacggaggttctgctaaggtcctttgagttctgcagagtgagggaagctggacttggcagggccgtgccatagcttgggtctacatggctcagaggcgtccatcactgatgccttgccccagccaccctccatggacaccaacgaggagctggccactgtgttctctgggcagcgctat

SEQ ID NO: 161866 - DNA, 415 bp, Homo sapiens
aaaactactcaggttgaaaaaagaaacagttataaaaattatcaaagaaaaagaagaatatcatactcatgaaactagaataagatagttacagaggaaacaaaagagctcttagaaaataaaaatacaaaagcagaaagaaaaaattcaatggaaatcatggaaggtaaatgtgaggaaataccacaaaaagtagaaaagcacaggagtagaaaaacagaagaaaattagagaacctgattagagggcatctaaaccagatgggttttggaaagaaaggagagacaaaatggaggggagaaaaacaataatgaaatatttaacattttccagaaatgaaagatgtaagttgctggagtacactgagcacccagcaaaacagatgaaaatggactcatattaagatattttgttg

SEQ ID NO: 161867 - DNA, 236 bp, Homo sapiens
gacccagtgagcctcaggagtgccaagccccagaactgcacaggcttttcccacagttgcatcacaagggcaagtctgttactcgggagagctcccaggagctgccccatcttagctgtctatctccagtgtcctgttgataagatctgttaacattctcagctccaggtctgaaatatacaaagaacagggcctgtttgttcaatccaaccttctaaggtttaactcccaaagga

SEQ ID NO: 161868 - DNA, 273 bp, Homo sapiens
gtcgactataattgtgtcccaaggcccatttctcctagtggactatgagctcctcaaggacaaagcttatttgtatttggctttccatgtgtggggtcagggtggggacatgggccaagtgcactgtgagagtgctggggaggacggtgagagcagtcttctcgttagaggggacagaacttgtacagaaagcacagagtagcagatcctggtgtgttcagggaagagcacacctggagagtgaggtgtacaggtgagggggcaggaggggag

SEQ ID NO: 161869 - DNA, 218 bp, Homo sapiens
tgcactccagcccaggcgacaaagtgaagctgtctcaaaaaaaaaagaaaaaagaaatacaaacagtagtactcgaagagtggagtaagggctcgaggggaagagggccctgtctaccactacctccccagcacctctcctccctgcacacatctgccgaatcaccaagtgctgcaggccctgcctccaaagtgtcaatcagtttctgcaccctgccc

SEQ ID NO: 161870 - DNA, 316 bp, Homo sapiens
gccgcaggcccgaccgggatgagaagtcctaatcggcgttctaggggcgttctaaaagaaggaaggaaggggatttgaaaggattgctcccgcagggctgtggccttaaagaggtggtgactggcaggttggactgacctgccgtgggctctcccttcctccccaatttaccttcgagaaaccctcgttgaggagacacccaagggctgagtcctcctccactttgaccttttgctattccatcacaaagaaaaaatggatcccaaagttaagaaatggaccagcacttgtttagaatcaggactggtgccttggt

SEQ ID NO: 161871 - DNA, 396 bp, Homo sapiens
tgccaggattacaggtgtgagccgctgtgctggtctaattgatatttcttatagtattctctaattgatgataaccccatcacctttattatcgtgttttagtttccttcttattctcaccaggatttttacatagctgtagtaggattatctgatttggagatataggcaaatatacattcatttgcaaaactttcattatttagaaattgattaccttggtcctgttcttatcccccttttctgcccagataagaacttaagcattaactgtgtaattccatttacatgaagctcaaagcagacaatttatctgttggtgacaggaatcagaacagtggttagttctgggggaggtatcgactaggaaagggtaaaagggaactttctagaata

SEQ ID NO: 161872 - DNA, 418 bp, Homo sapiens
tggtttcatgtgaaatctactgcctcaagtgcacaagcttccagatggggttggagtttggggcagagagtagcaaaaggataaggttaagacgctaacccatcacccagcaggtaagaggtgtcacttaaccttccagcttctggaagttgaattttgtaatgagctgtcactgtctttatcacctaacaattactgcaactgagtagggtgggataaaacctggaaaacattactctgtcaacagcattgatatctttgatgaagctgtctatggtggggtcccgggtacagttgaaaattggcacatggcctgttaaaatggtttaggttctttccattcctccactctgcagactgctcctggcttgtgatatggcaattgtttggtcagatcactagaggtggtcatgttgtt

SEQ ID NO: 161873 - DNA, 362 bp, Homo sapiens
actcacctcttatctccaggatgaagatcaggcttattaggaggtgatatgatatgtttagggatttagttaactgcatatttagggtgaatttaaaattggcaggatgatgaggatgccagaaaagctaatgtagtttcagactactttaatagattttgtagtaccttgtttgtgagaaataatagaccttttgtttcgcatactagtcaagccacagttggattaccatgttcaccagattttgtatagtcagcattttaagttgactggaatgtgtcttgggaaagatgactgaaatggtgagaagtctgaataatatgtcatttttacactagttgaaggaactcgtaatatttttc

SEQ ID NO: 161874 - DNA, 320 bp, Homo sapiens
gagctgagtgtggtctctaaggataaacttcagttcttaccatagtagctgctcgcatacagtactttcgagttgcttttgtgagcatggttctgtggagttctggaactgtcagaggcaagcttggcaagcccccttctggaacgcactggctgtgaataactgggaggtgctggcctcaggattcacaccaaggagggggctgagcctcctgcgttcaagggccggtatgttttggctgctttcttgcttttcttctgccccagtctgcatgattttgccgtctgaacaaccatcggggcatcactaagctccagcgc

SEQ ID NO: 161875 - DNA, 460 bp, Homo sapiens
ggaagctagtgacagacattcagggaagaaacaaggatacagaaatgtctttctctcccaaggccaggatcagcatgaccatggggcacaggaagttcgatggagctcagagttacaggaaatgccttgggtgcttatatccagagaaaatgctagaagcagcttcttaaaggggaagaggatcccactagacttaatacggtctctgcccacatcattgtggagctagatatctgtggaacttagcctaaggctttcaccttagacgtgactgaagtggaagaaatggaatcaggtccctacaggttgccaaattggtggcagctctgttggagttaggaaggatgcactcagaaaatctgtgcgctactctgcatttgtttttctttgatatgcctgaagtgatttaattaagctgtatgtgaaaatctccatgttagctccaactataataaaaagc

SEQ ID NO: 161876 - DNA, 454 bp, Homo sapiens
  misc_feature (1)..(1): n is a, c, g, or t
nggtcaggtttcattcttctgcatatgggtagccagttattcctgcaccatttattgattaggaggtctttttcttactgatttgcaaaggttctttacatattctggatgagtcttctatcatcacacacattgcaaatatcttctcccagtctgtggcttcccttttcatttcttttattgtgtctttagatgaacgaacagaagtttttactgttaatgtagtctatttatcatgctttatttgttatcctaaggggcactgccatccttaaaactcgtaacaagttacaaaaactttgtaaggataataagtacacgtaaaactgggataaaaatctcacaacagtatgaatatcaaatgtaaaaatacatattgaagagactgccatgttaataacatatatagtaaacaataaatgttaattactttcctaactcaagtgcttctcaa

SEQ ID NO: 161877 - DNA, 602 bp, Homo sapiens
tctgtttgtatacggaaaatcttattacattcttacacagagtgtgacacatttaatatttgctagaaaatgcatcttagaaattaaattattaagagttagtggtgaggaattttaaatttaatgttctatgatatagcacaacacagatttatttatttatttatgaaatggaatcttgctctgtcacccaggctggagtgcagtggcgtgatcttggctcactgcaacctccgcctcttgggtgcaagcaatgctcctgcctcagcctccctagtagctgggattgcaggtgcctgccactacacccagctaatttttgtatttttagtacagacgtggtttcaccatgttggccaggctggtctcgaactcctgacctcgtgatctgccctcctctgcctcccaaagtgctgggattataggcgtgagccactgtgccctgctgaatcttttatttttaagtgtgaatgttaaaggttgcaaaataataaaatgacctctgtggatttgaaatttggaataatatttcttgtccatattgatattacaactcagaggaatttcaccctgttattttatgtgtctttttagtgagtgaa

SEQ ID NO: 161878 - DNA, 490 bp, Homo sapiens
atgctcaccctaaactgaatcctgtaccagtggaaggcaaatgttataaaggatattattagatctactgacaaaactgacaagactgaatatggatggtagattagacaaaaagtatatttttgaagtcaattgtactgtggttacagaaaaaaacacagtattatatactctaaaataatgagggagaaaaaaatgtgtgtgtacacacacacacacacacacacacacatacagagagagagagaagatgagaaagaataattaaatgataaagcaaatggagtaaaatattcacaacaggcaaatctattaaaaaaggcaattgttctttgcactattttatttctacaacttttcgttatgtttgaaattattttcaaagaaaacatttcaaagctacattacaaaattagaattatggtaccaatcccatttctattaatatttcatttctaaaggaaaatatattattttaagatgttaaatg

SEQ ID NO: 161879 - DNA, 697 bp, Homo sapiens
caattgactctccatttcttctctattcgggagactaacctctatggactgcagcaactggaattcctactctctaataatcagttgaatttggccaaagggagctactagaggaaatcagaaagtgggagtcagagaatgtattacctatgctctttccctgctgggccatagcttgggggtagtattcctctcctgaaggtcacatctcctcgtcaggagctctgtgctttactaatcaatcttgctgtgttctgctaagtattccctctccttatctcttcagagttaggagtggcaattattttctgctgttgctaggtctaagatgctacaccatctcttacttgttgttccccttaactttgcccacacctttgtaaatagtctcttcattaaacttttgacagttatccttcagtgtgtcgtctacttcctgccaggaccctgatacgcttaacaagaggcaaaatctggattgctagactaatataccaaaggtcaatgtacatttagaaatgtacagttagagtgatggatatatgggggtgcctttttaaaataaatgtttgggtaatacaaaatctcttttcaaagctatgcaataaagaatacggtcttgcccaaagagaggtttgacctttgtcccagctcctatgaaataacttctaaatcttggcattgctgtaccaatagg

SEQ ID NO: 161880 - DNA, 194 bp, Homo sapiens
acttccaggagaaaggcttaacaatgtaagcacaaggaggataataactaggtgttcaagtgcagaatgaaaggggaatttatctacctgtctttttggataataagctgacagaatccagcactctgcctcagccctccctggtctgaaagacttggcaagtacattttttcctctattaatgtagtagttat

SEQ ID NO: 161881 - DNA, 548 bp, Homo sapiens
atgacactacaagaaaagagaactacaagccaatatcccaatgaaaatacatttaaacatactcaacaaaatattaatactaacagccctaattctgaattgcacagcaaattaaaaatatcacacaccatgataaagtgggatttatctctgggatgaaaggatggctgaacatatgcaagtcaattaatgtatacaccacattaacagaatgagaaggaaaaaaaatcacataatctcaatagatgcagaaaaagcatttgataaaatttgacgccatttcacaatagaaaacaaaaaccctcaacaaactaaacatagaaggaactcaattcaacgtaggaggggccacctatgaaaagcccacagctaacattataggctaagattataaacaagagaagggtacctactctgtcaatttctatccaaaatagtattgcagtcttagccagggtaattaggcaagaaaaaaaagaaagacatccaaattgaaaggaagaagtaaacttatctgtttgtagattacatgattaaatatgtagaaa

SEQ ID NO: 161882 - DNA, 510 bp, Homo sapiens
tccagcacagatgcttctcttgtggagtggaggtcatatgactgtacccttgccttatgggaagcaaggaaagcaaatattcagtagtaggcagaggtttctgccttctttcaagatgcatatggaagggaattccccaaggacaagaaggtgttttgatgctaagcaaccaagagaatgacttgtgcatcatgatgcttcctttggatcctccctaggtttgctttccctttcattcctgtttctactcagttgtcacctcctcagagaggccttttgtaatcactttctccaaaatggcaattccctatccctaatctagtactctgtttcttactctgccttactttttcttcataccgtttatcactgccacaaccaccactactactactacttatttacttctttattgtgaagttcttatcccagaacataagctctttgctcttcatttactcagtaaacatttgtttgttgaatgaagagaaacatagagattatgctata

SEQ ID NO: 161883 - DNA, 990 bp, Homo sapiens
ggctcatttgcatacttaggttccacaaagtatggtcagccatgtagtaatgtgattggacaaaaaggacatgacgtaacgctaacagactgagcagggacactcggcaaggcctgcctgtccgcattctccctggcctctctgagcaggattcttccttctgggtgtgggaaggaccttccctggaatgggggtcttatgacctacagtcaaacaaggtaggtcagagaatttgtttctggccagttttgtacagaatgacggaaggaaagttagagcagtatttttaagttttatggctggctttggggaaacggggttctggtttctgtgacctgctatgaggaagagagggattccagtttctgtggctgggcttaggggaggctgggactgagagacaggagggcaggagggggtcagagagaaactttttcttgtgaggcttttatgctggagtactgcttcccgactcccaacgtttgctacttgtaaaattttgtgattccacaggaaaggcaaaggcatggaagtcatgagaaggcaacgctaccttaacttcttctcattttattttttatagtgttcagtttaaaggcgtaaaaggctggaggagcagtacaacacagatatgtctgatcttcttggaggttctccctttagctaacttttgctgtgatgggtacttttttcatgcccctggttcctgtatctctcagttgatgtcattatagccatctgcgttcagcatcaaatacagggagccacgataataaaattacaggcaggaatacgtgagagagctgagaggcaaggggactgggctttagacggagcttgtgaaatcggtggcctcatttgttcacttgtatctagcactcctagaaagcaagcactgcgtggaggtccagccacaggaattcacaccaacgggcccagagtcggtcatagtgccctgatgtgaccatttcctagcagtgccagttcttc

SEQ ID NO: 161884 - DNA, 508 bp, Homo sapiens
tgagagtcaggagggagaaaaaagaaaatgaacgtttggaaaagggcattcccaaatcacaggagaaggggaagaaacgtgtctcagctactaagtttctcttttccatgacgctcaaagcagaaaatggctgcacgtgggcaattcgtgcgcttggagctcagacctgcagtcttgtcgtttgtctgccctgtcttggtgcatgctgggcctgacttttttatttttccatttcaaggagccccagcagggcctggaggaaatgagttttgcagcccatctcggcccttgagcttggctcctcggctgacctcggctccccgcctgcagacccggcatgaggcaggcagcaggcactgcggggcagaacttccgggacctgcaagaccagtccgctgccttctgagacgtagttctgaggtgtagcaagttttcattttcacagcataaaaccgtctacaaatacatacttcaaaatgaaatggaggatgcgctcaaaaaaaaaaaa

SEQ ID NO: 161885 - DNA, 400 bp, Homo sapiens
aacctcctaaaaatcagtaacacaatacaaaaatccagtagtataaaagaaaagttcacataaaggaatatatgtcccttttatgattataaaataagctcaatttcatttattattagagaggtgcaaataaatctacatagagatatttttttcacctaccagttaataaaagtacggaagtttgatagcatattctctagatgagggtataggaaacagacactctcataaaatgctagtacattgtaaattgttttaagcctgatacagaaaacgttgtctgtatctattgaaataaatctatatatttattgaatatgcaaatcctcttcatggaatttattctatagaaatacatacacacatcgagagttattcattatagtattatttgtac

SEQ ID NO: 161886 - DNA, 521 bp, Homo sapiens
tttgtgttctgaattgactatgtccagtgtggtgcgccctacaccacggctactcagttaatttcccagaatagacttatctgtgcttttcacttgagtttgggaagagctacaccttgaatttgtttagatgtaacttgttctattagcaaagggtcatgtcagagtgcgaacattttttagctaagaatattgcctttacgagaaccctattccaaaaggtaattacatgtgatctatagtcctgaaaaatcttccttttttggaagtgaaaaccaaatttattcttctttaaaactaaaaataatcgcttctctgcgacactgctgtcacaaaatatccatgccaacacttcacttccgagagtggagatgaagctgacctttaaaaacgttctaagagagacattttcattctcccagctgcagagacccaccagagttgctgctgttgtggggtgggagaaggaaaagtctccctttctgtccctggtctctgcttccccccagggcttggactca

SEQ ID NO: 161887 - DNA, 319 bp, Homo sapiens
acttgagacatccaggtcacgtcaatgcctgggagatacttcacatcttcagttatattctgtgtctctgatgtgaaagcctatctccatcctctggccttctctaaaatagtgtggctagaatgtaaggtacagaaacatggggaaggaaagctctgattttttttttaagctttggcttattctgggctcaatttatatctgggcacatagtttcaaacctcaaccatatgtatttcccactagtctgaaaaatcagtcaagacacagaggaacatctagcagccctaaccccaacactggaaaggagggctggggg

SEQ ID NO: 161888 - DNA, 224 bp, Homo sapiens
tgttctgatgaaggacggggggaaatcccaaagagtaataaatctgactataaggaaaagacgagggaaaacaggccaagaatagaaatacattgtgcctacaaaatggatccaagaaccaccaacatatccatagtgtaagcagaaaccatcaagtataaagattggctgataaaaatgtcaaggtatcattataattagagagctatccaccagctcattac

SEQ ID NO: 161889 - DNA, 342 bp, Homo sapiens
aggtagagtagctgtatactgtctacaactgctgtgcagaaagacctcagtgccagcttctccttggtgtagagtgaagagatacaatcatgctttggaaaatgtgttgatatcaaccttagacagaagggttaggctgaagacaatctctcacaatgattgtaaaattgacttaaccaatacttaccgtgtggttatcttcagtagtgctaatttctgtactcacaagatagatagaagtaaataggacagtgtcaaaaaaatttctgtaaatagtagttattgagtctttattctcttcattgcagagggaagctgagaaaaggggatgggggattatat

SEQ ID NO: 161890 - DNA, 493 bp, Homo sapiens
cagatgtggtagctcacagctgtaatcccagcattttgggaggctgagagggaggattgcttgagcctgggaggttgaagctgcagtgagccatgttgcactctagactaagcagctatgcaagaccctgtatcctcccaaaaattaactgatcagagatgtgactgtttatttttggactctctgttctattctattgatctgtatgcctgccctcatgccagtaacatagtgttttaattattgtagctttgtagtaagtttagaagtcgagaattgtgaggcccccatctttggtctttttcaagatattttttggttattcaggcccccttgaaatttgatgtgaatttgaggataagcttttccacttctgcaaaaaatattcttgagattttcatagagatttaagtgaatctgtatatcactttggatagtactagtgtcttacaaatgtcaagtcttcctattcatgaacacgcatgtctatttc

SEQ ID NO: 161891 - DNA, 595 bp, Homo sapiens
ctgagctctcgcatgagattatgctgggcgcgaattggatgttgctctgcgctcacctggtcgatgactttctggtctctggatcctggggcacatctgcattaccgctgaggataatcgagctgtcctgcactatcaaaggggaagaagagcatgcctgacccgtccagcggacactccattccgctcactgctccatctggtgcctgcctctgtcgggtggctgggtcctgtgctgactgttgtgactgttgacgccctggggggttggcgcatgggagttaggaggtctgccccgttttgcacaactatgcacccacccccagtgtcaggtgcttctcctctcctcctcctgtgtctcttctaaggatacttatctttagatgagatcaccctggattatccaggtgggccctaaatctaaagataagtatccttagaagagacacagggggagaagaggggaagtacttgtgaacacagccagattggagtgatgatgtggccacaagccaagaatggcaggggccaccagaagctggaagagcaacaaagtatcttttcagagggaacctggccctgtgataccttgatt

SEQ ID NO: 161892 - DNA, 421 bp, Homo sapiens
ttggagattaagttatattctaggtagatttaatatagaatgcctttactaaacacttttgggcagtggttgtcaaaagaaatgtgcatagatttctgagcttcattccatcattttgcattttaaacaaagtgattctgatacagaagattcttggaccatatttggagataactgatttttagggggtagtttgccaaagtatttaatagaacaatcaatttgttaagcctgttttaaaggttcccggttaaggccggtcacggtggctcatgcctataaatcccagcactttgggaggccaaggtgggtggctcatttgaggccaggagtttgagaccagcctggccaacatggtgaagccctgtatctactaaaaatacaaaaaaattagttgagcgtggtggtgtgtgcctgtaat

SEQ ID NO: 161893 - DNA, 321 bp, Homo sapiens
tatgtgtcattttgatttgtgataaccttaggaaaaagccagcaaagtctgggaaccaggtaatcgattgcaaattggagaatgatttacctgctatctaagataaaggaaaagggtaaatcacaatgttgctttaaattcctttcagctttgtttattgtttccttttgtgtggaatttcactgttgcattgatttaaacccagctcctatcaaatgggacatagagtaggccctcaagtaaacatttagcactaggcatgtgtgctctgtataggatatgtagaaccctctctctgcttctaagtcataaatagttctt

SEQ ID NO: 161894 - DNA, 171 bp, Homo sapiens
ctgtaaagtcacactgcaaagtgcagatacaggaagggtggagaatggtggcccttttgcaacttaccgtatacactgcgttagaaataatatggaccgggtcacagatggcagctgtgactgttagctccagcctggtgacttcaggaaagattaaatgagctaatgtgt

SEQ ID NO: 161895 - DNA, 305 bp, Homo sapiens
tgttcacacctctctcaactctcagtgctctgtacatttctgccgtaatctgcgtacctcctgactacaggggggcaccccgggcccccactctcagggcaaaggtggtctttttcatctcgcagtcagcaaatgtgcactacattattgtttattgtgaatctgtccacttccttccaatcctactgccgacactctccaccaagccactgtcatctccagagctcaatgcggctgcctcctatgtacccttcccgcccataatccacatcgacacagcagcgagcatggttggtttccttctt

SEQ ID NO: 161896 - DNA, 328 bp, Homo sapiens
agagttcacatttatttcaatgtagaatattagaagtgttttagtctttatttaggagtttggtcatgtttttgtgaccagaaatatgccataggaacttaactcttgtttatgtcaattagtctacggcaaaactggtttggttatatgtaattttgcttcagtcacagtttccaaggacttatcaactacattaagtgaagactcactacaatttacttccctttgcccttcaccctccttttaaatataaccttacaagctcaggggttctgttgtatttgctgatgtttcccaaatgctgagaggagcgactggcaggtagcct

SEQ ID NO: 161897 - DNA, 325 bp, Homo sapiens
cagcctccgttccctgtaacaccactcactcccagcacctctctaaatcaagcaggaattagaaaccaaactgcaccatctatcatctagacactgggatccaccctcagctgagagccaagggtctgtgctgattacagccaacctccctcagtctccggtgcacgctgctctcaggcagaggccagagaaaaggatgatgacccaggagaagctgggactctgtgaggctaactctcagtttagcaaacaccaggaaggttagggggaagattctgtagagaaagtcagaagggtacaactaacctttcagggcctggaaggc

SEQ ID NO: 161898 - DNA, 130 bp, Homo sapiens
atgttttaagtatttcagtttatatatctcttctaacatttttatatggaacaatcagtaatctaaatacaaattcctcttaaaaacgaaccacttctaagtgtttgtataaaggtatacattgtttttc

SEQ ID NO: 161899 - DNA, 226 bp, Homo sapiens
cgagggtgggttattgatgcactggcaggactgggcagtggctacttactaaggggtatgaatgtgtcccagcatgttaagatctagtggagctggactgatacctattggccgaatgtgacctctgcctgtttcaaaggtgtttaatcctgatgtctcataaattaagactcaggcctgtaatcccagcactttgggaggccgaggtgggtggcatcgataaaca

SEQ ID NO: 161900 - DNA, 479 bp, Homo sapiens
ctctctggcatccccactggctttagacacaacatcccccaaatctgttggattttgactatgaaatttagaattttttttctttcccaaagaacaactttctcaccactcttgttatacatactattccaaaaataagtgtaacaagaaacagacaaatacaggacagttcaggaaaccagtgagtttgaaaaatatatatatattttccctctaaagaatgtgtgtggccaggagtggtggctcatgcctgtaatgtcgatacgtggcctgctgcaggaaatggcaacaagaatagatacttaaggaagagcatgcaggagacattctatcacaacacggaagaacgaaggaaaagaggaaaaggaagcgtactacggaggaaggacactgaacaacgacaaagacaggaccacgctcgcccaggctagtctacgaacctcctgagcctcaagctgagcctcccacctccacctccc

SEQ ID NO: 161901 - DNA, 146 bp, Homo sapiens
ctaatcaagagtctcactgttattgaaactttctctgcagtgtcagaagtgacagtgttgcagacctcatcacctgttggcatcaggtagcagggagagctatcacagaatagtttagtttgaaataatagtttaaaatagtcaca

SEQ ID NO: 161902 - DNA, 654 bp, Homo sapiens
ttctagaggatctccttcgacggtgtgctgatctggactaacatgaattcatgatgtcctaccatttacaatgtttggcagataattttctacaggaactggccgttccttgaaagttatgagacagaacttacccataaaatcatccagtactttttggggaaggagtggaatcttttactatattcaccatatttttctggttatgggtttactctatttttctacttcttcttgagggacaatttaggtaatttccatttctaagctttcaaatgtatgtaaaagtggaccagcttgggctggcgcagtggctcacacagcactttgggacgccgaggcaggcagatcacttgaggccaggagtttgagaccagcctggccaacatggtgaaaccccatctctactaaaaatacaaaaattaatggctgtagggacaggcacttgtaatcccagctactcaggaggctgaggcacaagaatcacttgaatctggaaggcagaggttgcagtgagctgagatcgcaccactccactccagcctggacaaagagcgagactgtctgaaaaaaaaagtaaaagtaattaactacttgctgaaatgacatggatgggatttcaaaattatgctcattgaaagaagccagacacaa

SEQ ID NO: 161903 - DNA, 208 bp, Homo sapiens
cttggaacaggagattggaggacatgagcccccccaccaagtcccagagtcacggaaggctctggaggaaatgggagctgtgaagtcagagaaaggggctcccccacccaggggtcaagaggatggggtctttgaattttgttttttttgtttgtttggcttggttaaaaagaattttttttaatagaaacagtgtcttgctacattg

SEQ ID NO: 161904 - DNA, 420 bp, Homo sapiens
ctgtttgggaatgagatttgctacacccgtaggcattttcttcttcagaaaagagactgtttagctttctgccacccaagtcagtcatcctcagcctgaacaatggagcttaatgttctccatcttcctaagagttagtgtctgttgttatgaaagtgaattgaaaccaaatgtactttctattggaaaagctgcccttgctctcagctcatggacaaaactgagagagaaggctcttacaaaacagagggaaaaatcctcgctgtcatgtcataacaccagttatttcactgttagacctatgaacatatctttgatgcaacactacactatttgatgatgtttctgtgtcacttaagatgggcgtttcatatttatctcttagaaatgttagcagatttttttcacgagttatcttgc

SEQ ID NO: 161905 - DNA, 614 bp, Homo sapiens
gttgtgatgatatggtttaaagacaaatgtaaaaatccactgtcaatagactttaagcctgtggggaaaagtaagtatctgaaaccttggaataaaagggatttttaagtgaagccccttatatattgaggaaagggctcaacctcttgagtcaggtggacccaggttcacaggtcatttcagctgttatgtgacctcagttttctcatctgtaaaatggggttggtaactatctctgacagtagggttatgataattatgaataatatacacaaagcttctagcacagtgtccctcacatgacaggtgctatctctgctgggtgtcatcacatgcaggcttggggttcagttcgtaactgatccattattcatttatttcaaggcccagttcggtattccatattaagagagagaggagctttgcaaacttagtctaattaaacagattccacagaatctgtaatattttactttctacagaagaagagctagcagaaattattccctacgcttcttcagttagaaggaagaggacatttattcataggaaggagggaatgagaggggtgggggtgtgtgtgtgtgtgtgtgtgtgtgtgtgtgtgtgtgtgt

SEQ ID NO: 161906 - DNA, 180 bp, Homo sapiens
ggcggccctgggcagacagggagttgataacagcactggtcccctctgtagagttgagagagaccccatgaagggggtagaggaggaagagggaggaggaggcacagcctgtgtctgggtaaggtctgtttcatattttccccaaatcagagcttcaagaaaaaaataccttgactgtga

SEQ ID NO: 161907 - DNA, 375 bp, Homo sapiens
aaataaaaaattttaaaaacctgtcaagttagatgttaaagaggacatgtaaaataaaatctccctaacatgtttatgaaatagctgcaaaaggctgagcgtggtggctcacgtctgaaatcccagcactttgtgaagccgaggtgggtggatcacctgaggtcaagagttagagaccagcctggccaagatggtgaaacctcctctctactaaaaatacaaaaattagccaggcgtggtggtccatgcctgtaatcctagctactcaggaggctgaggcaggagaatcacttgaacctgggaggcggaggttgtagtgagccaagattgcgccattgctctccagcctggggagcaaatgcaaaactccatttc

SEQ ID NO: 161908 - DNA, 662 bp, Homo sapiens
aggaattcactatagagcttgtgctgatggacaggaccattccgcagtcagatgcccacacactggaggaaagaaatgcccacatagggccaggcccagtggctcacacctgtaatcccagcactttgggaggctgaggcgggtggatcacctgaggtcgggaattcaagaccagcctggtcaacacggcaaaaccttgtctctactaaaaatagaaaaattaccctggcgtggtagtgcacacctgtagtcccagctacttgggaggctgaggcaggagaatcacttgaacccaggaggtagaggttgcagtgagccaagatcacgccactgcactctagccttggtgacagagtgagactctgtctcaaaaaaaaaaccaaaacacaaacccaacaacactctggccagggacgaacacggcgccccccgaaaaaggcttctccaaacccatcccggttcgcgccacgcggccccagtgactggatagaggcacactgggcacaagcgaggcaccaaggagacacccggcgccaagacaagcgggccaggcgtcccacgcaaaacaaacacgcccgggcgaccacaacgttcagagcacaccccaagggagctcggagcgcactactgggctaacacaacgggtccaacaaaccagatca

SEQ ID NO: 161909 - DNA, 337 bp, Homo sapiens
tctctttagttatgagacaaagcctatacctacaaattagtttgatcactttggttgagtttactagtaaagagccctcctaaatagtttacatgatatgtgtctacacgtgtgtatctgatttgccaaaattgaaatattttgtacatggcaaatacgttctttaaatgtgtaagcaaataggtttattttagtcaacaattgatgacaggatagaaaaataaccagaaatgtggatccagctcttatcatagaaaatttgtactcctgtagattccatgacatcctcacctcctggtttatctttgacctttcttttggaatttctaagggtagg

SEQ ID NO: 161910 - DNA, 209 bp, Homo sapiens
aagatcatgtctttaaaaactcagagtaacctctgacacaatcttttccttaatttttaccctgatataaagtctagcttcaaaatgcttttcctatctgctccaaagcaaagttatctgaaatgtctcctattctccctgccaagcagcacacaaggtctataccttctgagaccatcatcaaccacgctaaagtgacaaaacctctg

SEQ ID NO: 161911 - DNA, 328 bp, Homo sapiens
cagacccccgttgttattttttaaattcagaaaataaaaaaccgtgataagttatgcattgctttttgaatgtcaatgctagctttaaaattgaccttcttaatgtattctcaaaaaaggccctaacacataaaaatcaaatgacacacattaaataataatatttaattgattacagtctaatggaaaattcaatactttttaaaagtgcggcacttttgaaaagtgcctcatagctgggcacggtggcccatgcctgtaatcccagcactttgggaggccagggcaggtggatcacgaggtcaagagatcgagaccatcctggtca

SEQ ID NO: 161912 - DNA, 268 bp, Homo sapiens
atgacatgatagaatcgagctcggtaccagatatgcagagaacccagaaggcacaggagcagtgagctgagatcacgccacggcatttcagcctgggtgtcagagtgagaccttatctcaaaaaaaaaaaaaagaaaaagaaagaaaaagaggtaagcactgagaaaatcatattacactttgacagcaagagtaaggagtaagggggtctgggttttcagcaaggtagcaccatactgtgttctgatacacattttacaaaaataac

SEQ ID NO: 161913 - DNA, 586 bp, Homo sapiens
ccatgtaatatatccacacaatagaatcttattcgtcaataaaaaggaatgaagtactcctagttttagaagtttcaatagcagctttcaccaactaaaacaactcagtacataagcacaaagggtatagtatatcaagtggcctgcaacagatgaggctaggcgggcattgctatgctattcacttcattttattcccctctatcatgcaatctctccttgccttatcacccagacttcctgaaagagaattctatactctcataccttcgcatctccgatttacttctcagtgaactccagcttgtcttccaccttcactctgaaattgctctaggccactagggaatcctaatttgcggataacatagagatttggcggggcggcgggggggtcacttttctgaactgttagtttgatactattttaatatttaactatttgtaggtcacaacgttttctggaagtacgatgaatgctattgaaacttctaaaactaggcctagttttagaagtttcaatagcaggaagaagttcaagagctctattgtataccatagtaactctaggatttttgggtttggt

SEQ ID NO: 161914 - DNA, 501 bp, Homo sapiens
atctttcacatagcttagataaattggctagttaaataattaccaaagggtcatagcctaataatatttgtggttttaaatatttacaattaatataaagagaatttggcataagatctcagaggatttcagaaaagtacatttataagctctgtcataatcttacatgactaatgaaagcaaatagaatagtcctctctcatccgcaggggaaacgttctgagacccctagtaaatgcctgaaactccagatagtacagaatccaatatatacaatatgtataaatggtattttaaagtaaacacatatttatcttggcatttaaaaataataaacctccttttctcctcatttaacaagcatctattgcattcctactatgtgtttgccttgggctatgatgcctcaggagtaaacactaaaaaggaatggtgtcagagttactatcttgttggacaagtaattaggtacattctaatacacattactctttataaatt

SEQ ID NO: 161915 - DNA, 372 bp, Homo sapiens
agtaccatctggcatactatattttatgtatttattgattactgtctctcctactagaatgtaaactacatgcaggtaatggtgtgtgtgtatgtgcgcacacacgcatctcattcaatgattagtcaatcattggtctattttgtttaatactatatttctggtagggaacagtacctggtacttaattggtattcaataaatatttgaacaaatacctcttctatttttgaaataggtaccatatttgaaagcatgggtataactaagcaatagacatatagtaggccctcctctctatagtctaggaataacagctagttgaacaatttttatatgccatgtaccgtgttagtcctgcaaacagtcata

SEQ ID NO: 161916 - DNA, 386 bp, Homo sapiens
aagccacaacttccttatccctccatagatgattagaccttttaatcagattttcatcttttctttccatcaattagcagtttcccaatagctgacctttgggaccacaattatggtttccagtgaagaagtgtttacatcctaacacatctacccatagcaagtcctcccatgacctcacactccatccccaaagacatacacacacgaagggggatggacacacgaagggggatggacacacgaagggggatggacacacgaagggggatggacacacgaagggggatggacacacgaagggggatggacacacgaagggggatggacacacgaagggggatggacacacgaagggggatggacacacgaagggggatggacac

SEQ ID NO: 161917 - DNA, 502 bp, Homo sapiens
tgaacatggtagaagtgggaaaaaaagccaaaacatcgcctcccgttaggttgtggcttgggatagctaaggcagaagagagaggctggttgctttggaatcactagttatttaccagtacctttctcgcatcccggcacgctggtgaagttgtaaaagtcacaaatggtgggctagagatgagggtttctgttgaggcagcaggcccagaaaggtggggtaaggccaagctagtggggccagcatgagaccctgcctgccagctttcctgtgaaggattaattaacctccccagattctgctgttacaaggaaaagaaggtttaaggaaaggaatagttaagttactacccctgtgactcatctacactgaggaaaaagcccgtgatgattttggagtcctgattctggagaattgcttgaacctgggaggtggaggttgtagtgagccgagccgagatcacgacactgcattccagcctggcgatacagcaagactccgt

SEQ ID NO: 161918 - DNA, 293 bp, Homo sapiens
gaacccctctctaagtgcgaccactcttttctgtatagccagaataccctatgtgttcatctgggaaggttatgacatgttctgcttaagcttccagaaatcccactttggggggaataatataaaagatgcagaggctgtgaagtctgaggctgcccttcttttactaggcttgttcttattttctttgctgtgattaggagatcaggtcactgggagaccccgaacagattgctgcttctatttaaggaggaaataaacttgaatatgaatcccagctctgctgcgtacca

SEQ ID NO: 161919 - DNA, 441 bp, Homo sapiens
gatatattaggttgttcagtgtgaatgtaaaattttaggtccgtatttgaagtgttagaactagattctcacttgttttcattactgaacaacatgggccagctacttatgacgggcaagccaccagccaccatattagcagagaatcaatctgtaggtaatacgcataccatgaaaagttgcttctttctccacagcgttattgcgtctgagaatactacttctcttcctcccctccttgaaagcccgaaacaggatagggttaaaccatttagggatttttaataatcactgaagacagtgcaacaccatactgtcatgttgagttgcaaatatctttgactggaggaggttggaagatgaaatttcaaacattattccatgtctctgccagtagagatacaagaaattgtaaaaagaattgggctagctgtactgtag

SEQ ID NO: 161920 - DNA, 468 bp, Homo sapiens
taatctggaacagcgccctgagcacatggtcaagatgaacatcgccagtcatgagacaaaccgacatggagaatctgctgatgtcgtgcactgagaagaacagcatgtctgctatgcagtagtcctgccaaaaatgttatacctacctgaatctaatcacaaggaagccattcgacaaacctacgttcaagggcttcctgacaatgactgcactggtttaaagcacactttaaggcgggctgatcacgagatcaggagatggagaccatcctggttaagacggtgaaaccctgtctctactaaaaaatacaaaaaattagccgggcgtggtggcgggcgcctgtagtcccagctactcgggaggctgaggcaggagaatggcgtgaacccgggaggtggagcttgcagtgagccgagatcgtgccactgtgctccagcctgggcaacagagggagactccatctcaaa

SEQ ID NO: 161921 - DNA, 500 bp, Homo sapiens
tgtcacccaggctggagtgcaatggtgtgatctcggctcactgcaacctctgcctcccgggtgcaagcgattctcctgcctcagcctcccgagtagctggggctacaggtgcgagccaccacgcctggctaatttttgtatttttagtagagatggggtttcaccacgttggccaggctggtctcaaactcctgacctaaagtgatccacccgcctcagccacccaaagtgctgggattacaggcatgagccactgcacctgatctaacagtgaataactttttaaccatgtccaaaatctttcccctttgaagcagtggaattttggagctttctgagatgagtgcaaactatttagctatacttagttttaataagaatagttgctgaaaaattattttctataaggatcaagcagaaaatcaaaagtagttgattgaaaagtcttcagttgagttgatagtaacgtgctggtttgttagcatgaacagatgtacctt

SEQ ID NO: 161922 - DNA, 388 bp, Homo sapiens
ccacggcccgtgtgtggttagcagagagagtggggagcctgacttccatttcccatttctcccaattagagccttgctggactagttttggaaaagatattattttagtggtttccaaatccctgaacttgtagttggaggaaacctctccactcctctcagaatcaaaagcttcaagcagatggtttctgagagggctggtccagacggccattatcaggttttttctccctcattccaaagcctgtcctcactgctgttgccacagcaaaaacctaaatcagggagagcatcagtgtcattcatccaagaaagacaggcacttcctgcttccaaatagatcaaaatgaagcccttcagctgagaaccagaggctgttccattgttc

SEQ ID NO: 161923 - DNA, 281 bp, Homo sapiens
atatgcaaagatcaaatttgttataagactttatataaacaagctctgtccagtatttatgacattaacaatgtaaagcataatcttttagatgatgcatacttcagcctatgtgactttaaaaattatcaaaaaaacagaaacaaaacccccaattaaagaatcctcattaataaatcctcaagggaaaacacttcagccagcataattgacaaaaaaaaatgcaattagtagttacatattaggaacatattaagaagttataaaagaaagaaatacag

SEQ ID NO: 161924 - DNA, 611 bp, Homo sapiens
taacaatcacacatccccaggctcaggcacatgcacgcacaggtgccagaggaaacatgcagcacccactgctgcctccagctacccctgcatcttgcatcctcatgctgctctctttctctgtccccccacccccgcctgccctgcctccttcagcgccacctgtcccaggaagagttctaccaagtctttggcatgaccatctctgagtttgaccggctggccctctggaagaggaatgaactgaagaagcaagcccggctgttctaggcagaggctctataaatatatatgcatttatataaagatatatgtaaaatctctctactgtagcataagatccttccccttgtgtaaactgataaatcagatacacaagcttgttggaaactggggtgtaagtcaaggggaattatactctcaatgagggggcccaagaaacgtgcattctgtttggggcaaggactttgcattctgaattgtttttgcacacttactgtttctgaactgtatttcagccagcagagagtggcaggtagccttttactcttgtccttctgtggagaccaaggatgatgaaaaactaattcatttttttgtgtaaactgatt

SEQ ID NO: 161925 - DNA, 439 bp, Homo sapiens
gtcgaatccaaatcactcattgtgaaagctgagctcacagccgaataagccaccatgaggctgtcagtgtgtctcctgatggtctcgctggccctttgctgctaccaggcccatgctcttgtctgcccagctgttgcttctgagatcacagtcttcttattcttaagtgacgctgcggtaaacctccaagttgccaaacttaatccacctccagaagctcttgcagccaagttggaagtgaagcactgcaccgatcagatatcttttaagaaacgactctcattgaaaaagtcctggtggaaatagtgaaaaaatgtggtgtgtgacatgtaaaaatgctcaacctggtttccaaagtctttcaacgacaccctgatcttcactaaaaattgtaaaggtttcaacacgttgctttaataaatcacttgccctgcacatc

SEQ ID NO: 161926 - DNA, 1114 bp, Homo sapiens
gcagagattcaacttcatgctggaccattatgtctagagacatgtgaatgtctgaaaaactgccctggaaaatgccactattccaatgtgtgagtgtttttcaagtttttattctgtctagccccgaaagtgagcttaatggctggctggggaaaggtatgcattgtcagcagctctttaaccccaaggacctcaagatgaggttttgttttgtttgtttattgttgtgttttttttttttaactggcaaaagccaattttaggattaaagccaccttatgaccctctgatatcatttttattgcagacctagtctaggggcaggagggctttggtggtctcagtgctttcaggtttatttgtttgcctctgcacttttaaacttggggcagcggggaggatctcgtccatggatttcagacatctgggaggggctgcttcaggcgtttaggtggtcctgtctggcagtgctcagtctaccactgactgccagttctgattgtgccacgtttccagccacatcactcattttacagggtctcagggctccatttttcctcctctcttcccatagtcactggcccttatcttttgagatggctgggagtttggcctcagggaaagaggacatcttctagatatggcatttgaaagtagaaactgtattttccaagcccagttcttccctcgcccacaatgggaagtagccacttcagacatgagaaatggtgtggatttggcacatctgtatgccacttaagcaattctaacagcttgaaatactgcagaaaaaatgcattttgcttcttaagttggcagtcccttggtccgcaatacaggggtcatgccaacgtctcttgccctgtttaccccttattttaggaaacaaattgccttatggcttaaaaaaatccttttggaagtgtgacgtgccagtagaaaagcatagacatcatgagtgaacagctcagtggcttttcacaagtaaacaggcccgtgtaaccaacacctagatcaggaaatacagcattgcaaccccctcaccacacacacacacacacacacacacacacacacacagacacacacacacacacacacacacacacacaca

SEQ ID NO: 161927 - DNA, 366 bp, Homo sapiens
atttcaaagaaaaactattgtgtaacctcatttataactgaaagatataaggcccacaaaagctatcattcacaagttaagatgtcttataaagtgtcaaagtcactgcaccaagccatctcctccatgtattgttaaatgtatttaatagtctttggattattgaaaacagctgattaaaaaaaataccaaataatcaaagaagatagacaagaagatcattttaatgtgttttatattctaaatgctttggcctctttccaacagttggcattcactgttagataataaattacaaacctggaataccttcataaaatactatactttttaataaatatttgccatcattcatctttcataatt

SEQ ID NO: 161928 - DNA, 125 bp, Homo sapiens
gtctcaagccacgtggaataaattgtggaaagacctgtgctgtctggcttgtgcctttacacatgctgttatctctacctcaaatgctgtcttcccactcagtaattaccacttccacacgtcat

SEQ ID NO: 161929 - DNA, 191 bp, Homo sapiens
gaagggaaaacaaggtcgcctagaacatcgggaaagcctctcataaagctccataagcccctcaaacttgtgactatccataatcctgggccttttaaaatactgaccttttgatttctcttccttctagtctacttatctctaaccacaaccagaacaatcaccctagaacatgatgtgttttttgtttt

SEQ ID NO: 161930 - DNA, 375 bp, Homo sapiens
cttgcaaatgtgcatatgcctccttccgaatcaccagagtggagattgggccaatatccaatctagtcaataatttataaagccagagcattcatccacttcttgcaaagcagctgaatatctatgggggttagtcataatctgagctccttgcaccagagccatttgagctacagaatagcacagagtgtcacagaatagccaaaagtgcagagttatttcagtatgagagaaggaggagcacctgactgctcctcgccatgtgcagaggaggagcccatgcatttccaaacccaggggttgcttggtttctagcttggtttctgtctgtaccccatcttgctattgtgtgacttgagtaagcccatctccact

SEQ ID NO: 161931 - DNA, 674 bp, Homo sapiens
aaaatatgaaaacaaaaatatgagcacagttttattctagtcctaatgaaaagttattgccaaactagtgataatagttttacatttagtatcacgtactgaatactaatatgtataattgtatccttgctgtttagtcatttaactgatatttattgagcatttattatgttctaggtacccattgtaaaagtggtcaaatcagatttttaaaagtgtggtgataagtgctagggagaaaaacagattaaggaagaaacttaaggagtgctggggtaggtagggtgggttgcacttttaaatgggttagtagggaaggacatctgagaaggtcatatgaatcaagatttgagggaagcgaggaagagaatgttaggcaaaaggaacagcaagatccaaggccctgagtattcctggcagatttgaggaggccaatgtggctgtagcagagtgagaaagaagaatagtaggagattagatcagagagattagggagtggtagggggcttattaagtagagtgagctgggtagagtattgagattacattggcttttattctgaactagggcgaggtattggaagatttcgaatgaaggactgacatgatctgactcaatattagccccagtggtcaaaatgaagtggaagatacagaatagagagacaggagaa

SEQ ID NO: 161932 - DNA, 260 bp, Homo sapiens
cttcagaatcataagtgctgagtcggctctgagagtttgttcagtctcttttctaggttatgtttaggtgagtcttcaatgatcctgagtgtgcagctattcccatttgtaaacgtatccagagaacaactgctctaataagcctgccactcattctagtttctctcaatccttttggagagggtaagaattttaaaaactggatcattacctactaggggtaggaatgcaggctgagccttaggaacatggcacaataa

SEQ ID NO: 161933 - DNA, 252 bp, Homo sapiens
acaagcaacacgcggacatgcacacacacagagcaacacgtggacatgcacacacacacagagcaacacgtggacatgcacacacacacagcaacacgtggacatgcacacacacacagcaacacgcagacatgcacacacaaacacagagcaacacacagacatgcacacacacacagagcatgcacaggtgtgcatgcatctctctgctcctgtctacctccagccccatctgtcacatctgtttctgtg

SEQ ID NO: 161934 - DNA, 414 bp, Homo sapiens
aagaaataggggattcagaataacaagatttagaatagcagggcagctgagagaacaccctgagtaaagagggaattgcctgcctaagcctgaagaggccagacccaagttcctgtcagcccattttccaggctggtgcctgcatttctctttggtgaggattgctgcccttctctggcctcctggaggtaaggagagttcttggcagcagaaaagcgcgtagcaaccagagggggtctcgagattgacctcacctcccagggatccccgagccccttctcctagagcgagtgagtctcttagaggactaggaagactcttgggtgcccacactcagagaagtctctgggcccaggattctgaagccattctcaccgctgtcaaaagctcaaggagagctcaggctgtatcagt

SEQ ID NO: 161935 - DNA, 674 bp, Homo sapiens
gagggacctcatggggcatctagtctatggcttccaggcctttgatggaaactcgatgagaagtagatttgacagcttctcatcatgcacagacacacctgatggaatgaaacctcatagcctttggttaccctcggtgcatgcgttgcaccctggtgagtcccagtccactttagtctgttctatttttattaaaattttgattcacaatctctgctgggtcagcctgcagttcaagaagcacagctgcattccaacctcattcccagatgagaccactgactcactggtccctggtgccaccccacacctctgagggtgactccatgcctgctcatggtacagcacagagacttggatgatttatagatgtgcaggaaggctggtagagtgcagaccgcagtatttataccttcaagactagctcttactctcagctagctaaggcctccctattgtattttcttcttatgcaaatcaccctggctcttgcagatccagcttccatttcaccttgtgcgtggtaccagttcaggtcaccctgccctcaactttctctgaacgcctgtacccctgggggttgtaccactctgggggtagtgagaaactctgtgttatcttcctctcctgagaccctcttagtttcctagtttgtggaatttccttgaggatgg

SEQ ID NO: 161936 - DNA, 252 bp, Homo sapiens
  misc_feature (36)..(36): n is a, c, g, or t
gtgactgggatataccatggtcactatcagatgtantcgccatctcgtgacggcgattatttgatgtactttgcatgttttaactcactttatcctctaactctagaagacacaagtgtgtcagtaatttggccaagaccattaacctagtaagtgatgaactgattgaggattcaaaagtggcagtctgttccagagccagtgccatgttgcttcctgtataaacaagggttaataatcgccggtcacgag

SEQ ID NO: 161937 - DNA, 219 bp, Homo sapiens
caaaacataaaatatgctggctttgtcggttcatgggaccctttgctgtgctcactatggcctcgggaccactgtccctgttgctctgcttgggaagcttctccttccctcctttgcagaagtgacccctcctcaccctttagctctcggtcccatgtcatgttctcagaggagccttcttgactggggtgaagccctaccaaaggctcagaattctgt

SEQ ID NO: 161938 - DNA, 233 bp, Homo sapiens
agatatacaccaatggacgcagctgtgttccaatacaaccttctttacaaaagcggaaggagggaaagagtggtccttgggctgtagtttgcctataccaggtctaaggaatgaaataattactatacacatgaggtattacattcttctgcgggaaaacaaggtcagtttcttttctaaaattctcagtgattcactttcaaaagccattgttaattcttaatattcacatg

SEQ ID NO: 161939 - DNA, 438 bp, Homo sapiens
agactttcttatgcttcctctatattatgatggtaaaatcttggtaagaaagtcaggtccaattcaaaagagctcaaaggaaaaaaaaaaaattaaagatgctgtcttacattttttgggctgctatgacaaaacaccttagactggttaatctataaacaacagaagtttatttatcacagttctggaagctcagaagtccaagatcaaggcaccagcagatctggggtctgaggaaggcccattccccacagatggcgcttgtcttcacatggtggaagggatgtggggggctagggtgctcccttgaattattttataagggcactaatcccattcacaagggtggagcaccataacccaataagctcccaaatgccccactttttaatactattgcattggagattaagtttcaacataatgaattttggtggg

SEQ ID NO: 161940 - DNA, 315 bp, Homo sapiens
ccacagaacctggggatgatagagtaaatctccagtccctcttgtccgttggactttgtgtgattgcctcattcttgtttctcatggggctgttgctatgaagttgacaatggaaacacatggcagagttgggtgatcaagtcagaagaaaggtggagcactgaattttgcaactgtttggccaaaataaagaagacttgtgccttaggctgctgcagaaaatccagagacctggcctgcattttaggattatatatcttagaaggtgataattgaaaggcggagaaaagatagttagttatggttaggataggg

SEQ ID NO: 161941 - DNA, 407 bp, Homo sapiens
tttttttttgataagacagggtctctctctgtcacccagcctggagtatagtggcgtgatctcggctcactgcagccttgacctttcaggctcaagtgatcctcccacttcagcctttcaagtagctgggactataggcatgcaccaccacacccggctaattttgttcattttttggtagagatgcagtctcactatgtggcccaggctggtcgagaactccagggctcaagcgatcctcctgcctcagtctcccaaactgctgggattacagtcatgagccaccatgcttagcctcaatagcttaatctaacatacctctgttccctgttttgccaaaaatcaggttatatgctcaacagtcccataggaatcacctctgggccaaggtgcccactacctatcca

SEQ ID NO: 161942 - DNA, 322 bp, Homo sapiens
ctgagctttaagtacaagtctttcattcaaggaaaggtatcaagaagagaaattggcaccaaaacagtagaattggatatatatatagaatctgtccaagaaatcatttaaaacatagtaaatttggtacacagaattaaatggacttcttcccagaacaatggaacagcagtcgaggaattgaaaacagtgcctgctggagaaaaacaggaagagaaagagacagtgggaacagagagaaggggaggaagagaggacgtgaatgaatgcaagtgttatttattgacattttagaaattttaattgaggtgatattactgta

SEQ ID NO: 161943 - DNA, 333 bp, Homo sapiens
aaagatgacaggaatgggaacaaagacaagcctctagccaacattctgtgacaaatcctaggactttggagataaccctggagcaacccttgaatggcagccgactcaccagggcatctttctggacttccatggattaaaacacactccaccatagcatctactaatgtgacagtcttctctctattttgggggaccagtaagtggagagctgaacatgaacccttttattccagtagcagcctggcagggtaaaagcaaattggtcttgtgattatttagagagaggaatgctgaaaaaaacattagctaaatctaacgcactgtgatgca

SEQ ID NO: 161944 - DNA, 573 bp, Homo sapiens
cggtaccggtcccatgcacagttacaatcagagatggatggattgatttgaaaacaaaataaaatccagcttcagctgggcgcggggctcatgcctataatcccagcactttgggaggccggggattaggctattgaaaaacttgagatgcttaaaaaatgcataacaaattttaagggcacacatgaaaaagaaaaatataaattagctaactaccaaaaatctagtgagggaaaataggataaaaaaacaacaatgtaataattattttttaaaaataaaaagccaagaaagtttctttaaaaaggccaaaaaaaaagacaagcagaaggcacaaagacagcagaatcaagtcaatttaaatatatgagtaatcacaaaaaaaacagattaaacatgccagttacaatcagagattgatggatttgattttgaaaacaaaataaaatccagcttcagctgggcgcggtggctcatgcctataatcccagcactttgggaggccgaggcaggagaattgcttgaacctgggaggtggaagttgcatgagctgagatcatgcactgaggccag

SEQ ID NO: 161945 - DNA, 448 bp, Homo sapiens
aagtggttgtggctgatgacagggagaaatgttttgagcctgtgggcaagaaattcccaataagaatttttaaaaatgaacatgtataggtatgtgcagtaagggaaaaaatggtggggtttgactggtatatgaccctcctctagaagcactagactggtaaggaacaattgtcctaagagaacatgtgtgtaacttcaaccaccagaaagcatatgtgacccttcccagacactggcaagtcactgtgcatatggtgattagccagcagcccactcaagggggaggatgagaggaggagaccagggaaaaaacaggaaatagtaaatctgtaagagccctgagtcaaagatcaggtggggcccctgatctttcaagttgcccattggtcctttccaagtgtactttgctttgttcaaaaaactttcacatctgttttaaaatctac

SEQ ID NO: 161946 - DNA, 128 bp, Homo sapiens
tagtccttccacccaggttctagaccacatcttttcttactatccctgaaaccctgccccagcactcatccctcttcagtgcacgtcttcaaattctctccctaatgtaacttcccctcagtctgtaa

SEQ ID NO: 161947 - DNA, 359 bp, Homo sapiens
ggttatctctgaatagtaattattttttctaaaatttctcctaaaatcacatattacttctgtgggcacacagcttccttaactgatttacttttcttacacaatatttatatgtacaaatatacatttttccttcccagttatgtctctgaagctctgagttaaaccttaaggcccagacatgaatacaaaaagccctggccgggcgcggtgactcacagctgtaatcccagcactttgggaggctgaggcaggtggatcacgaggtcaggagttcaagaccagcctggccaagatggtgaaacacgatctctactaaaaatacaaaaaattggccaggtgcagtggctcacgcttgt

SEQ ID NO: 161948 - DNA, 455 bp, Homo sapiens
  misc_feature (4)..(5): n is a, c, g, or t
attnngtgacagccatttaggtgacagccatttaggtaacagccatttagcctaacagccatttaggtaacagccattaggtaacagccatttaggtaacagccatttaggtaacagccatttaggtaacagccatttaggtgacagccatttaggtaacatgccatttaggtaacagcctttaatgtaacatcaaagcttgaaaattttatttctttatttctttctctttttccttagagtcttttaaaccaacagcattaatgataaatggtatatgtcaaactctgataactaaaaaatcccgcacctttctgaaacagtctcctatatccaatgtcattagggtatatgtgaggtacattgtactctttggatggacttttaaaaaatacatatgccacattacaagaaagagacaaaattgatgtgatatgtatgtgataaaatctgac

SEQ ID NO: 161949 - DNA, 253 bp, Homo sapiens
cccgccaccgtgcccagctaattttttgtatttttagtagagacggggtttcactgtgttagctaggatggtctcgatcttctgaccttgtgatccgcccgcctcggcctcccaaagtgctgggattacaggcgtgagccgcccactttttttcttaatttttatgaaattaaattgagtaaaacacttccttggtcagcctttggcctgtgggctctcattctgcaaagcctgctgtgggcaccaaacctgg

SEQ ID NO: 161950 - DNA, 372 bp, Homo sapiens
gtacctaggtttgtgcccgagatatgggcaggctcacccactgctccttgatgacactgtatgtcaagaggcttcaagggcaaacaccaccaaaatcctcactggcttattttaactcaacaggctctcactgcttcagcagcagtgagagaagaaaaagcagagagagggtagaatagaaaaagaaacagaagaatattttctgtgccttgcctggctctttatggcagacagtgcacacttacgaattcatttctcaccaagcatggcatcctgttatttccctgccatgcccaccttcaaaacatcttggcattcacctgaaatgggttcccagttgattaccctgttctaacacttctccgtgtaatc

SEQ ID NO: 161951 - DNA, 331 bp, Homo sapiens
atcaagtctagtttctgagggaaaaattcctcacatatcagattagggttttcttccagccaggtggaaatgaggttttttccaaaggatgttatccataaagaaatgctttgttccctgtttttacctgcccaaagcaagcaaacctgagagcagtggtgtaaatgtcactggttgatacaggctgtctttaattgttcagagggacaggtgtcttggtaagtgggtaacacacaaattccacaggttctaataggtcgatatcactttaactcacacttagaagtaaggtgagttcatggcacagacaaactggaacacagttgtgcag

SEQ ID NO: 161952 - DNA, 580 bp, Homo sapiens
ttccacctcccagtgccttcctgagatggtcccctgaagggaagacccatccttcccttctccaaacaccacttaaaccacttaaaccctttcattaaacccttaccctggcctcaaaccatctaccacgctgctgtacccctttatttcagagacggctctgactctcactcagaggtgacactcaccctaccacttgtctatggctgtgcatccctcttggggccatctcttgtggacaagaatatgagccacattcttcatatatgagaaaattacaccaatctcagaggattagaggtcatgccaaaaaacacacctggtagttatgtttaaatatatttttaaggctgggttaaaaaccacgatgaggcgaaaccccatctctactaaaaaaatacaaaaattagctgggcctggtggtgcacgcctgtaatcccagctactcaggaggctgagacaggagaatccctagaacccaggaggcggaggttgtagtggcgtgatcgtgactcactgcaagctctgcctcccaggttcataccattcccctgcctcagtctcacgagtagctgggact

SEQ ID NO: 161953 - DNA, 457 bp, Homo sapiens
caggctggtcttcaactcctgaactcaagtgatccaaccatctcagcctaccaaattgctgggattacagacgtgagtgaccacgaccagccaatacatgaattattttcattgacaataaatgcactaaacagtcacctcaaaaatacaggtaagtaacaaaatagcataaccaaagaaagtagaaagaaagaattaagtatctttttaaaaaaatcaatgacccatttctcactactcctccctcttaaaataaaacagaaaaccttgatgtaaaaacaatcaagcatgggaagactttgaaaggtggaaaggacaaggtggattacctagagaccttaggacctaaagaacactacactaatgagctgtctaccataaatcccagatggggcgctggagaagcctgcaacctgaaactgccaataggcccagacccaaaaaaagagcccctttc

SEQ ID NO: 161954 - DNA, 227 bp, Homo sapiens
ataagactatgtcatgaaagctttagaatatccaacacattatagaatattttcacggaaatatttcggatggaattttggctttaattctttctctttttttcctgttcttttccctctccccacaaccacttctgtttcattttctgttttgctccttcttttcataagtagctggtagtcagtgttctctttttcttcctgtgagacaggatctccctctgttg

SEQ ID NO: 161955 - DNA, 316 bp, Homo sapiens
aaaacccaggaccagagagattaacagcagaattctatcagatgtatataaagaagagttggtaccaatcttattaaaactactccaagaaaaatcagtgaggtgagattcctccataactcattctacaaaactagtatcatcctaaaataaaaatttggcaaggacacaataaaaaaagaaaactataggccattattcatgatgaacatagatgtaaaaatcctcaacaaaatactagcaaactgaaaccagcagcacatcagaaagataactcatcatgatcaaacgggttttattcctgggatgcaaggac

SEQ ID NO: 161956 - DNA, 505 bp, Homo sapiens
ctatcggtcggtacctctggatgcaagtgtctggctgcctttaaagccagctctgtttctactatcctgggctttctcattaattttttctttttgttccttctgctgtcagtcaaatcagtctgttccaaacttgtgcctgttggcctctctgcctcatctctcctcgtttcatttatcccatccatgaccacccgattaacctccattaaacaccagcctctactttcttcgtgggcgatgtttaacaacactccattaccccttgaaggtatctggcgtttaagggctctctctctagcttaatttcttatattctagccaaagaactgttttcatgttccttcaacatacaacacatgtttttgtgatttttaaaaatatgttttttctacacgaataagtatagcccagattatctcattagtgacataaaaactctcctgactgagtaagcctgtcgttgttactattgttattattttgacacacacaactatttaga

SEQ ID NO: 161957 - DNA, 328 bp, Homo sapiens
atttgtacacagtccttaatacttgctcgccaagtgagtgaatgctagaggctggcagctgggtggagggaacttggttagccaggggggattgcaggagcccgcaggacactcgggcggggccgttgcaggcaggtgggccttcaggtgactgcgcaggtgcagccctgtcaggaacaggtagggagactcatgcacagcagcggccagcacctcggaggcctggctttgtccctgcagtgttgctcatcttcagtgtctgttgctctctgccgggggaggctcagggaggcaggactggcttctgctggattccgagtgcacgggc

SEQ ID NO: 161958 - DNA, 376 bp, Homo sapiens
gcaagctggggtattttctaatctaaaatagattaggcattttctgggaatgggaagaaatgagtagattagggattgaattctgttttctcttttcatctcttctttattttatcgtccaatcattctcactggcatttaaaacacacttaatttagtcctatccttgtagagcaagttgatgtcatctagtttgatttagcctatttagtccaataagttaattggttaataggccatctgtatgcatcaggtgacaggaatgctaggatgaatgcaatcacacacacacgttaaataagacgacatgggattgtataaaaacagttcagtttactccctatgactgctaaagtaaggttttctcatttctgat

SEQ ID NO: 161959 - DNA, 182 bp, Homo sapiens
ttgaccggtgagcagtatggtaggtagtgtttttaaattttgtccctactttgttttcttttccttagagactctgactaattaggactctgcacgcttcatgtcctcagtgaatacttattgactgcatcacagaccaattgatttatcatacaccaatgtaaatggctaaaatactgcca

SEQ ID NO: 161960 - DNA, 372 bp, Homo sapiens
gcaactttatttaagctctatgatcacctgggatgatatatatactttggaactgaatcactttacagagtgtcccaccactttctctcccggagtctgaagaaagcctttaagctgtgatatcaacagtcaggagtccttaggatcagagtagttcagtcaaagcaagatgtggttaagacaagaagctgatatgattaaagttatagtctgtatcgcccctcctccaaggttaacttttagtggtatgtaagtgccagcaataagtttaatctatgaaaccacataacttggattttcttctaaatatcttaaaatgaaggcgattttctagataacagataatagtgaaaagtatccctggagaaagca

SEQ ID NO: 161961 - DNA, 335 bp, Homo sapiens
tctaaactctcaggtgaagtggaggtaagctgcctctgcgaggatggagccacggtccactcatcttgacagagccaattgagtaccctgggatgcaggtatttattgggggtagggggtgggaatgcccaggggcagacccagattgtaaagtggctcagcacagaaaaaggctctttcatgctgaggacctgtgggccatcacctcagatcttcacctggcactccattttgccaaaacatcagagcatcgctaaatgtggcagtgactgcttggtgctgtggaaacccctcactagaggctcactggcaggtgcaggtgggcagtggcacct

SEQ ID NO: 161962 - DNA, 344 bp, Homo sapiens
tccctccatcaaacaatctgccttacttgctgcagccaaactaaagttgtctagactcccctctcccatttcttcagttcttctagctccttaacacacactggtccaatttctgccccatcactcttggcaaaatccattatgacctccaggctgctaaatccaagatacagttcaggcctcaatctgctcatcctttcagcagctttcacagggctgctgagtagggttgagcagttttgccctgcacacaggtgccctgcagaggaatgaggtgggctgaatgaaactccttttttaaaaattctcggctggcatagtggctcacgcctgtaatcccagca

SEQ ID NO: 161963 - DNA, 521 bp, Homo sapiens
aggacacttccagagcactttgatcaccctgctaacacactgctcttcatgtgctacacaaaggtatgcagcttatctcccctcttgagattttaagctacttgaggtgaaagactgttttagtaaccacacagcagacaggcagtgaatgttaatcaaaagaaagaatgaatgtatttttgcatgtatttcttaagagtttacaaatttgaaaaaaaaatgaccaaaaattgcttcgagaaaagctgatttaaatgtaccaaagccacattttaaaaggatcagagagaaatttgaaaacaacgggagtccagaactgacagcagtttataacaactccttacctgagtctaaaatactgggaaataaattcacagtggttaaagctactctgcagattgtatgtgtgccaaaacttgagttttacacaaaccatgctgtggccaaataaacagtacagttttcaattcgaacatcacctatgagcaacttcttcagttcagtgatgctcaaatatcaga

SEQ ID NO: 161964 - DNA, 247 bp, Homo sapiens
atcctgttttaattttttaatgacgtttatttctaccatggtagaatgcattagtagccccaaatcctcaccattgcctctactggcttctttgtcatatggcttcacagatactctcatcaagaggtgattatgttttgccacccttaagtctgagtgtgaccatgtgacttgccttggccagtgggatgctagaaggcaggttaccaccagcagaggccagccagatcaagcatttgtgaaactg

SEQ ID NO: 161965 - DNA, 240 bp, Homo sapiens
acgtcatgaaacactgaaatgacagtcactgaaatgacagtcactgaaatgacaaaaaggcaggacactgtttaagttaaaggcaggacactgtttaagttaaagaggaataaagagacataaaaactaaacagcatgtgtgaaccttgattggatcttagattacaaaacagagctataaaggatatctttgtagataatcaggaaaatctgagtatggactgtgtattagaaaatatt

SEQ ID NO: 161966 - DNA, 330 bp, Homo sapiens
gtccgacggcagtggtggttccatgtgtacaggagcgtgtgagggagcgctgttactatcccgttctcacacagagggaacggacacactgacatgcagctccatgtctaggtcctagggctggggactggtggagctggggtgtgaatgcttgcagtccgactccagggtttgcatttgtcaccatgaggttctgccgccttttcatttgctgcagtttgctaaaagctttgatcagctattgtgcgtcgtgagtgcaaagatgaagaatttaggatctactgtgaatcctacctcccacaacctcacggtgtatcttcactgacatat

SEQ ID NO: 161967 - DNA, 385 bp, Homo sapiens
agagcctacagctaaccagggaagacatggtgagttcagtaaaaggcaggtaaggaggagccttgtgtccaaagctctgtaaaattttctttacttgctgcataaaaaataaaaagactcagaatatatccaaagatcttatatttaataggcctttaacctgagaacaaatcaattaatttttagatttcattttatcatgctcattcttatacatccatacttagaaaaaagaatgagtaatattaaaacaaagtagcggcacactcaacagacctcacaccactgagatatgagacgaatgcaatcatatcctacattctacacatatctgaaaactttaaaagaaacttacagaacgtgtgggaatcccccgcatgaaatt

SEQ ID NO: 161968 - DNA, 321 bp, Homo sapiens
tgcacactacgaaggtcagtgactgttacctttcctcccatcgtccagccggctagcagcatttctggcaacccagagctctgggccctggaacagggtctccactgcctctcggttgtcctcctcctcctcacgctgcccctccccttctcattacctttactgcttcttccttgtactctcattttcttttttcttttcttttctttctttttttttttttttaagacaagagtttcactctcgttgtccaggttgcagtgagccaatattgtgccattgcactccagccttggcaaaagagggagactccacctcaac

SEQ ID NO: 161969 - DNA, 553 bp, Homo sapiens
aatgagaatgatgccgccatcactaaattcctcctgggccagatggcatctgcctcattgtacaaacttcatctttttaaagtcacatatctacttattttatctggttgaattattccagtaactttcttggcaccagaaaaagagatagcaaatattaattctgctctttttatcacgtcaacggagtttcttctccacacttggttttctcaatcacctaaacaaaaatagcagttggggcctccttgcatcctgaaagagtcatggggaattttccagggaaaggaaggcatggcatctgccacccccttgttgggagaggatttgttttaattgttccataatctggggtgtcaactattcagcaatcagtgtaataacagaaactaaccaattagaatggacacaagcccttggggaggttggaaggtatccaggcagtggttacttgacaaccagtgtgaaagtagttcaatattttaacaggtcgagatgtacctgccaaacaccagtgcaaatgcaggcacatggtgggtgagggatgggttga

SEQ ID NO: 161970 - DNA, 149 bp, Homo sapiens
aaaaggcttagaaatgtagaacaaaatttctgtaaggtttcctatgaaaaaaaatttttaaaactaacaagacttgtgtgcacatttcctggggtaataagaaagttgagacagttgaagaaattgtacttcacttttcttgaggtggg

SEQ ID NO: 161971 - DNA, 526 bp, Homo sapiens
gtactacttcatcctaaattaaattggtaagaaaacaatatgtttagtttctactattcagaaactgtgacctagggaaagattggtatgaaaaaaaaatccctttccctttctcagtgtatatagtacaactctttgttacatttaaactatatccatggatatcagtgtgctttggaatcctctgctagcattaaagatggaaataaaaccattaatttgggcgaaaaaattacaatacaatacaatacaatacaatacaatacaatacaatacaatacaatacagtaatggtcctccaaagatgttcatgtcctaatgtttacaacctatgaacatgttatgctatgttacatggcaatggggaattgtgctggcagatggaattaagcttgccaaacagttaaagttatcctggattatctgagtgaaggcagtataatcacaagagtctttataagaggaagagggaggcagaagtgatgtgagaaagacttcattagcattgctggctttgatgataaaa

SEQ ID NO: 161972 - DNA, 389 bp, Homo sapiens
gcggtggcatgatctcggctcactgcaacctccgcctcctgggttcaagcgattctcctgcctcagcctcctaagtagctgggattacaggcatgcaccaccacgcctggctgatttttgtatttttagtagagacggggtttcatcatgctggtcaggctggtctcaaactcccgacctcgtgatccacctgcgttagcctcccaaagtgctgggatcacaggcgtgagccaccacgcctggcccagtttttctttttttattcccaatcagtattttattatatggaaacaccaaaatttgcttcctgttgatgagcatttgggttatttccagatttagactgttaagaataaagcatctataaacattcatgttttcttttatcc

SEQ ID NO: 161973 - DNA, 438 bp, Homo sapiens
caaggaaggcctggcaggtgttccctcaccccgctttctgttccatacatgtttcttgagcgttgatatggcctaggcctggctctgggcactccgtcatatatgatcccataagagatggtgttttgctctaagaacatgggtgtggtaggaagctagcccttgggaggggtcagggtacatctcagtcctctgtcactgtggggaggacctcagtgtcagtaaagttcagggttagtctggctggaaaaaaggtggcagcattgatattcccttccctgtatataaaaccttgagaggagtcctgcataaaatccggtggcagaacccaggctctgcctctcagggcagcacctacctgtcatagtaatttagctgaagttcacatttattttctttttcttattttttactttttttcagaaatggggttaccct

SEQ ID NO: 161974 - DNA, 376 bp, Homo sapiens
agagaattcaggagatatcaacccctgagcaagaggtgcaaagcgttaggtactgggtttgatgtacaggtccaaaagaaggatgggcagagccaggtacccaggctgtataccggattccctgggctctaacctgtctctgtgccacatacctacttccttcctcagccacacctctggatggagacactggggccctgggcaccagggaggagagcagtggaggaggcagggccttagggtggggcagcaggggaggagcctccccaggaactgactgggtccagggcttggagctgctctctgcagttgtgtgggctgtagagtggagggccatccctcctcacctcagccccagctcccaagcctctggagt

SEQ ID NO: 161975 - DNA, 403 bp, Homo sapiens
tttcacattcttgagcctagactaactaaacttagtaaaataaaataagtctgttaaaagaaatcaagaaaatgccctcgtttcctgccaggctcagtataaattggcagcctcacatcagaatctatcagcagtgtgcataaggcaccgtcttgtccatggatgcttatagacttgtgcacattcaacagctagtgtttctactcaatagtaagccttggacaaaaaactggcacagaagaatactgtaacctatgcttgtagaattaattgggtttatcagtttttctaactaaaaatagacacagaatggggaaaataatgaatttaaaacttaaagttctgtaagtcttagaacttttaaaaagaaaacctcaaaactaaaaggaaaaaaagatatgcc

SEQ ID NO: 161976 - DNA, 142 bp, Homo sapiens
caaagcagagctgacgtccagtccacgcctcatggcactttggaagtgcatctgacaccgtttgcctgccatacacaagccacaaagactttttgaggcgacaggttatgccaaaaattaagtaaaaatgacacagcttcag

SEQ ID NO: 161977 - DNA, 674 bp, Homo sapiens
agtcttcttcctgttagagtgccccaggacttgcactgttccttctctaccttacctttcgctatctaccctcactcccttggtgatctcacccaacctcctggctttaaagactgtctacatgctgctgactgtcggatttatttctctatcccagacttctttcctaaacttcagctgcctgttctacagttccacctggatatttagtagaaatctcaaattaataatcaagctgaaaactaaactgctaatcttcctgaaagaaaccttttctaccagcagtctttctcatctcagttgatacagtccatccttccaattgctcaggccagaaaccttggaatcagccgtgactcctcacatctcctctcccttcgtctttcttcacctccttactcacatctcaccccaacccatcagaacattctgaaggcttaccttcaaaatacatccaaaatctgaccatcttttcctagttttgtctgagccagtaccatctcctgcctggattactgctattttatagtctgttctcacaaaagcagtcatagtgttcctttttaaatgtaagtcagatcatgtgactcttctgcttaaccctgtagtggctcaccatgtcactcagagtcaaagcccatatgtctataaccatctctaggatctgcccccat

SEQ ID NO: 161978 - DNA, 344 bp, Homo sapiens
ttgactccatatgcatgttctcgtccatgggctcatacccagtccaaaggactttaccccagctccatctttgcccagacacacttgaggctgcagggttttgtttggatgtgtgtcccctccaactctcatgttaaagtgtgatccccaatgttggaggtgaggcctggggaggtgttttggtcatgggaggagattccttacaaatgtcttggtgccctcctcacagtaataagtgagttctcaccctgttacttttgtgcagagctggtgactttagtctgacatctctcctgttctctgtcttgccatgtgacgtgactgctcctcctttgccttctgcc

SEQ ID NO: 161979 - DNA, 408 bp, Homo sapiens
  misc_feature (23)..(23): n is a, c, g, or t
tcggtacctacttttccacaggngaaggaggagggtgcttcattctgctgcagtattcgaggctcacctggctgcaagggctgagggaatcaatatcttggcatacctataatacatcttggcaaaccagtgtataattatatacaccaaatgtaaggggaagagacatgaaatgtgggaattattagtggatttactttgattaattcctctgcgtaagcatctattttgaagccgttaagaaaattcagataaaacatgtgaaacttaaaaatactaaatagttaagtctcttaattgcctgtcttctagcagtcaggcagttgagtcaggaatgagatggagtgaccgttttacttaacgctttataaaatgtatttgtcggttttttagattaagtatatttta

SEQ ID NO: 161980 - DNA, 279 bp, Homo sapiens
ccttgccgtcctggagcgctgcctggacttgcgtcctgctgtgttccttctccactccttccgcgcacactctgtcctgatttctgctaccagcacttccttgaagttgttctcaaggttgccaagaccacccaattgtcacagggaagaaacattttgcagacttcagcttacttgaccttcctatacttcctggtgctgttgttcactccctttgcttgcaattctgtcttttctttgtttctacaatgttactttctcctggttccaccccctcct

SEQ ID NO: 161981 - DNA, 367 bp, Homo sapiens
gagtattaaaaataggcagtccccaggaaatattgaaaattctagggctctcagaaacatcaaaatcaggtcctctccttagtacatgacttctggttttgggggcttcttattatcaacaaaaatctgcttgtgataatctggagtaatataactgtttccaggtgtttcttcaacaagacaggtgagttgcttcttcactgtggacatgagcaggaggtcttgctcaagtttcttacacagagaaaacttctagaaggtttaattttatcatttggcttttctactgccatgatgtaaatagacacctgcatatatttaaccattaaaagaatctctgcttaattaattgctataattctttttt

SEQ ID NO: 161982 - DNA, 295 bp, Homo sapiens
cttgagttttagtgcccagcatggggagacattgcatggaaataaccattcctaatttgcttagttgaaacagaaaacaggagagtctgctggcagtaagacaaaattattttctttccaaatcttaagaatttggcttaggactgggttttgtcaaagaatgttcttgctgacatctcatccagcttcttccatcccttgagcccatcagttaaaactgttcgatgctcactggagctaagtcctcttgggaggcttttaatggaggtagattactattcattttaaaacaaaa

SEQ ID NO: 161983 - DNA, 243 bp, Homo sapiens
agaagaaagatgcctaagtatgttcttataggcaaataaaacacagactttgaaactgtcctgaacaacaactattctactgtaatacttaatacagaagacaatgatccagacaacataatgcagttacttgcaatgaaaaggaaaaaaacttgacattccccctatcaaaagacgacttttgataggaggagaatgtgggggaatatggttgttatgaaccatgagggtgtattctcgtgt

SEQ ID NO: 161984 - DNA, 514 bp, Homo sapiens
caccatacgtcttaagctatcatttctttgaaatataagaaaatgtgcagcccattgaccatgaacttcaaaaagaagagaggaggtgcactttgtcctgagggaatttgtggtatcataggtctttgaagttggctctagcattcatcagtgaagaagcagacccatagtagtctcattcttacccttgtataatacaacaagatattctacccatctggtcctggagtagggcggaggctagtgtttagtatggaaatattaataggaggagacaaaacaattagaaagtatgcactgaactacttagtacttgtgaagaagtagaagcataaaacccagagaagaggtcttattctctatgtatgagagttttattatctactgtgtgccaggtacgatgctctgagttatttcacaagtaccatttttcttaagagtcagggccatgtccctttattgtctgtaagatggaaagagaaaatgtgtcccttcctcacgctgactgaaagta

SEQ ID NO: 161985 - DNA, 491 bp, Homo sapiens
taaacttgacatttatttgcaggacagggatcattcttttttttaggagaaatgtcccatgtttctttccattatttctttaaagataatttttgggtgaagcgtcacagtatttttatttatctatcatcgtgagaagtctgagcaacattacttttggtaagcatccaggattatcattcaaattagatacttgcagacgtcacatgtctgggtaagtttagcagcttgataaatctgtaagtccctgcagcttatggttctttcacagtccagtgtgtatcacaggcacttgacctttcttgaaaaggattctactatgaaatccaaatgtccagcttcttaacactgaaacacgtatatacaaacacacataaatatgtatatacgtacttacacatatatgcttatatatctatatatattgtatctatatttcaccactttccttcaaagtaatttagtatatccataacccaaaacaaaacaaa

SEQ ID NO: 161986 - DNA, 149 bp, Homo sapiens
agtcacagcaaaactaatagtagctaatgtttattgaaatcttctgtgttgcaagagggtgctaagcagttggtatgtactaattcatttaatcctcacaacagccataagaggtgtagaggctattattatccccatttaacagttga

SEQ ID NO: 161987 - DNA, 358 bp, Homo sapiens
gctgggattatatcatgagcccccgtgctggccttgttcattcatattataactcttaggaactttaaccttagatcatagttagaaatgagttcaaacttttaatatgtatctgtttttaacattagctatgactctgtttcaaaatataattctaggccataaattaaatgttaaaatatatcatcacaacttttaacaatattcctaatttaaaatatctgtctagattgtaaataaagaacattcagcagctctgaacactattacataattcaaaatttaaaattagcactaaaataattttccattttcttgaaaactggtacaaatttctaaataaataatttccttaaag

SEQ ID NO: 161988 - DNA, 196 bp, Homo sapiens
tgccatcttggacttccaagtacctagaactacaggacatacccaccatacctggctaatttttgtagagatggggtctgtgttgcccaagctggtcttgaactcctggcctcaagtcatcttcccatctcagcctcccaaaatgctgagattacagacatgagccaccaagccaggcctcattttcttttctttt

SEQ ID NO: 161989 - DNA, 254 bp, Homo sapiens
ttagttatcttagcatttgcctccagcctcactttctgtggccttgtttcctgtatttgcccagtgtgtttataaaataaggatttaagaaactaagttttctctgtagagtatcagtcccgtgttaagatgtttcttattgccttgcctgattctgcctagttgaatctgtctgcttttccagagtcccatgaatcacatgtactgctatgagtccaaagaaaataaaaaattaatttattaaaaatgagtct

SEQ ID NO: 161990 - DNA, 196 bp, Homo sapiens
caaaacgggcaccccagtttccaaaatttgtatgaccttgaagcccaagtaatttctttctgcttttcttacttcacattccagatagaaaaaaaataaacatgaatgagtgaatgtatctatctgattatctcagtttcccccccttttttctagaactgagtatcctaagttgttgacctgacccccctataga

SEQ ID NO: 161991 - DNA, 180 bp, Homo sapiens
tgcttgctgagcaattctacaaagagagccacacatagtacacagactgaaaaacagagctacacaaacacaaacagtggaggctttgggagaaggtccagtactcacatttttaaagccattctggggtagtccaagagagctaagcaacaaagacaaaatccttcagctaataaatct

SEQ ID NO: 161992 - DNA, 402 bp, Homo sapiens
ggttaaaaatcacatgaagtgaaatcagaaagttgcttgttcaaatcccaactttgatatttatgaacagtgagactttgggttaattattaaacctcattgaattgtaacctcctcttctatgaaaatgaggataagaataccaggctagggataacgtgaatattaaatgggggaatatatacaggggcctcaattatggtctggtactcagaaaaggaaaatgaccaggctgctctcactctcctagcacgttctttaccttgcaacccctggttcccatcactcaggtcaatttctccagagatgcttgaaagcatccttttctcctgttccttcaacatttcctttgtcagagtttgccagctcaccatcaagttaaaacctcctttaatgaactaa

SEQ ID NO: 161993 - DNA, 338 bp, Homo sapiens
  misc_feature (268)..(268): n is a, c, g, or t
  misc_feature (312)..(312): n is a, c, g, or t
atggaaaaattgatgacactttcttgcttctggtgtgcttcccttccacgttcattttccataagaagcttcctccatcccacctcccaacaggccacagtcaattgaagacatttaactgtgaaaatgaggctccataaaaagaatttagaggccgaagccgggcacagtagctcacgcctataatcccaaagtgctaggattacaggcatgagccactgcacccagccaaaaccagctctttcaaaagactccagtgcttgatatnaacaactgcctgagggttccccacccttttgcagtttccacatnacaattaaccagcattcccttcctgg

SEQ ID NO: 161994 - DNA, 234 bp, Homo sapiens
ggtaaaggcttggctgaaggaacaagagtatgcacaaaggtagaggtggagagaagggaagattatgcaggatcttgtcagccacactttgatccctaactacctttcctatccctgagacccaaggtggcagcaagtaggatactttgggtaaaaggacatgttagtcatcgaaatttgtgtacataaaaatccatagcttttcctgatgttataacttctagcctttacacg

SEQ ID NO: 161995 - DNA, 619 bp, Homo sapiens
attaatcattacagcattttctttcttggtaaaataatcagaagattgttgacattagttcttagatgtaagaagataggaagctctgcttcactgatctgacttcaggtatgaccttcattattgccttctttcctatttaaagctgtgactcatccaaaaagccttctccaagagactgtgtatcatgtaatgggtactgtgacctatatgtgctagattttccagagcagctctgatttaaaatagtgtggcccctcatcattcttaacagatgatgtgattaggaaattgttaaccaaatttgtaacttaagacttgataaaaaggatagtatgtaaaacctttgagagtaaggttcatgagctaatcatcttggcacacattcctcacccaaattctgttcccctcagcctgatgccttccacttagatattcagtaaatatttgagtaaactgactgaatgaatgaataagacgtgaagtctttaaaaatggataagatttgaagctttgatattccaggattagggagacaataagttaagcatataaaagcaggaatgatagagtaaattagggagacctaaggtcttttctagagcggaagtatgtagta

SEQ ID NO: 161996 - DNA, 456 bp, Homo sapiens
atctgtgaaaagggggatgactagtacaacttccactgtgggagaccacaagaaaaatcagccctctccaaccacacaaaagagccagcaagctttgcaactcccaaggaaccagaagcagaaagggatgcagtatggcatgacagactgtgagtctgagtcacacagatctgggttcaaatccaggtatccactaccggctgtctgtggattaaatatggctacaaaccttttgccactctttccatcaagaggtggcgtctagttcccaacctggaatctgggctggcccagtgacagctctgaccaatagaacatgattgaggtgatgttctgggacgtgagcccaggcctcaacacgactggcttccactgtcttggcccccagatgccatgctgcaagaagttcaggatagactcttgaaggattagaggccatgcaaagagaagctgcct

SEQ ID NO: 161997 - DNA, 461 bp, Homo sapiens
ttagagagtacaaacctctctgaggtttacagcagcctcagtaatttgcttggaggcaagtattccaatgaaagcaaacacagagccagtcccgagccccacgaccagcgctgtacccaatatgcacccagggtccagaaacgtccggcggtgaagagcctcagacacgtccccgtccatctcctcggggaccatgctgaggtcaggccggcatggttttataagctggcctcagacggctccgttccctgtctcctgtctgggtcagcccagctgccattccccggggacatgcttgcaggctgcatggccctccacctcctggctggggctcgccgcccagggatgggtccctgactcctgagcccacagtgtgtcccaggtcacatggggtcaggaccatgagatgcagatgcggccttggagggagaaactgcccactcggaagtgctgggtggccg

SEQ ID NO: 161998 - DNA, 400 bp, Homo sapiens
ggcttataaacatcagctgtagtaacgatacccccaggtgggaaggggtggtcatgtagtcaggcaggcacagaggagtgagaggccaaggctgagccagcagtggacttgggtacgattttcatcttttgccttggaacgcatgtctgtgattcccactaaatctaactttccttggtttaaatcctctcagttctctcatggcaatttctctggggagtcacggaggtcaagacacagctctgttcagctggtttaccctgtcctgccctgcccaagaccacagcctgcaacagtgccctttgctcaccttgttacagaacctgccacgtggtgcatccccttttataaaccatccacagcaaacttctggggatcctggggtcatttgaaggcctgg

SEQ ID NO: 161999 - DNA, 307 bp, Homo sapiens
acagatttccagtgggggcagaaatatgaaaagctaaaggggaatttctgagaaaagaggaaataagaaaataatatggggcaggagacagaagtcttagaagctgatgatcaaaagaatagggagattcagctagtgaagatacagaatgtgcaaatgcagaatgaaaagaatctgcaaggaaggcctagagcaaaagttagaattatcagaaaacaagatttcaaaggcaaaaacctaggaaacaccacttgtcttggtgtctatagtgaccaaagatttttaaagaagctaaaagggtttcccc

SEQ ID NO: 162000 - DNA, 356 bp, Homo sapiens
aggcttttttgtagtaggatgacaagtgccaacttgggtaggaaagctagagctagagatgagggaaatcgtctttctgcaatcgtcagagtaacagctggtttaggcaagaatcattaatacatgctaaacctagggaggaagtttgatgaagaccaaggtatttgcatggtcttaaattgcctcaccacagattgatgggggttaaaatagtaactacacagtggagaaactggatttggatactatctaattgagtaatcaaaattaccaccacgaatgaaggagagacacactgtccaatcagaagtgacaccccaataagggcatattacttctattctgccaggagccca

SEQ ID NO: 162001 - DNA, 283 bp, Homo sapiens
ctatgttgcaacactcacatctatgcactgaaatttacgttgactcttagaaagttttagagatttggacattttgcctcacagcaaattagcccttttggccctcttcttccttattaatccctccctacttggtcccctagaagcctcctcagctcacttccatctcgtcttaggaccacttccaagacacctgcttgaagaatcattgccaagagcagggccactcctttcttccttcatctcctccttaaagtccactaacttgaatgtgtccccacgt

SEQ ID NO: 162002 - DNA, 405 bp, Homo sapiens
ctctggtacagcaccaccatttgcaagcaaacatgccagtaagctcccagaagtgagcatgctgagtaattctcaaaagggtggcttactagaagaaacctgctggcaaaacctaatctccttcccctaaaaaagaccccacatactacaaaatatcctggctcataatacactttaaaatcaaatgcggctgggcatggtggctcacgcctataatcccagcactttgggaggccaaggtgggaggaccacctgaggtcaggcgtttgagacaagcctgacgtttggccaagtggtgaaacccgtctctactaaaaatacaaaattagccgggcatagtggtgcacgcctgtagtgccagctactctggaggctgaggcaggagaatcgcttgagtccggggcg

SEQ ID NO: 162003 - DNA, 359 bp, Homo sapiens
ttctgctggtcaggcagtcacccccgtgggcacaatgctggtggctgctgtaaggatttctctcaggttcatctctgtttcctcaccttgctggttcagtcttccagcttctacttctgaaatgtctcttaagtcccctacctgcctcccaggtcatcaccctaggttgacactggcctcacccaatctcttcccttcacatatctctctcagctgggggagggagggacggcctggtgagagggtccatgagacagtcaacgaggcagacgtggccacttcgggggagactaagctcactgctgaaggaggcggagctcggctgacccttgggtgctcgacttggggcaggggcctgg

SEQ ID NO: 162004 - DNA, 465 bp, Homo sapiens
agaagtcttaagggaaaactctgcgaggaccaacaggctcagaattagctgtgcattgcaaacagatggtgtgtccctgaggaaatagcgtagttgccctaagcaattgggtgcttccatctgatttagcttagtctctgtaactgggaaaaaggaaaatcttatggaagaaatgagtataatcacctgtgaaccattctaaactattatctagagactagtgattattgacttacatatagatttcataattctgcaagatagtcttcggtgttgtatcatcagttatccaaggtataaataacatcaagacccttatgcctctgagcctgatagatccttatcttttaataaccaaccccccactttcttcagtagccatgatgctactgtatcaatgctaccagcaattggaaacccatattcctaatgccaagtctcggcatgtagattttgaggtctgaa

SEQ ID NO: 162005 - DNA, 330 bp, Homo sapiens
tcactatgttgcccaggctagtcttgaactcttggcttcaagcgatcctcccaccttggcctcccaaagtgctgggattataggcatgagccaccacactcagccttgaaaagtacatcttttatgaccacctgttggttatccaccatgtgagtctcacctaatacaggactggtggtttaggaaatacctgtggctgtcgcagttttggtcctgcagggaaagtgccatctacaaaatgaacttggaatgtctaggttcaggcagtctcttcctcagaaagcaggaacctccagaccagatctaccaaaagccattctccctcccaca

SEQ ID NO: 162006 - DNA, 249 bp, Homo sapiens
tctagaaaacactatgctaaaggagtattagtaatcaactgtaaagacactgtggtgtctgaatggatattggcaaggaaaagctgatgaatatgttgaataacatgttaaacataatatattgcatgcattaatcaatgttccatcataaaacaccattaaaattacagcaaaaggattttttttttttttttttgagacggagtctcattctgttgcccaggctggagtgcagtggcgctatctcgg

SEQ ID NO: 162007 - DNA, 538 bp, Homo sapiens
ctgaacagaatatgaaagtgggtagcagctggaggggcgtgtttgtggtccccagcgcgggctctacgccgggggcgcatccttcccacgtgccacgggctatgaggaaccggcccctcttcctccctaatctcagcgattccagctgggctgcagccacacggagctcaccggaggccacctggcaagcctctgtgattatctgctgcagacgccgaggcctggagtccctgagcatcgagcctccccggggagcaaatgcactcggcactcgtgaggtccaccgccaactccataacagcgctcctagggaaagagcagcgccgggcgtgtcactttttacacaagggctgtttagctacgtgctgtatcagacacaggggacccctccctgcctgggggctttaaatgccacgcgctgaggccagcccttcctgacgtgtcagccactgccccccagtgtctgtgggaccctgagggcccctcggccttccgctccggggagcacctgaagtgcctcaatttactcactatctgc

SEQ ID NO: 162008 - DNA, 383 bp, Homo sapiens
ggtaaccccttcaaacatttaatttctggcacactctcaatctgggccgacaaaaataacatagatcttcaaaacattaaggctacgtgaaagaacatggacacaaaagaccacatagttgtatgattctattcataggaaagtccagaatagggaaatctatagaggcagaaaggttagtagttgcttaaggctaggggaggagggggaataaggatggtagctaaagggcgaagtgttactttttcgtgtgtgtgtgtgtgtgtgtgtgtgtgtgtgtgtgtgtgtgtgtgtgtttagctggtgtagtcgggtcacagggagttactacttgaggtgatgaaaatgttgtaaaattgattgtgatgatggttgcacacatc

SEQ ID NO: 162009 - DNA, 449 bp, Homo sapiens
aacccggtttgcattaggaagtgtaggccacatgctcatatgctgtgtccggactgcgcaatttctgtgtgattttatttgtatcaatgatgactctttatggggggtagaaatgattcagagttaacaagccatatttttagttgcgtcagtgatttcctttgatcattatagaatgttaattttattttctgtatattgtttcggtgttattttgatggcatattttatataaatggtagaacaatatggaaaattcagaaaattgagggagaaaatcatcgcagtactttgacagctgtttcagtttggagatagttctttattctctatgcttacattttacaggttgtaatcgtgtgtggctgctttcaggcagtgtgatttctcttgtggtctagctacatttgagtggttagaaaaattggttgctttctttagttttttta

SEQ ID NO: 162010 - DNA, 477 bp, Homo sapiens
ctctctagtagctgtgttctgtgggttgaccaggatcacttggaaaaagcaagatggaacctaagcgtccaccaatggtggattggataaagaaaatgaggtgcatatacactgtagaatattacacagccatgaaaaagaataaaatcatgtcctttgcagcaacatggacgcagctggaggttgtcattctgagcgaacaaactcagaagcagaagatcaaatattgcatgttctcacctataagtaggagctgaacaaggggtatatatggacataaagatggggtatgaggattgaaaaataatctctctggtacagtgttcaacatttgggtgatgaggccgggcatggtggctcacgcctgtaatctcagcactttgggaggccgaggtgagaggatcaggagttcgagaccagcctggccaacatggtgaaaccctgtctctactaaaaatacaaatattagccaggtgt

SEQ ID NO: 162011 - DNA, 446 bp, Homo sapiens
gagtcttgggtccctttccctcttcccttatgtgggagccacacccgaggcatcctctttcccctccaccgtcaatctctcctaccctagggcatcactcccttccacccgccaaaatctagaatggcccccacattggaaatgctgtccttgactgctctccctcctgcagtcatacttccaatttttcccttatgcttctcaatgaatggatcaacagctccatgtacccgaagtctccatattcctcagttctcactctgttcccagatctctctgtgtggatgaccttgccacccttccttagaatggctctgtttagcgtcacccagtcagtgactttgtgtcaactcattcttacctggggtctcagtggaatgctattccactgaccacgctcttccttggaaacactcttctataacagcagttcccaaccttttagg

SEQ ID NO: 162012 - DNA, 586 bp, Homo sapiens
cccgtcagtcaccctgctgtttactatctccctcagcccccgggttcgaggcccagagcccacccacccacaaccagccttcacacagttaacgccttctgcccccagtcagggagctgctgtgtccctgccttcagcagtcacactgtctcagtcacagtcacacgtactcacactgggcccagcacccccctcgggacacgcaggctcctgcatcacccagcctcccggctttgaggcaccctcatctcctccgcttgcactgtctctgttatccgcccttccctttgggatgtcagcctgcttctcacagaggagcacactgagagagtcacacctgctctctcttcatagactgtcttcttggacctggacagggtggaacagaggaggaaggacatctcaggtggtctttacagaccactgcaggcacccacccactgctgcctaccacccagcagcgtggcacagtggcagagacacagcctgaagacacatcaccttggtccaaatcctggagtggccacttgctggacaagtgtctgcaggaaggttttttaacctctcagtacctcggtttcctcct

SEQ ID NO: 162013 - DNA, 399 bp, Homo sapiens
tgagccaagatcacgccactgcactacacagcctgggcgacagagtgaaactctgtctcaaaaaaaaaaattataaaaggtgcatcattaactgtcaatttgacaactgaaaacatacatgaatttggaagatctgactataatgcaatcagtaagtttgatttactaaatacagaaaataaaacctttgcattttaccaagggcataattttttaatgtccacaaagcaattaaaacttaatcatgtacttggatgcaagtaaacgttaataaatcctctcagatacctcagagctgcattcataaatcatataaacaatatcaaaaggtaagcaaaagaaaaattcaaggacagacatacttctaagtaatgtcagaatcaaagatcaaataaatat

SEQ ID NO: 162014 - DNA, 289 bp, Homo sapiens
ccatattttattacactatctcattgtggtttttcacactgtgggaattggacttccagaactaggggagcctctccactttcattttagtctgaccacttttcttcagggaaggcaaaggttcacaaatcaagtttgttcatgttaaaccccaggaagagatttaaaaagaaaatcttgctacataagcatccacaatgtaaagtacaatattttatatgttatatccatataacaataactgttctaccaaaagcccaagccaaacaaaatctaacaaagtctcatt

SEQ ID NO: 162015 - DNA, 172 bp, Homo sapiens
gagggctgattcttttatcattatataatgtcccactctgataatttttttctgcccttaagtttatgtgatattaatatagctactcctgttttcctttgattaatatttgtataacttttcctatcattttattttcaacctaactgtactgttgtatttggagtgagtt

SEQ ID NO: 162016 - DNA, 192 bp, Homo sapiens
ctgctgtctcttcataccacactgctggtttcatgcatgagtgtctgagcacgtgctgagcatgcctctcagaatgcacacattctccgaggaacactcatccatcacaccagctcacaaagccgaccttgacctagagcccttcctcacacccaagtcccttctttagtgtttctgtcattctttagttat

SEQ ID NO: 162017 - DNA, 345 bp, Homo sapiens
taacagtaaaggagtatgctacggtttgaatgtttgcctcctccaaaactcatgtcgaaacccagtccccagtgtggcagtattgagaggcggggcagttgacaagtgactgggtcatgaggggtctgctcctgtcactgggttaatccactcacagatggatgggttatcatgggagtgggactggtggctttctaagaagacgagggtcctgggcaagcatgttagcatgctcagccccttgccatgtgatgccctgcgttgcctggtgactctgagagtcccctctccccgccagcaagaaggctctcactagatgtagcccctctaccttgtacttcccaa

SEQ ID NO: 162018 - DNA, 159 bp, Homo sapiens
atttttgacagaggactagaggcctcctccctcccctaaatgctttggcacttgacacaaccttagggaaaaggaaggaagccaagaagactcaggagttaaattttctcagcagctgggcagaaaaagagcttgaaatcatagaggaaaaataaagtt

SEQ ID NO: 162019 - DNA, 249 bp, Homo sapiens
ggcacatgcactttctcatgagttagccaatggcagttttttaacaataaactatttcaaacttttcaaatagtcaattacaaattgtcatgttatgaggttatactcttcttttcagtaagcttgaaatgcaacatttcaatataaactagaaatatattttagaaaatcccaagccattgtttacgagaaataaatttgtatatcactatctcaaagcgccaaaattgttttttgaggtgtttatcc

SEQ ID NO: 162020 - DNA, 910 bp, Homo sapiens
ctgcgcctggccgggagttcttaaataaaataaaacaatggaacaaaactactatttaaagctataagacaactttataggaaaaaatactataagacaactttataggaaaaaatacatataaagagggcctaccacatactagagaaaattaacctgcaacaaaaaccctacaagataaaaaaaaaaattcctcaagaccttgaagcaaaatgatcaaataatttacaagggcaagaaaataaggctggtatcagccttctcaaaaaacatcagccaaggtggtaggatcacttgagaccaggagtttgagacctgtctgggcaacatggcaagactctgtctctacaaatttaaaaagtagctgggcatagtggcatgggcctgtagtcccagctacttgggaggagtctgaggctggaggactgcttgagaccaggagtttgaggttgcagtgctgcagtaagctatgatcacgtactgcactccagcctgagcaacagaggctctgtttaaaaaaaaaaaaaaacacacacacatcaaggtaagaaaataatgaaaaagcattttccaaaacctccaggaaaaaaaaattagaaccaaagctttttatatccaaccaagctattcttcaactatcagaaccacaggaaaaaagtttaaacattcaacagcccaagaaattctgtactcttaagtcttcttaagaaatttactagaagatacaaataaaacttacagcaaagaataacataatcacactaagggcagtggaggggaataacccacttaacttttgaacattatattttgtactatatattctcagaacattaaacaaatactgggctctaactcctaagcttctttctaacagaggtatgagctagaaactctgaaactattctat

SEQ ID NO: 162021 - DNA, 120 bp, Homo sapiens
cagggcccagcaggggcattctggggttcttaagttgaaggctttcttggcgggacctgcatttaaggtgaaggaagctatataagatggtggctggccacatccagatggacaacactt

SEQ ID NO: 162022 - DNA, 290 bp, Homo sapiens
caaaaacacccggggacgaggacctcacactcagcagacagaggaggcaggatcacagttcttccttctccagcctcctgagaagctcctccctctgccccacctcctggggaaagctgactgggctaaagtgggagtgcagtggaagtgaggagaggcaggtggcaacgtcagtcttttacaaagaatgtccccgattgcagtcagagagaggagaagagaaggaatatgaaatctcagtttccagagagagatgcagatgccagaagggacaattagagaactaacaa

SEQ ID NO: 162023 - DNA, 226 bp, Homo sapiens
catgaagagaactgtttaaaaacctaagcagtcacagtctgagtaacattaaatacaatttgttcacagacagtctgttgcagattttgtaattctcccttttggattacagatttgacagatttgccacttattttgagatttttaaaaattccttattgttttaggagttacttaaatttatcattatggaaaattaaaacatacatacaattacacagaataa

SEQ ID NO: 162024 - DNA, 580 bp, Homo sapiens
agaggacccctctctgctcccagagttctgtggatacaagcatgtgcaataatctggctaatttttgtatttttagtagagacagggtttcaccatattggccaggcgggtcttgaactcctgacctcaaatgatctacccacctctgcctcccaaattgttgggattacaggcatgagccactgggcctggcctgttctctagtttctactggatttattagtgaaactcttcagtgccttccccacttcctaaagctacaggttatatgggtgaggggacacttgagatgaatatggaagacctagtattatttagccaggtgaacaagagttaaaatatcaattcagacagagcatgggcatgaaatactatggaggtattaaccctttcttccacttagaaaaaaaatagtgcatctcattgccagctctcatttaattttacataaacacactctttgaggctgaagcaaatctgactgattttcaatgtaaaaataaaatataaaaactgttcttaaagttatttctaaacagaacaaacatcagaatcgtctgaatcattgggatcgtctatt

SEQ ID NO: 162025 - DNA, 549 bp, Homo sapiens
tcggttcttcaccgactatttctccctcaaactctgggcctctgcttgggctcttgtagccgggtcctctggtgtgaacaggagcagatgaccaatagcacttagctgggtgacaacccataggaggtatgcttataaaatgccaggggccactgagtgtccattgactaaatgtgctgtccagcacatttattcggagaagtttgattgtctgacgccttcttctctcaactcatcaaagtcattctccgtccagctgtgttccattgctggcgaggagctgcattcctttggagggggagtggcgctctgatttttagaactttcagcttttctgctctgttttttccccatctttgtggttttatctacctttgctctttgatgatggtgacgtacagatgggattttggtgtggatgtcctttctgtttgttagttttccttgtaacactcaggacccttagctgcaggtctgttggagtttgctggagtccactccagaccctgtttgcctggatatcagcagcggaggctgcagagcagtgaa

SEQ ID NO: 162026 - DNA, 230 bp, Homo sapiens
ggactcagctgcaggtgcccctattcaggactccctgtcctgactgttgtagagttccaggccaagtcaccccagcccatgctggcctgaactcctcagcaaatccttcccttcagtctggatctaggtcttgttcttcacaatcccttgtttcttaattgatggttcactggagcttggactttgatttccacgactgtgggcctactgtaccttcatccacctctcag

SEQ ID NO: 162027 - DNA, 795 bp, Homo sapiens
  misc_feature (770)..(770): n is a, c, g, or t
  misc_feature (776)..(776): n is a, c, g, or t
cttcttctagtaaaaccattcccagctgaatagctgggtaaggcagagggtccatacaggaacccagtaaatgggacttttccctcctaatttaggatgagctgtcttcaacttctcacagacttgatatatctttccttttaaagtagattaagtcctatcctttacataataagaatgaagataaataaaatgccaatggtagaagtgcttagcttttggaaggaagtaaatcttaagttatgactaataatgcttatgcttctcctttgaagcaacacgaatgttgtctaaatcatcccaattctgcaagtggcataaaatctgattttcattcagttcagcaactgatcctcaaaaacactttgctgaatgcaaaaaaaaaaaaagaaaaaaagaaaaagaaaaaaagtgattgttcaggtaatatcttcccagcaaacagcacttaaagaaacccccagcttttttttctgagaaagagtcttactctgtggcccaggtgcaagggtgtgatcggcaatggtgcgatctcggctcactgcaacctccgcctcccaggttcaagcaattctcctatctcatcctcctgagtatctgggattacaggcttgtgccaccacgcccggctaattttggtatttttaagtagagatggggtttcacaatgttggccaggctggtctcgaactgctgacctcagttgatccatctgctcggcctcccaaagtgctgggattacaggtgtgagccactgcgccgggcttatnactatntttttttttaccagtcatg

SEQ ID NO: 162028 - DNA, 178 bp, Homo sapiens
agccctgttttcctcataagctaaaaagtgaagctggagataattctacagaaaaaaatttgaaagataccacgtatgcagtcaggccagaggtctctacttttcaacatggaatctaaaacaaacataaagaagcaacgctcgcctgtgatcccagcactttgggaggctgagacag

SEQ ID NO: 162029 - DNA, 617 bp, Homo sapiens
atccatgctgcagctgctgagaagtagagcaggtctagaagagctgccctaggagttttaggaggaagctctgcgacctccccatgcttggcagggagccaccaccctttgacaaacccagtgcactgattccttaggtatgcgtcccatgaccccatggtcaaatgggcacaggccagctggggtacacatgtacaggtgtaccagctgttaaaataccaagatgctctgtaccagctggtaaataactgccctccaaatgcctccagtgcccactcctgtgctttcctgctgcctcctccaccaggacccctcaacaccgcctcccccatggcccattaactccaagagctaaaatctcactgcatccaacctagggccaggtactctgtcactgttgagtattttaaacagcactctgcctcctagactctggtgcttccagggcaaggagtctattttattaatttctgcatctctagcatgtcttgaagccacacccgcagaagtatcagttcaatgcatccaccaaggacccaagaggagcttgccatgaggcagggctgactgtgagtgaggaagagtgagcagcggcgagttgctgtggtaggtatcac

SEQ ID NO: 162030 - DNA, 678 bp, Homo sapiens
cgcctatttgtcttttactgtacttttttataccatattttaattatttttttggcaaagcattaaatggttaaatggtgcatttaaagagatttgttatctgtttgtaaatatttcccatgaaaagaaggcaaataataataccctgacactgcattgtagtaaatctctgtctcttttgctttcatcttgtctaggcacagagatgttaccagaatgtttttgggtcgaagttctcctttggaaaatctatggggtgatgtgtcctcagccaccctttggttttttcctggtcatgggtttcagtactatctggggataaaccaagataactgccatggttatgttagctagagtgtccattggatctcagcttctggtttattttctcccataagatgacctgaggtatggagtgtatcctctcaagggagcaagtggatattctggggctgaggggaatcttccggtgtactcttattttgaaacgggtaaccctttgaaatgttaaaattgccttccctcaaccaggcttccatttcttggagacaaattgctggtcagccaatcagatgctggtaatgaggggaaaacacagaaataatttctgccccctggattctctaaggggacagaaaaatagtgaaattaatatagtaaaagaaaaagagtaaaaaa

SEQ ID NO: 162031 - DNA, 274 bp, Homo sapiens
acacaaacaaaacaggaattcacacaattttcaatagagagggaaatctgctgacttacaccatcaacaagaagcttgcttctagtactcaaaccaatggcacttctcttaagatcacatctgccaggtgtggtggctcatgcctgtaatcccagtgactcaggagactgaggccagagaatcacttgaacccgggagggggaggttgcagtgagccaagatcacgccactgcactccagcctgggcgaccgagcaaaactccatctcaaaaaa

SEQ ID NO: 162032 - DNA, 525 bp, Homo sapiens
atgtcctctcttgccctgtgtcactgacacttttcccatgcagaactgtggttcatacccctccccttgaacatgggtcacctttgacttagttgcaaccaagagaatgaggtgaaagtgactttgtgtgatttctgaggccaggttggaaaaggcaggcagcttctgcctcattcctgcaacactgacacacggacctcctgctgccataaaagcagtctaactgtcccaaggccaccatgctctgaggaagcccaatctagtccacaggggagagcacatgaagaagcctagggccacaaaacaagaaggagagaaatgtctgtccagcccctggctgttccagatccctcactgggagtgggtggttctggccactgtctcactgcacctgtagagagaactgcctgatcaagcccttcctgaattcctgacccacagaaaccatgaggtaatttattactcagagataatgaccaaaacattcatatagtcattggaagggggttttagttaccataggat

SEQ ID NO: 162033 - DNA, 334 bp, Homo sapiens
tccactcggagaagaactccttccgcctttaacaatgtcttggtcccaccttcgttccttgcctttgtggatccagttgccttctgaaaggtttttctgatgccatctgacatccgaatggtgtgatctccacattgtaaccggtaatacttaggcacgtcaaatcctttcaccctggccagactaccccactggctttcctttttaactaatattctggtctctaactttgctctcaaaagggatcctgttgagcaaagcactgtaacttctctgacttacctactcctatttccccacttcttgcttatccattcacttcatcagacaggcc

SEQ ID NO: 162034 - DNA, 411 bp, Homo sapiens
tgacccagaggtggacccagacccagacctagacccacgcggccagctcccaggcctaaatcctgccttgctccacccaccacgccctcattctcccttctatgtcctggagccctctctccgcagtgctggtgcgaacaaggttcacggatgcagggatttgaggcctgagttttcaccccacagaaaagcccatagggaatctctccccagcctggcaggttgaaccagatggaggatgaaccaatacggaggcagagggaccagccctggctgggggtgaggagccagggattagccttaagaaggtggttgaaagtaggtccaggaggaccccagctcagctcttgagccctcccagggccagggactttacaggaaatggacagttcatgagccctactgtgtgca

SEQ ID NO: 162035 - DNA, 220 bp, Homo sapiens
  misc_feature (10)..(10): n is a, c, g, or t
  misc_feature (18)..(18): n is a, c, g, or t
tcggacctgntgctccgngagaatccacctgccgcttctcaccctgcagccgctcaccagctgcagcttttcctggcattgacttcttttccagcctctttcaccatggcttactatagcctttaaccctggcactcctccctcccggcacccctgcccctgctgcccttgctgtttccctagtcccctgaccttcatactcgaattctggtcttagggg

SEQ ID NO: 162036 - DNA, 278 bp, Homo sapiens
tgaataagttcccttaaggactcaactgaaaaggcggcttattaacccagggctcaaacaagtaacggcagcacaaagtgatatacaagactaaacccaagagtggcaaccaccttctagctgaaccacatccctgtatttttttatactttgtgaactaagtcagctttgcactccagctgcctcctgaataagagattgcgcaaggatatggtaggtgggcgttttacccatcaggactggaagcggaagtttccaggtgtgcacttggagggtgg

SEQ ID NO: 162037 - DNA, 234 bp, Homo sapiens
ggccaggtcttcaggccctatctcctgtgccccaagaggccatgaaaaccagttctggaagtggcctgaaagtgaaagccagtgtgttcctcttgctgtctgcattcctgtttgcagttagtttttggcttctgagtaaaaaagtctctgttatatccagcatttttaggtgttttcagcagaagtcccattatggtataaagaccatcacatttgcagacacctctccctctt

SEQ ID NO: 162038 - DNA, 392 bp, Homo sapiens
agccaagaggaaaagtcacagagaacagcgaggggaggtggaagtttcaatacagaaattgtagccatggctgagaaccccagcactggaggccggaatttgtgcgtttgaacgccagaggcttggctagtcatgattagcaaaggaacttcaaagagttttggagcctgctttatatctgtgaaatgggaattatttccatctcaaaggtttgaggggattcgctgagagaaacttcttagcatgggatctccagaaactggaagccacagagaaagcagcggccagagggaggaggaatcggacaggctgatcacttggagtgttcgcctaagcagtttctagaaatggaggcagggaccatcaggaagctcaaaacctttgcttcagcc

SEQ ID NO: 162039 - DNA, 149 bp, Homo sapiens
actgccctgggcccccagcttacaggaagtcaggaagcttgggtgactgggaagaagtgtgggggccaggaagagtgttggtatgtccagagggcagcaagaagaagggagagggtgagtgggtacatcttcaagtagccaacacactg

SEQ ID NO: 162040 - DNA, 539 bp, Homo sapiens
caaaataatggagtcatagaagagttcagtatgaaatggaaaccaaaaaaagtttagcagttttgcacccagaaaaaaagaaaacggagaagggtaagcttgtaacaaacggatgggggtcttttatatgctaaggtatttgcccttcatcctatggttaatcaataggggagctttcagatgtattcaagccagatgacactgtagtttagaaagataaatctagtcctacgcagaagacagagtgggagataaagcacttagtggcagggaagacagttaagaaacttctacagcagtccagaaggagagatggtgaagctacaacctaaaagacagcatggaaatggcaaggatggacagtttctctcccaactccacatttccatctctgcttctcccacaaccaactatggccaggaaatttactggtcacagggttccattacatgtacaccaaggacaacataaaagtcggtggagtcaaagtgcaattaagaggattgaaaggggaggcccagaaaaagagtcccaggcac

SEQ ID NO: 162041 - DNA, 431 bp, Homo sapiens
aaagaaaattaggcaagaagtgaaatttcttaaaaaggcagttgtctaaggcactgttctgacatgcatttccaaaccgccatccagccgtgtggtgaaggtaacacgccaaggcaaagcagtcggcaccaggcctggcttctccacagggaccgccacccgtgcagtcatgcaggctgtgagctgtgaagagagatcctcccagcccaccccatcccggcaaagcaagagagcccaggacgaagcttccccaggtgaagggcctcgggggagagcaggacagtaaagccggcccagcagccttcacgccccctccaacaggctgctcatgccttcaaagcaaacgcgatgaaggaataaaacaccatcgaagagaagcagaagctcagagccattccggtgttgggacctcagggaaactgagaggagaa

SEQ ID NO: 162042 - DNA, 411 bp, Homo sapiens
ctgaggtgggacaggaccgaaagccccagggtgcaggagcgaggggctcctgcgatgggaagatgggagagctgggagcgttctcgcatgcagagctggtgtgttttcttcctctgggaaggaaggaggggagggccatacccaggaggggacaactagaaacttgttgaaaagcagcgtacatagatcacaggtccaaggacgaagcaggtgaacccgtcctgtgattttaagcatgaaaggagaatgtttgcctggcatgggggactgccccagggatggcacagttggtcatcccgacatagaaatcgcctgggtgggtggtgccatagcccggcccctggctctgggggctgacattaccgtaaggtcaggaccacacgaagctgatcctgatgtgtcactcagaga

SEQ ID NO: 162043 - DNA, 354 bp, Homo sapiens
acaaaaataacaaaaaacaaaaaacaaaccatattcacacaatagcagatgccaaagcaacgctgtaaaaccacaaactctctaatgccccagagacggcattaaatgctttacatcctttccttgctacaatttttcttgtttccaacactcttttttcagactgtaccttttggtgctacatattattttcatattacatattgaaattgcatattgatatgtaatatgcaattaatatgtaatatgcaaataatatgtaattgaaattacatattaatttcagacatattataggtcaagtaagctgtagtgtgttgacctggggacctatccccatttgttaaagccttt

SEQ ID NO: 162044 - DNA, 293 bp, Homo sapiens
tgaaattttttctttctttgtggtaacaccaatagtactttcagactggacctgttctgggggaattggcaacaaactgaaatttcccattagttgtgtatggatctattgtaaaactgctgataaggtatcatcatcattattttttttttttgctgagattgttttttatcacattggatcagtgtctggcctttcaaaatggaacctgaaggcagatgtatttataagcatgtatgcatctgtaaatggtgaccaagtagataaaacaccttttcctgctggcggtgtgc

SEQ ID NO: 162045 - DNA, 560 bp, Homo sapiens
catttgtggttgttgctgtgttttactactgacattttggaactattagactgcttagctatttaattgaaagaaaggactttctcttcaaaacgaaggtatcttaattgtatagctgtgatattaaaaactgcttacctccagaaataatccaggtcttctgattagtgcagatttccaaaggccagtattgccatgaggcccattataattggtcctgatttcttcctctcaatcgcaatagtattttttgtgctccaaacttgggctactacatacagcatctgctttccattatgctcagagctgaaatatggcactgatactttcatacttggtgaaatcctatgtacagcctccaccagatgtatttgaaattaccctgtggaggactgaaaagctaataggagctgatagatgctgttggcctttagttaactctgaaatatagctttccacttgtgaacctccaaagtgtttagactcctttcagtggaacactggcacagttacataaatgttagtacatcccatacttttttcagctaatcttggcagta

SEQ ID NO: 162046 - DNA, 429 bp, Homo sapiens
tctccccaacccctctgccccaccgggaaggcactattcagtcactgaccataaccttgtagagcgcagtaggtctttagtgcagccacttggccggctgattgggaactcaacttccgatggtcctaacaaccctttgggttttgcaggatctttgagaagcaaaaccttttacctaggccttacggcttggccttctggtccattagtatcatccaccagttcacccaatttccattaataaccgcatctagaatcacatgaaacttgagatgggttgatctcctgtcttgaggcccagctgggcgggtatgccagccaaggagagggctggggcgccgggggtgactctcgggaggtgaagcacacaagcagcccataaggttgggatcctccgtctccaagtagcgcgactacagctcttgcccg

SEQ ID NO: 162047 - DNA, 498 bp, Homo sapiens
gaacagaaatgttgagaagggtagactgatgactacccctcagtggaaacagaccagatctcagcttatctggctggaaggaaagcaaaaaaacaaagcaaaaccaaccaaaaaatcctaagaaacaaaagacagattcaagccaatctgtgatttgtaaaataagccaggtgcaggcttgtgtgccttcagctgaatgtaagaagtccagctatcatgaagtctccatgtggacagacaattcagaggaatgagagagagagagacctgagcagctagcagtgccagcacctagatgtttgaatcttcccagcccagatacatgatggaaaaaacttcaagatgcccattggacagcaaccacatgaaagacctggagtgagaactcctaagctgagatctcactctttcagactccagagccaaataaataattattaatgtttaagccactgttttggtgtggcaacaataaaggcctggaacagggtaaaaaaa

SEQ ID NO: 162048 - DNA, 379 bp, Homo sapiens
ttttagcaagattatttgatattttatttaagcatccagaaaaggccaggacacaagaataaagagttagagtcctgctacactttgcaaacaaatagaagagggcatagcatgtccctggaatctccaagccccttgcagattctaactgccaactcctcatcccaacactgagtagcaaggctctttggatgtaagtggcccaaactcaaatgaaattggcttaagcaaaaaagggggcctcattaattcacagactcaaactgcagaaagcgtagagtggagctgagcttggagaagctgggatccaggagctccgtcaccaggtggatgctctcccatttcctttctgcatctccctgcctgttgtcttcatttc

SEQ ID NO: 162049 - DNA, 794 bp, Homo sapiens
gaacagaaatgttgagaagggtagactgatgactacccctcagtggaaacagaccagatctcagcttatctggctggaaggaaagcaaaaaaacaaagcaaaaccaaccaaaaaatcctaagaaacaaaagacagattcaagccaatctgtgatttgtaaaataagccaggtgcaggcttgtatactgggccacatggtgacttggatttttaagggttacacacatgaggcaactacaatccagaggaatttgtgactatcctcagaggccacagccattgatgcctctttcactctgcccattatgtcccactgaacagcttgggtgtcagagccagccattttgctctgtgaggaagtaattttgcagttaaattggacctggttgcattttctagtctctgctttctccaaatatcccagtacttagtttttgctctggttgaaaaaaaaaaaaaaaaaaaaaaaaaaaaaaaaaaaaaacctacactaatggattaaacaaccatttggaaaagacaggattttttcttaaacttttttgaggtaattttggaaaggatcattcaaattaacgtatgtgaagcacctaacataacagacccttggtaaatggtagcaaagaagattgtgatcattaggagctcctgagagagggcaggtgccacaggaagggattggaccagatcaacatttcagtgtcttctgaggattataatttctggaagttgctcccagatgggggacaactttcaacctacggtcaaataaatattgcttagaaactctcaat

SEQ ID NO: 162050 - DNA, 938 bp, Homo sapiens
ttttagcaagattatttgatattttatttaagcatccagaaaaggccaggacacaagaataaagagttagagtcctgctacactttgcaaacaaatagaagagggcatagcatgtccctggaatctccaagccccttgcagattctaactgccaactcctcatcccaacactgagtagcaaggctctttggatgtaagtggcccaaactcaaatgaaattggcttaagcaaaaaagggggcctcattaattcacagactcaaactgcagaaagcgtagagtggagctgagcttggagaagctgggatccaggagctccgtcaccagatactgggccacatggtgacttggatttttaagggttacacacatgaggcaactacaatccagaggaatttgtgactatcctcagaggccacagccattgatgcctctttcactctgcccattatgtcccactgaacagcttgggtgtcagagccagccattttgctctgtgaggaagtaattttgcagttaaattggacctggttgcattttctagtctctgctttctccaaatatcccagtacttagtttttgctctggttgaaaaaaaaaaaaaaaaaaaaaaaaaaaaaaaaaaaaaacctacactaatggattaaacaaccatttggaaaagacaggattttttcttaaacttttttgaggtaattttggaaaggatcattcaaattaacgtatgtgaagcacctaacataacagacccttggtaaatggtagcaaagaagattgtgatcattaggagctcctgagagagggcaggtgccacaggaagggattggaccagatcaacatttcagtgtcttctgaggattataatttctggaagttgctcccagatgggggacaactttcaacctacggtcaaataaatattgcttagaaactctcaat

SEQ ID NO: 162051 - DNA, 663 bp, Homo sapiens
ttgtgaaggttaaatgagaagttgcgttaaaatgctgagtgtagtgcccgggatagactgaatgaccaatacatattagggaccatgaggacaatggctctcattacccacggctgtgagaatccatccctcgactgctgcacaaaatgtcgaatccattttcaggggttgacatctctggagatctagccattggctccaatggcagaaccccctccgctcacttgcactccacctgctcctgcctggggcatcaagcagattctgtttgcaagcacactatagccaaagctcaacttgcttccccaaacagcacattgggtgttgcacctgagtggggagaggcacctcccttcatgtctgtccctgggctaaaggcctcgctgctcttaccctcccttcgtgctgcaccaaaccctttaacagccctgagggagttgttcttccacccaaccatgctggcacccttgccgaaagagcttgaatgattctagaaaaatctgttgacgtatttggcaatatcagggcagctcccctgcttcctttcatagtccctgaaacctcctgaggtgaggacacaccacagtctacccaacagtgatgaagttaagataatttctggattaacaagtggtggttcatctggtaggaggacaaaataag

SEQ ID NO: 162052 - DNA, 275 bp, Homo sapiens
agcatacacaatgcattctacaaatgattttcaaaaaaatctgaatttgttaaatatgaaaaaattggcaatcaaatcatcactccagaaaagcagatgttcaaggacaaaatgagaaacaaagggaactactgctgtaatacatacaataatattcagatgatgtttcttttagcatttactttgtactgttcttttagcacacttttttcattctttcttattttgtttaaattatttgcaagtctactctaccagtttgtaatttccttgaa

SEQ ID NO: 162053 - DNA, 543 bp, Homo sapiens
aatagagccagggtttcaccacgttgaccaggctcgtctcgaactcctgacctcaagtgatccatccgcctcagcctcccaaagttctgggattacagacgtgagtcattgggccttgccaaggtttttgggttttttttggaaaaaaaaaaaaaagtagtacacattcttagtgcagatgggcttggccagtaccacatgatggtgaagcagacgtgagacaacagggagaggcagggacagtgtgggctggagaccctgggcccccctactctatcctagtccattattatagccagatcttccactcggtcagatgatgatggaaatctggattttgtgtgaaatctctcagtttattgttgacaagtcaatttgaattttagaaacgtgatgtaggtcaactcttgagttggatggttctccgagctgccagtttacaactccgattctagcaaaagagacagcctctgccattttcagtacagctacaggaagatccttcagtggactagcttgtgacctgcttatctcctttttgtg

SEQ ID NO: 162054 - DNA, 275 bp, Homo sapiens
ccagtaatcaactcaaaataacccttatgccagaggggcatgtcaggggcagcaaattctggcctgctagtcctgtttggggtggcatgttctgagccccatcactctccttgcagacaggcacctagagttatgcttcatcttatcactctgaccaccccgctatgtattgcttattcattccctgagcactccctgctaaggaaaattattgtggcactcattaaaaccggtaaggaagactcttcccaacaggagtcaggaccatcgcaatg

SEQ ID NO: 162055 - DNA, 460 bp, Homo sapiens
ttttccatgcttttccctctagtacgtagaacttaacatccctttgccttgcatgagggctagattagtagactcacttctaatgagcaggttgagaagcgaaaaacagtaatttcagagcgaaggaacttggcacacattaccttaaccaagagacaagattaacatcaccaagattaaaatataccaataagtgtcccctgtttgatatgatgtgatgagacaggcacatcaactctatggtattgtacccataacctcagtctaatcattacaaatatcagacaaaccagtactcttcaaaattgtccaggtcatgaaaaaggggaaagactgagaaactgtcacaggtcagaggagactaaggagaaaactaaatgcaacatgagaacctggattggctattggaacagaaaaaaagacattcgtggaaaaaacagcgaaccggtacgcgctcgac

SEQ ID NO: 162056 - DNA, 480 bp, Homo sapiens
ttttccatgcttttccctctagtacgtagaacttaacatccctttgccttgcatgagggctagattagtagactcacttctaatgagcaggttgagaagcgaaaaacagtaatttcagagcgaaggaacttggcacacattaccttaaccaagagacaagattaacatcaccaagattaaaatataccaataagtgtcccctgtttgatatgatgtgatgagacaggcacatcaactctatggtattgtacccataacctcagtctaatcattacaaatatcagacaaaccagtactcttcaaaattgtccaggtcatgaaaaaggggaaagactgagaaactgtcacaggtcagaggagactaaggagaaaactaaatgcaacatgagaacctggattggctattggaacagaaaaaaagacattcgtggaaaaaaccggagaaatccaaataaaacctatagtttagtattataccaa

SEQ ID NO: 162057 - DNA, 272 bp, Homo sapiens
tgctctagaggctcccctctccctactgtatcctatatttttttccagtattgttttgggtccagaccatttgagagtgacatatagaagtcatttgttacacgcatgagagtgttagaagtgacaagaaagaggcaataaagagggttttctggatggggtcagtttttaattccttattgagattttacagtagctcaaaagaaaagcctgttgcaggccagttatgatggttcacatctgtagtcttagaactttgggagccaagatgg

SEQ ID NO: 162058 - DNA, 360 bp, Homo sapiens
tattttaaaatcaaaaaggtcttccttgtgctgacccttttttgtcaccctgcccccacctctgtttttcacttctataattttgcctttggagaatattctctaaataggatcatacaatatacaaccttttgaggttggcttttttgcactcatcataatgcccttcaggtctactaaaattgttgaatttatcaatagtttgctctttttgttaaattaccgaatagtattccatggtatgcatgtatcacagtttaattgtttgcctatggaagggcattttggttaatttcagtttttggctattacaagttaagctgctatgaacaattgtgttctgatttttgtgtggacata

SEQ ID NO: 162059 - DNA, 389 bp, Homo sapiens
cgtatctcaggggcgctgtacccgggggatgaagctgaccagcagtgagggaagtcgatgagaagatcaggtaggctgacatcgatggagatgggcaggtcaatgtatgaatgagtttgtacagagtgatgactgcaaagctgaaggccccccggggcagctgggcgatgccctgttctctatgatctcatctcttctcgacgcgcgcacgtctcgtcttcaacgactccccggcgatacagcgtgtatcctggggagccatcccagagaatgtccatagaaatgcctgtgagtccctacaccttaatgactcatttgcaaatcacttattatatattttgacaccttttgatgtcttatccctcccacgttcacattttcagttctcc

SEQ ID NO: 162060 - DNA, 201 bp, Homo sapiens
gcatactatattttctacactttatttgttttatgtaactattttaacaacctgaggacttttacaggctgcataatatgtcttaatatggatgtatcttagtttatttaaacagttactggtgatggacatttccatgtttccagtattttttctcacaaacaatgcagtattatgcctttgtccacattcaccattgat

SEQ ID NO: 162061 - DNA, 576 bp, Homo sapiens
ttccctctagttaagtctagttagtacctatcatcttctgaacttgactcacacattctcacatctgaactttcctcacactattcacataacacccccaatctgaaatgtgcttctttcctctctccacttaactgaatttttaaaaaatttgtaatgttctggcttaagcaccacatcttctgtgaaatctttattaaatattctactctgaagaaaattctcatccttccaaactccattgaggcttctcctgtgtacttaattcattctactttgtgttaactatctttttatgtgtaggtctcatcaccccaaccagactataaattcctttgtcattatttaaatccatgcatggaactcccatagacatcaaccaatcaccaatagacaagccttagaacatgtattacaggaaaaatagagtaacacatacaactaatacagaggaacaacaattgacattaaaatagaaaaaaaaattaacactcttggaatctatagaaaaatgtaaagagaaagaaaattgaagataatacgtcaactagaatatttatttgcctgcttcaacat

SEQ ID NO: 162062 - DNA, 529 bp, Homo sapiens
aatttccccttatactttcctttcttggaagatgtgagagacagccgctccctaggaggggcttcattctctgttcagacaaaaccactttggctagagaagccctcatgtgaggaagtccagaccaagccaggcccctccaggagactttaaagatggaatgaccttgtcacttggtgattgcttgggcagcctgctttgaaaaagagaacttctgacagacttcaggtcgtgtgtttatcctgaggctgggccattccaaactcatgtttcagggtttagaggttgcgtccagccagcccgtgggtggtaatcaaatgcaggtggagaccatctggccgggcctgtccctcccacccagccaagtaagggctggcctgcccaccacagaactggcccagaaagcaccctgcgtggaggcagatggtggacacatgcgtgtgcacgcatgcacacctctaggcgcgtgtgcacggaccctccttagtgaagtggtgctgtgtggatgcatctgatccagtgatttctt

SEQ ID NO: 162063 - DNA, 378 bp, Homo sapiens
taactgtctgggccaggtgtgatggctcattcctgtattcccagtgctttgaggaggccaaggcaagcagatcacttgaggccaggatctgttccctccacttggggggtcaggaggggtaagggtggatttagcctttttcctggttggctgaggctcctttgtcagcggtccctcctttggggccaccgccactgccgtctgctcccgacaggctgaggaaggggttggtctgggcagtgaggactggaggtccgcctgctgctgccactgctgcagctgcagctgctgcggccatgagacttgtgttgttgccaagcgagggagccactagggctccagcgggcagcaggggtggagcagacgctgtaggcagca

SEQ ID NO: 162064 - DNA, 355 bp, Homo sapiens
cgagagaacaaagaaggatagctgcccattagcatttcagggcgggctttttaagttttaaagatgactgcattccggctgggctcagtggctcatgcctgtaatcccaacactttgggaggccaaggagggcggatcatagggtcaggagttcgaaatcagcctgcccaacataatgaaagcccgtctctactaaacaaatacaaaaagtagccgggcgtggtggtgtgcatctgtagtcccagcaacttgggaggctgaggcaggagaatcgcttgactccgggaggcagaggctgcagtgagccgagatcacgctattgcactccagcctgggtaacagagcaagactacgt

SEQ ID NO: 162065 - DNA, 381 bp, Homo sapiens
acagttatagaaggtagcttctgatcagtaagaaagtctaccatatatgttactggaatttttaagcctctttctcttagaattctctcagttcctattacatggtagattaaccgaagaaagtcattctgacttcctgttcttggcagtaggaatcacctttctcacttaaaagcagagaacaagcctaatatattctattattctattctctcttctatccaaccaccagtcataatgtgataataattttcagttttagttgttgccctttctacttacttttgtgccataatgatgccttattaataggctatctcatatctttactaataaaaaagaatgtgaataaaatatattaaatcaaagtttgcttgaaaa

SEQ ID NO: 162066 - DNA, 547 bp, Homo sapiens
ctgttttatttgacaaccatcgagaataagttttcttgtttgtagagataaccaccaaataaatattactaaccaaaaacatactctcgggggtcagctgtcttggtgttgaaacagtgctgagaattaactgtgctgacaggtcctatctctcattggcacttttaaagctgacatcctgttacatggatacaaaagatggtaattttaaaggaaattttgggggcagtgatatgaatagtctttaataagagctggcatggtattgcctgttgtcaaagatgacccaagggtaagagtttattagtgcattttctcctaaactgaaagtgacagggcatgcttaaggcttttttgttgctgtttgttacaaatgaaaatttcattgcagaattttcatgctgaagagtattgatctatgttttcccacagccagaagaataaaaaaaagtatggagaaacagaaattactttgctatgactttagcattgcttcctgatcattttgaataacgataatgtattcagcttatggaggccaatctct

SEQ ID NO: 162067 - DNA, 239 bp, Homo sapiens
taatggacttcctttctttcttatttcctttctttctttctttctttttttcttttttttttttttggtttgtttcttgcatcttatgttatctctatggtaagtttagctaaatgaaaaattcccaggattgtaaactgattgattagaaattatttgatttttctttatttcattttatgttactttttaagacccagtcaaggaacatttccatatgatgtgcgtgtatccataga

SEQ ID NO: 162068 - DNA, 356 bp, Homo sapiens
tactctagagcgatcccctttttacgcaggcagataacgtgactgagaaatccacacaggccagcctgggaggcccctgtgttggccccatggccagctacctctctaattctggttctatggcctatgattctttgtcaggtctgctttgtacccctggtagaaccatgtctgagcatgccagccagcagggggatgctctttgtgtgaggagaagctggtctaatcccggatatcctataaagttgagcagtttgcgaggggagacagaggacacgcctttaggactaatgtgtttttccttggcagaagtccaaggtgaacctctgtctttgccaaaggaacaccgcttcagg

SEQ ID NO: 162069 - DNA, 277 bp, Homo sapiens
attgacgttttcttccatacttgaaactataatttctattgaacgaataaaacacagcccaatttagatgtcagtatctctattaaattattacattgttagccacattaagttgtcatttttattttgttttcttgagaaagagtcaataattaacctcaatgattgaagtataatgtttcaaaaacaacatagagccagggtagttaatattatacttgttatattttgagagcatgactttttcatcatatgtatgggaaatagttgtgcttga

SEQ ID NO: 162070 - DNA, 262 bp, Homo sapiens
tccttctccagttcttcactggtcaatcaagccattgttaccccagcaggcagagctctgagaaactgcatcctgggatctaatgatagcaatagctacaatatataattctcagttcattcgtcccggtgtgggaacttaattccctcacttactcctcccaacaactccttgaggtagggattattttctttttaactttttattttgaaataatttttgcctcccagaaaatctgcagaaactgtagggtttcctaata

SEQ ID NO: 162071 - DNA, 239 bp, Homo sapiens
tatcaggttgttgctatatacatggcattgtaactattaacacctctgaaaatgcttctctacaactttttgaaacttgttgagtttcttgaatcttccaccagacaaaacctaattttctgttctagagagaggcagattctttttcgctggggatgttctcatcctaggatatcagaggcaccatggagattggggataggagtttttcattgtgctattgcttttcatagagaaac

SEQ ID NO: 162072 - DNA, 563 bp, Homo sapiens
tgttctcatcctccattcctcccttatcatccagagagaccctaatttctcccctcagcattccgaaccctcctccattctctctgttcttgtcccgggatcatgccatccctaactgtcaccattctgatcccctactgctcctcgtcctctatatggggcctcctattcctccctttcagcattccaaagcctctatttctcctgtcatcagcctgagggcccctcatttctccctctcagagttctgaacccccatttctctctcaacttcagatgccccgatgtctccctttagcgttctgatctccaccattcctctccgtcctcgtcccaggatcccgacactcctacctgtcagagttcagagctgcattccttcccgtcctcagcctaaatccccccatttctcctcgtcagtattccgacgccgccattcctcccccttatcggcctgagggcccttcattcctccccgtcagcgttctgagccacaattccttcccatcctccgcctgagcgctctccacgtccagccccaaggctgtctcaccagtttggca

SEQ ID NO: 162073 - DNA, 440 bp, Homo sapiens
tgttctcatcctccattcctcccttatcatccagagagaccctaatttctcccctcagcattccgaaccctcctccattctctctgttcttcctgagggcccctcatttctccctctcagagttctgaacccccatttctctctcaacttcagatgccccgatgtctccctttagcgttctgatctccaccattcctctccgtcctcgtcccaggatcccgacactcctacctgtcagagttcagagctgcattccttcccgtcctcagcctaaatccccccatttctcctcgtcagtattccgacgccgccattcctcccccttatcggcctgagggcccttcattcctccccgtcagcgttctgagccacaattccttcccatcctccgcctgagcgctctccacgtccagccccaaggctgtctcaccagtttggca

SEQ ID NO: 162074 - DNA, 577 bp, Homo sapiens
agctgtaggatggagtaggatacctcccttcccccatccctcccccaggaggccccaggggtgcccaggtgttgggagagacaaggggagactctgaagcctgggagccctgccattggggattggatctgtctcccttctctgccacatccccctggcttggggttgctggggtgggctaaggaggcaggcgagacctgcgcctcacagtgtagccaggagggatggcgtccaggctgctctcttgaagctgctggtaaatgaataaccctgcccctgcctccatggctccccggctctcctggccagggactgctgggggtggaggcagatgcaaccccttggtcctctgcccatgcctgcaaatcccatcccagacagacccagagaaacctcctctcggttccctccatctcctttccctaagccccttcattgtctaaggcgacctccttctcccatcctttcctctcactaagcccggccccttcactgagccccctccaatctctaagcccccttccctcttggagcccttccccttgctgagccccaccccttttccagtcccatcctt

SEQ ID NO: 162075 - DNA, 328 bp, Homo sapiens
tgaatgaaaataaagcagtgtgaggaagaaggaaggtaattctttcttataggttgattatagaaggcctttctgatggagtaatgcttgacccagagatctgaatcaaatgagagagtgaactatgcaggtatttggaaagaatactgtcagcaaaaagaagagccaccacaaaggccctcaagcaggatcatgcttcccctgtcaaagaacagcaggggaccagtatgaccagagcagagtgagagggtgagtgggcgaagatagggaagtaggcactggggggcccaaatcacataggccttccaagccatggactctgtggttt

SEQ ID NO: 162076 - DNA, 366 bp, Homo sapiens
tgtgaggcacggggagggaggaagtgatgataggggggactggaaggcccaacgctatggctgggagttggacaggagacaggtgagagtgttgtatagagcagaaagcacaaagaggtgtgtcaaagttaggcaggcaggacaatcagacgtgtcacatgaaagccaagaggacacagcaacagagacagataaaagttagaacacctgggttcaaggctcagcccccacagctcgtttcccatatggactcaagcaagtccttttgtgtgtaataaacctcaatttccttgaaaagaaatacaaaaggatatcggtatctttgcttcttatcatgaagatggtctcaaaatcagaagaaataat

SEQ ID NO: 162077 - DNA, 429 bp, Homo sapiens
tgaacgaatcgagctcggacccctccataatgtgtgcccaactgcaaagaaaacagttcatgctggtgactgagcccagcagggcttgccttctcgatctcaaaggttttgcttttgtggctgtggaggctccaatgcaggtcctctgctgacgacgccatttctcttcctctccctggactcagggcggccagctggagcccttccgcctgcgagtcggggaagtggcgctgtgaacctgctgacaatggggctctaatgagtagagctcatgctgaatgcagccttgctcctgctctgggcagcctcagcccaggagtgctggggaggctggagaagggaagacgggaggggagacaaatgcacagaaggccagtcctgtggcccactgtgtccttgtctgcctttctatgacctcaaaatggaact

SEQ ID NO: 162078 - DNA, 198 bp, Homo sapiens
atgcttaaaatcaagacacacacaaatacagcaaaacacatttaacttatcattatccccttcacatgattctttttctatattccatttttctttgatgatgatattgccatctttatggtcatctcaatgggacatagaaaaagcattataatatagctctctcaatgctacctccaatttaatcagcccatacat

SEQ ID NO: 162079 - DNA, 449 bp, Homo sapiens
ccagccatgcagaactgtgagtcaattaaacctcttttctttataaattacccagtctcaggtatttctttatagcagtgtgaaaatgggactatgatcacgttttctcaaaaactctctggaaggtgccactgcagcacaaggaaacaagattctgcagctcattaaacatccagacaaactacatatcaatttacacttctggcagacaaatccaaatcctgggctggaaaaaaaaggtccatttggggagaaacagggaaatgtcacaaaactaactccccactagattaacagctccatcggaatgacacttttaatctctcttctaatttctcctatatgcgggaaacaggtgttgagggtgaaccaagtctattctcttttactaagccccacatccctctttagaaagcagggttacttattaccctttggtttcagctttg

SEQ ID NO: 162080 - DNA, 811 bp, Homo sapiens
tgatttttgtagttttagtgcagatggggtttcaccatgttggccaggctagtcttgaactctgacctcaagtgatccacccgcctcagcctcccaaagtgctgggattaccggcgtgagccaccgcgcctggcgacttgtgctaacgttaaaccaaaattatggggggtcattgtttgtggactgagtttctgcactaggtcctagcagaccaaagtagttacatatattaagtgccacacagttacatggaaactttacagaccagtttttcctgaaaacagaaaatcccagtctgtctgaatcagaataataaggaagtcccttcttctttaacccttaaaaaaaaagtaacccgatgttaaccaatcagttatttttcattgttttgtttccttgctctcatcttacaaaacccactattctgctgtttctcattgggagctttcattctgttttgtagaatggaggctgccccattcataagttatgaataaacgccagttagatctgtaagtaaatttgttgtaatttttttctgacactaggaattgccaaatgacccttcacacgggaagtactagtttttgtttttaccagtcccagtcccctatgcctttttaaaaaagagatgaagtctcactgttacccaggtaattgcattggctatttacagccacgatcataggaaacgcagcttcaaactactggctcaggggatcttcctgcctcagcctctcgagtatcctgtatcttgctaacagagcatgttgacaaacttggatttgtgcccatcaaataagtttgaact

SEQ ID NO: 162081 - DNA, 422 bp, Homo sapiens
ccagagggtctttgtgagagcagcagagtggctgagggctccgagcagaggactgctgcaggaaggaatctgcaagccagaatttccacgtggtagaaaaagaccagctcagaccagagcaggaggggacagctggaggagagccctgtgctactggttaccaagctgcacttcaagggcaagggccccagagcaggacaggcccaggccctaaggctgagctgagatgcagctgtagtgtgacctcagagaaaagacttgacctctccaatcctgtttccaccttctacaaaaggctgtgatagtccttgaaggagtttgaccacctcagggatgtggcgtgcgtccagtcatgttgggctgggcaggttgatggtcatgttacatctgcaaattctcagagcaggagccatttcctcaag

SEQ ID NO: 162082 - DNA, 314 bp, Homo sapiens
ctgatcctgggatggagacaacaaattcttaaggaatgtgggccttgagatcctgcacgtacctggtcaacaaataaggtcacctactgtgaaaatcaacttctcagagcagcagcactcacccaacctcctaatgaaagaggaatcatatggattaccttcaaagaccccactgctcaactggaacacagccagaatcttacagaaagaaagaacaagctattgataaggaatgcctaagacagcatcggggttagaagctaacacctactcttgtgacctgatgatcagaaagagatgtttatgggctgagg

SEQ ID NO: 162083 - DNA, 244 bp, Homo sapiens
acttgtaatcccagctacttgggagtctgaggcaggagaattgcttgaacccaggagacggaggctgcagcgagctgagatcatgacattgcactccaggctgggcgacacagcgagaaaaatactcagttttttgtttgtttgttttttgaagagaatttgaataggcatcccaaaagagaatattcaaaaggccaaacatttagaaagaaactcaaccttattttgtcttcagagaagtact

SEQ ID NO: 162084 - DNA, 311 bp, Homo sapiens
tatcctcaggtgactcatcaacgactcggaagatagacatcactaggctgatgacacccaattcaactttcgcatgtagctctcttgagtttatcacctcgacttcacaggaagggctggtcacgtgaggggagactttgggtaggaggaagagagtgggcagaagaaggaaaaatcagatctgcctgctgccagccttcaccgttcagaagaaacacttaactcttttcagcaaccgcaacaaataattatgttgggctctggccatctggccctgtttgacctgaatcggaagacaggtcttattttag

SEQ ID NO: 162085 - DNA, 151 bp, Homo sapiens
aaacagagataacaatactgatcatcttcactttgcacagtagcacaggactgtaaaaatgaccatacaagctgaaacagtgcaacctgatcttaatcagagattaatcacagagaattatgattctcccgtaacctttaaaaatttttgg

SEQ ID NO: 162086 - DNA, 550 bp, Homo sapiens
cttgcaggagttgggacttcattctaactgcaatgagaattcaatagagaattctccagcaagggagtgacacaatagggacatctcttcaatggctgagtaccagagtagaggcagcagagctatgccaacaggctatcacagtaatccagacgagaggtgatgaaggctcagcctgggacacagtgagactccagaagtggtggattcaggacataatttggtgatagaccccataaactttttttaaaggttttggatagatagcttttatcatttatttattattgaagatatgtacgacacaataaataagcttgcttcagacgtatatatagaactctgtatccaataatgagtgaatccacattcttcacaaggacacacgaaacatttctgtgaaatgcctgtggactagtccacaaagcaagtctctgtaaatttcaaaaatgtatacccttgaaaatctctgaagtcctggagatttaagtctgcaactatcttagtcttactaccaagaatagcccctaaggaaaaaaaaaaacccttt

SEQ ID NO: 162087 - DNA, 892 bp, Homo sapiens
cagggtctgcagctcctcatacttgatctggtgcatgctgtcagccttggcctggctgcggttggcgatcttctcatactgggcctcgacctcagcaatgatgccgtccgtgtccagggagcagctgttatgcgtggacagccccacagatgtgtccaagatctgggactggagctcccagatctcctcttcatacagctgcctgaggaagctgatcttgtaagcttgccatccaggtaagactccatccagctccaccctattcatgtatgcctcatccacatccttcttgatgaggacaattttattctccatctctgtatgcttactgatctcatcctcgtacttgttcttgaagtcctccaccagcccctgcatgttgccaagatctgcctccagtttcagcttctcctggcctagagtgtccagctgccacggaggtttgttgatgtagctcttggacatgttgtccatgctgctccaagctgtcttctgctgccgcaggaggctctacttggtctccagcatcttgttctgctgcttcaggaaccgcgatgaagggggcaaacttgttgagggtcttaatctgctccttctcctgagtgcacacggcctggatgttggggtccacctccagcttaagggggctcagcaggctctggttgaccatgatggctgtgatgcctcctataaccaccagctcggccatagcctccacccagacccatgctggcacccaggacaccctggacactgctgctgctgcccacttgggagaagctcgaggaactgacgcaggcaccaggcctactcatgttggagtggctgctgaaggtccggggccagaggtggacaccctgtagaacttctgggtcaccctgatggacatggt

SEQ ID NO: 162088 - DNA, 623 bp, Homo sapiens
tgcactccagcctgggcaacagagcgagactccatctcaaaaacaaacaaacaaacaaaaaaaatgtaacgtgcaaacagatttcatctattccaatgcttgtacatagacattattagcatttcatcaggatatttccgttatttaagattgtcatggaattgcagcatcaccagccttgggctccaattccagcaacataccacacaaatacataagaatattagagagcactggtcagcaagtcgggttatttatccaacacctactacataatggggcacagttctaaatgttagggaaaaaggaaaaatatatacatattctaatgggaaaagacatgtaaataatttacaaagtcaaaaaataattacaagctcatccaagcaaaatctattttatcattcttagaatactgtcatgggggcaactgggtggtaaggtgctcaatgtcaccctacctgaaaagaaagcatcagtcataaatgggctgctttcaacccctacgaaagcagaacagcagaaggcagccttaaaatgataatggccatggcttgactgggcaccgtggctcacgcctgtaatcccagtactttgggaggctgtggcgggcaaatcattgg

SEQ ID NO: 162089 - DNA, 471 bp, Homo sapiens
gtagtagtgtgttggtataacatgacctgagcttgctgaccagtgctctccactattctccatgtatatgtgtggtatgtagctggaattgtaacccagcgctggtcatgctgtcagtgtccatgatcactctcaccttaccgataatggggcactgatctgcatgttaatgtgcaaatatgcaagctttgtacttattcaaatgggaaagcacgtgtcaattatttacagaggctagataatgatttacgagctcatcccaactacgacgagttacctgatccctgagtatgatctgtcatggctgtagcttgtttctgaagtgaaacaatgtcaccctacctgaacagaaaagcatcagtcataaatgggctgctttcaacccctacgaaagcagaacagcagaaggcagccttaaaatgataatggccatggcttgacgggcactgtggctcacgtctgtaatcccag

SEQ ID NO: 162090 - DNA, 593 bp, Homo sapiens
cactgtggctcacgtctgtaatcccagcactttgggaggctgagacaggcggatcacgaggtcaggagatagagaccatcctggctaacacggtgaaaccccgtctctactaaaaatacaaaaaaattagccgggtgtggtggcaggcgcctgtagtcccagctactcggaggctgagtcaggagaatggcgtgaacccaggaggtggagcttgcaatgagccgagatcgtgccactgcactccagcctgggcaacagagcgagactccatctcaaaaacaaacaaacaaacaaaaaaaatgtaacgtgcaaacagatttcatctattccaatgcttgtacatagacattattagcatttcatcaggatatttccgttatttaagattgtcatggaattgcagcatcaccagccttgggctccaattccagcaacataccacacaaatacataaacacacctgcctgcccttcttcatggtctttaaatcaacatgtctatttccaaacaacccctaggtaggtaagggaagaaagcatcatcacctactaatttaccttaatcacagggcagtaagtagcacagaattgtaa

SEQ ID NO: 162091 - DNA, 324 bp, Homo sapiens
gaggacatttgccgatgtctggagacattactgcgtttgtcacaactgagggagaaagcactactggcatttagtgagtagaggctagggatgctgctggacaacctgcagtgccccagacagccgccacagtgaagaattatctagccccaaatgtcaggaatgcagaggccaagaaactcttctagatctcactcccagttcacaagaaacatgaaggacacagggacgtgataaacgacatcaccagaaagtcctcagtgtagtccatgctgtgagagattctgcaagacagatgggcctgatatcttcaacagatacatg

SEQ ID NO: 162092 - DNA, 554 bp, Homo sapiens
tgacaccatcgagaaatatacagtcatttgtcagaccagtgattttacactgtcacatgctataactgccaagaaacacatacacacacaggaagtacttcatagtgaggtatgtaaaaatatcagaaggggtataattgagtgactatggctaatcacacacattttccagcatgcagcatggcatttgaatttttctagtatatcagcgttatgttaaatatatcaagagtaaaggaagtagtagaatattagaggagaaacaaagggagtgaaaaaaatggaaaaaaaaaagagatagatttgaaaatgtatgccgggcatgtatatgtgtgtctatggtttttaaaagtttctactataaacagcacttgtgagcagggcagtgtctggtgccaactgccctgggtatatatttgcccttgtttttcattgacaagatgcagacctatgtagatgctatcaatgctactagtaatagaagattaatatgcaatccaaatgatatattttgtttatactattaaaaatatttgatttttagactgaaaatg

SEQ ID NO: 162093 - DNA, 385 bp, Homo sapiens
aacacagccagactcattcctaaacatggactagtttatgaattcatgctttacctatggctgctttctaaattgagtacttgggacagagactctgtgacccaaactatttatgatcttgccatttacagaaaaagtgcagtgacctcattagagaacaatgcagtcagttaatatctattaatatataaaatttgaaaacacataaaaaataccaagaaaagccgcacatctgtgattctaatgtgcaatgaggtgccgtgaggcattgcagcaaactcagaggcaccgtggggtattttaaatttttgacggaaacgcggtaatacaggacatccgttggacactgcaaatactactcatgtgaggtttttcactgcttcaa

SEQ ID NO: 162094 - DNA, 457 bp, Homo sapiens
tatactgggtcaaataaaatgtattactaaaattaattcatctgttccttttcattttttcaaaatggctattagaaaatttaaaattacatatgtggttcacactgtatttccactggccagtgctgcacttgaggttacttgcaggaaaggctgaaatatcacaatctacaaatagctaatctccattttatttctttgcactatctttctaagtacagctcatatttcatctccaagaagggttcttcaactattcctgttaacctgtatctctctttggtagaactcgtattgcctttaaaatatacacttcagtgcctaattacataagtatattttatttttccctaatttttcaagttttgggtttcatcaactagacagtaaaaatcatgaaggcaaacagacatccactagccttttgtttgaataatgataagtggtatagtgctaa

SEQ ID NO: 162095 - DNA, 324 bp, Homo sapiens
agattttttctcttcagttttctcctttcagtggagagtaaattcagttgcaaatgtattatataaaccaccctttacagttcctgtagcagccttttaaactcaaaatagcttccctttcactcgcaaactcattgacaagtgactgccccatcttacttagactaggctcaactgtttcttccttgcattattccaaagtgctgttatttctccctaacaggtccccccagtacatgccccacctccaatccatgaaaaatgctcatgttgtttggtttcattttggctttgtctttatagcacatagttcagggggatcct

SEQ ID NO: 162096 - DNA, 215 bp, Homo sapiens
tggtgctgggcgagtctgctgggcctattcacttggcagttagcctacaagtaccaaggtgtcctaataacacatcatagattgcagaccctaacagctatatatccaacagccatttttcttactgtcagaggcctgatttgatttgggtgttcactgtcccatgggttcaggaaatgtggcacttccctagatccagaggataaatgtgaata

SEQ ID NO: 162097 - DNA, 409 bp, Homo sapiens
atgtgtgtagatgcatgtggggcttaggggtagattaagagagatgaaggtgtaggctaaaacatagccaagccatgtcttggagatgtactggtgctgtgaagagaacactaaactgacaaacaggcgacatggccttcagcatgtcacctaggctctttgtacctcaaatttttccgctttaaaattaaagagttgtacaaattaacctctaagttcctcctacctataaagttctatgaccttaagaaaacaaaagggcttttcagttgcccacagagtctgaaaaatcaacatgctttattttgcaaaggttatcgataacacgtagtcttacagcatctaaagaagctactttttaagatacaaaaaatctgtcataacagggaagctgtccacaggaggtcta

SEQ ID NO: 162098 - DNA, 520 bp, Homo sapiens
catagaaaaggagaggaggcaaacgcagcccaaactggggggtttctcttcaaagccagctggtctggctttattctacaggaatttttttacctgtcagggtttggacaacaaagccctcagcaggtgctgacgggtacaacttcctggagaagcagaaaggcactgagaaaacatcttgctctgttgctcaggctggagcgcaatggtgccatcgtagcttactgtaaccttgaacgtctgtgctcaagcaatcttcctgcctcagcctcctgagtagctgggactacagagacagggtcttgttctattgtccaagctggtcttgaattcctgacctcaagcaatcctcctgcctctgcctcccaaagcactgggattattacaggtatgagccaccgcactgggccgtcatgcttactcttcggagagagaagtgaagtatctgaacgcctcagcctgagaatgggtcatttgcaaagtaaataaaggcaatgccaaacgtcagtacaacaagcaa

SEQ ID NO: 162099 - DNA, 743 bp, Homo sapiens
catagaaaaggagaggaggcaaacgcagcccaaactggggggtttctcttcaaagccagctggtctggctttattctacaggaatttttttacctgtcagggtttggacaacaaagccctcagcaggtgctgacgggtacaacttcctggagaagcagaaaggcactgagaaaacatcttgctctgttgctcaggctggagcgcaatggtgccatcgtagcttactgtaaccttgaacgtctgtgctcaagcaatcttcctgcctcagcctcctgagtagctgggactacaggtatgcatcacaatgcccagcgaattaaaaacaacctttttttttttttttttaaaagatggggtctcactctgtcacctaaattggagagcagtggcactgtcatagctcactgtggccttgaagttctgggctgaagcaatccttctgcctcagcttcctgagtggctgggactacaggcatgaaccactacattcggctaattttaatttttttttgtagagacagggtcttgttctattgtccaagctggtcttgaattcctgacctcaagcaatcctcctgcctctgcctcccaaagcactgggattattacaggtatgagccaccgcactgggccgtcatgcttactcttcggagagagaagtgaagtatctgaacgcctcagcctgagaatgggtcatttgcaaagtaaataaaggcaatgccaaacgtcagtacaacaagcaa

SEQ ID NO: 162100 - DNA, 1102 bp, Homo sapiens
atcccttttcccttgctgtccatatctacagagttattttccttaaaggaactttcagaatatgttacaagtctgtgtccatgaaaatactgggcagccaggtattgatgaccacacatttcttttagtcatattttcttttgagctcataaactatttcggagttatgggaagaaagctttaaagctttcagcttctcattctcaaagaaaatgaaatcaaagaacaaaaatgaaatttaccaaaggtcaccaaggtggtgacctttatgtagatacagacttgggtctgtttcccaacttaatatccagggattttttttctaattagactttaagcatgttgactagtaaactataagtaacaatgatcacgtggaagttgtttaatgagttgtttccagggaaggcactagtggctcattttttcagtctacccgaggtccctgtacttgaatgtttgagaagcactttgtttcttttaaagatttattttacttggattttaatttttatctttatttttagagaaaacatcttgctctgttgctcaggctggagcgcaatggtgccatcgtagcttactgtaaccttgaacgtctgtgctcaagcaatcttcctgcctcagcctcctgagtagctgggactacaggtatgcatcacaatgcccagcgaattaaaaacaacctttttttttttttttttaaaagatggggtctcactctgtcacctaaattggagagcagtggcactgtcatagctcactgtggccttgaagttctgggctgaagcaatccttctgcctcagcttcctgagtggctgggactacaggcatgaaccactacattcggctaattttaatttttttttgtagagacagggtcttgttctattgtccaagctggtcttgaattcctgacctcaagcaatcctcctgcctctgcctcccaaagcactgggattattacaggtatgagccaccgcactgggccgtcatgcttactcttcggagagagaagtgaagtatctgaacgcctcagcctgagaatgggtcatttgcaaagtaaataaaggcaatgccaaacgtcagtacaacaagcaa

SEQ ID NO: 162101 - DNA, 266 bp, Homo sapiens
agaaatagacaaaaagaaagaaaaagaagaaaaggaaaggaagaaagaaagggaaagaggtaattgaactcaggaaagaaatatgaagaaaaaggcaaaattatctcagcaatgaagaatgaattataaaagtgttcaaggaagagtagactcaatgacataaagaaaaatgaaaagggtgagagaaataattagaaaaagataagaaaaaagaataatattcatattattggattacgtgaggaagaaaaatacaaaacaaacaa

SEQ ID NO: 162102 - DNA, 158 bp, Homo sapiens
atacacagctgtcacttggcccaacccagaatcaggaggagattctgatactgaagacttgatattggtcttaaatatccaaatgcaaactaaaaagactgaactcagcaatgtgaacactgaacaagtcttgaaataactgggcatagataccaaaa

SEQ ID NO: 162103 - DNA, 181 bp, Homo sapiens
tatggtgccttctggcaatctacttgaagatatgatcttcattttggttgaaatctaataccccatgtgaagaacaaggacagtacaactcaaaattctggaccactgcatatggtatcttttctataacccatattttaaatacgtgtattaatttataacacaaacatatggatgtttc

SEQ ID NO: 162104 - DNA, 232 bp, Homo sapiens
caggaagatacagtttgcctaatcagactggaaagttctacgagacaatttcttcaacacataaatagcctgggaaaaattttttaaaaatagaaactgttaaaagattaaaagaggcataacagtcaaattttgtgtgtgaaccttatttggattctgattcaaatcatctttaaaaagcatttttgggcaagtgggaagagttgagctgcattggatattacatattaag

SEQ ID NO: 162105 - DNA, 368 bp, Homo sapiens
ggagggagggttgtgtacagaagagaccaagcagtgttttatcaaaaactggcccagggatgggcatggtggctcatgcctgtaatcccagcactttgggaggcaaaggcaggaagatggtttgaggactggagttcaagaccagcctgggcaacacagggagatcttgtcttataaaaaaaaacaaaaaaacactagctgggtgtggtggcacaggcctgtggtcccagctacttgggaggtgggaggatggcttgaacctgggagatcgaggttgcagtgcaccaagatcgtgccactggtactccagcctgggcgacaagagcgaaactctgtttcggggaaaaaaaaatgtgggtacactgttg

SEQ ID NO: 162106 - DNA, 407 bp, Homo sapiens
atgccacctgccctgctaattcaaaccaaaaaacaaagctgtggtatggaggaaatgaagtccctttttaagtatacattagataagagaactgacaagtaaatacggggtatataaggtacagactccttcttggtaaggcagagaagtcacaaacattgaatggagaactcaggaagacttctttgaggatttcaggtagttctgaatgaaatacagcatggaactggaagaagacatggaagcaagaagaacgctgaagttgggttgagaacaagctggctgcctcagctagaaaaaaagataatggcagaagtgacttggacaagggaataactggcaggctgcccaagggagcacatgaaagaaatcagatctgctgcaacaagctaccacaggcaatgggg

SEQ ID NO: 162107 - DNA, 355 bp, Homo sapiens
agatgtagctctttcctcctgaccctgagaggaagaaagctgagctggaagtggaaggagacaggacaaggttggaggaggcattggaatctgattttactagctgaagggtagccctgtcacagagctgactgatagagcttattccagggcatccttaccattcatcattgtctcactggctcctttccaaaaacttcctccattaagagggtcagagcctcggcctccttgccttctagtgacaatttcctttattttaggggattttaaattagggtgcttaaggacttgaagaacatgaatgggaagagaatataactctaattaagtcacatgtgtcattttcctttgg

SEQ ID NO: 162108 - DNA, 454 bp, Homo sapiens
cagctgccatatgactgactggaaccttacaaaaaatacaaagaactctgactatttgagtaatccagaaagaggttgagactaaaacaaaaatgtgatttatttggtggtaagatgattagagtgtgggttgggatgggcaatgttgagactctttatgaggaatataaaattggatgcagtgctgcagttcaggggcatatcaagaagagtaaatgagatggttcacagatgtcaaaagtctgcttgccagtggcaagcaggttttttattttttattattttttttaatttacaaaatggtaaaggattcaaattttaggaaatgaaataatgtagaacattattcatacagaggatgattcatcgttctgagggccagattaagtaatgccagtatgacattgacattctgcaaggggaaagggaatagtaaagaataaagaagagggaa

SEQ ID NO: 162109 - DNA, 919 bp, Homo sapiens
taaagaaagaagagtgagggcaaaaggcgaagaatgccagctgagctaacacttcctccctcgcccacctttaagcttttccaaaaaccagagccctcacccaacagcttcaggttatgatttttgttgttgctgggatttagtactgtggccgcccctttttagaaaggaagtgagtaaatgtagttctgttacttgggaacattgctcccactagcaaaaatcaagatactgttagaaggaagaaagggagaatgaatgttggaaaggtaaaaagcagtatcttctccaggtggtcaagaggcatttagctagtaaacaggcttccaatggaactggccctagctaatccctagtgcagtggttcttatgtgtcctcccctgctccagaacagctgcatcacctgagaacttaggggaaatgaaattctcggggtccactgtaggccagctgcttagcaactcggggatttgacccaggaatctgtgctttaacaagccctccaggtgcttctgatgcccatgaaatttgagaactaccgtcctagtgcagcggttcccaatcaatggcatgcattaaaatcacctatagagttttttttaactatgtaagcctagagccctattatagaagattctggttaaggaggtctggtatgagctccttatatctatagagtagagccccgttattcatggtttcactttccacagcttcagttacccatggtcaaccatggcccaaaaatataaaatggaaaattccagaaataaacaatttataagttttaaattgtatggtaccttaaagagcagggttgcaaaaattaaaaaataaaaagttttaaattgtatgccgttctgagtagtatgaggaaatattacagtatattgttataattatgctattttattgtta

SEQ ID NO: 162110 - DNA, 365 bp, Homo sapiens
ttcccgggttcacatcattctcctgcctcagcctcccgagtagctgggactacaggctcccgccaccacgcccagctaattttttgtgtttttagtagagacagggtttcaccatgttagccaggatggtcttgagctcctgacctcatgttccgcccgcctgggcctcccaaagtgctgggattacaggcgtgagtctggctgattcttgagccatacatgtgttggacaaaatcaaagcagcacagttaatggtaacagagctggactgagatttgatctgttgcctcctgcacacaagacagggtttgcagtttaacaaaactaattgcttgttaaaataaacattaacactgttcaaagga

SEQ ID NO: 162111 - DNA, 545 bp, Homo sapiens
caagaggaaaagagttccggagattggccgtacaaaaaagtggatgtacttaacactcctgaatggtacacttagaaatgattaagatggcaaattttgttatgtgtattttataataatttttacaggttattttggggaacagtcagttcttaggtgccttgtcacaggctgcaatgagaagtgcacagctctgtcggtgacgtaagttttttgggcacaaacatgaaactgaatgtcatggagccttttgatctaacgtccagtttccaggaaagtcggggttagaggaacacgtgccatgacatcatgagaaagccaccagagtcaggagcaggacagtctgcagtacacacagttgctgattttgtcaacagacactgacatgaaacagaaagctgtggtgaggggatgggggcagtgatgccgcaggttagaagagtcagaagaccatcgccatcccgtgcaaatgcagaccagatgtgacagatcctggatcccaaaagccagctgtcttatctgggggacaatggggacattttaga

SEQ ID NO: 162112 - DNA, 401 bp, Homo sapiens
aatctaggtcctggttacatgagtgtgtttaatttgtgaaaatgtatatagctgtacagttatgtttacttttctgtatatatgttatacttaaataacaagttaaagaaaaataatagcaacttaaagcaaaatataactatagggagttctagcttctcatggaagatttatggtagtccacatttttagttttcagtcaaatgtaacacattttgaacactcattataggcaataattggaaagaatttaggtaattcatttcatctgctcctcaaatgaaaataatcagcttgggtgagcactcatgactataaaggtagttatacacatgtgaaaatgcagaaaagtagaaagttaaaatcaccctgaagttcgaccacttagagataaccaccac

SEQ ID NO: 162113 - DNA, 1484 bp, Homo sapiens
cctggagctttctgcacaccccccgaccgctcccgcccaagcttcctaaaaaagaaaggtgcaaagtttggtccaggatagaaaaatgactgatcaaaggcaggcgatacttcctgttgccgggacgctatatataacgtgatgagcgcacgggctgcggagacgcaccggagcgctcgcccagccgccgcctccaagcccctgaggtttccggggaccacaatgaacaacttgctgtgctgcgcgctcgtgtttctggacatctccattaagtggaccacccaggaaacgtttcctccaaagtaccttcattatgacgaagaaacctctcatcagctgttgtgtgacaaatgtcctcctggtacctacctaaaacaacactgtacagcaaagtggaagaccgtgtgcgccccttgccctgaccactactacacagacagctggcacaccagtgacgagtgtctatactgcagccccgtgtgcaaggagctgcagtacgtcaagcaggagtgcaatcgcacccacaaccgcgtgtgcgaatgcaaggaagggcgctaccttgagatagagttctgcttgaaacataggagctgccctcctggatttggagtggtgcaagctggaaccccagagcgaaatacagtttgcaaaagatgtccagatgggttcttctcaaatgagacgtcatctaaagcaccctgtagaaaacacacaaattgcagtgtctttggtctcctgctaactcagaaaggaaatgcaacacacgacaacatatgttccggaaacagtgaatcaactcaaaaatgtggaatagatgttaccctgtgtgaggaggcattcttcaggtttgctgttcctacaaagtttacgcctaactggcttagtgtcttggtagacaatttgcctggcaccaaagtaaacgcagagagtgtagagaggataaaacggcaacacagctcacaagaacagactttccagctgctgaagttatggaaacatcaaaacaaagaccaagatatagtcaagaagatcatccaagatattgacctctgtgaaaacagcgtgcagcggcacattggacatgctaacctcaccttcgagcagcttcgtagcttgatggaaagcttaccgggaaagaaagtgggagcagaagacattgaaaaaacaataaaggcatgcaaacccagtgaccagatcctgaagctgctcagtttgtggcgaataaaaaatggcgaccaagacaccttgaagggcctaatgcacgcactaaagcactcaaagacgtaccactttcccaaaactgtcactcagagtctaaagaagaccatcaggttccttcacagcttcacaatgtacaaattgtatcagaagttatttttagaaatgataggtaaccaggtccaatcagtaaaaataagctgcttataactggaaatggccattgagctgtttcctcacaattggcgagatcccatggatgataa

SEQ ID NO: 162114 - DNA, 1430 bp, Homo sapiens
cctggagctttctgcacaccccccgaccgctcccgcccaagcttcctaaaaaagaaaggtgcaaagtttggtccaggatagaaaaatgactgatcaaaggcaggcgatacttcctgttgccgggacgctatatataacgtgatgagcgcacgggctgcggagacgcaccggagcgctcgcccagccgccgcctccaagcccctgaggtttccggggaccacaatgaacaacttgctgtgctgcgcgctcgtgtttctggacatctccattaagtggaccacccaggaaacgtttcctccaaagtaccttcattatgacgaagaaacctctcatcagctgttgtgtgacaaatgtcctcctggtacctaccactactacacagacagctggcacaccagtgacgagtgtctatactgcagccccgtgtgcaaggagctgcagtacgtcaagcaggagtgcaatcgcacccacaaccgcgtgtgcgaatgcaaggaagggcgctaccttgagatagagttctgcttgaaacataggagctgccctcctggatttggagtggtgcaagctggaaccccagagcgaaatacagtttgcaaaagatgtccagatgggttcttctcaaatgagacgtcatctaaagcaccctgtagaaaacacacaaattgcagtgtctttggtctcctgctaactcagaaaggaaatgcaacacacgacaacatatgttccggaaacagtgaatcaactcaaaaatgtggaatagatgttaccctgtgtgaggaggcattcttcaggtttgctgttcctacaaagtttacgcctaactggcttagtgtcttggtagacaatttgcctggcaccaaagtaaacgcagagagtgtagagaggataaaacggcaacacagctcacaagaacagactttccagctgctgaagttatggaaacatcaaaacaaagaccaagatatagtcaagaagatcatccaagatattgacctctgtgaaaacagcgtgcagcggcacattggacatgctaacctcaccttcgagcagcttcgtagcttgatggaaagcttaccgggaaagaaagtgggagcagaagacattgaaaaaacaataaaggcatgcaaacccagtgaccagatcctgaagctgctcagtttgtggcgaataaaaaatggcgaccaagacaccttgaagggcctaatgcacgcactaaagcactcaaagacgtaccactttcccaaaactgtcactcagagtctaaagaagaccatcaggttccttcacagcttcacaatgtacaaattgtatcagaagttatttttagaaatgataggtaaccaggtccaatcagtaaaaataagctgcttataactggaaatggccattgagctgtttcctcacaattggcgagatcccatggatgataa

SEQ ID NO: 162115 - DNA, 388 bp, Homo sapiens
ccatggcttctctgcctatcccttatgtacttttctctttcatatttctgtctcttcatttctgtatgatacatactaagttacttctttagaaatcctaaatatttctctttttagctatggcttgcctatgtttaacctgtttgatgtgtttctgcttcaataatgatattttttcattggacaagttctgtttttcttcttctccaaacttacctgttctcttttcatactattctgttcttatcttatggtttccattcctttatctctgtgaacatgaggtctggaggcagggaacctaaggctgattcgcactgacttcctagaactaaatcaaaaggaaaaccccagccgggcacagtggctcacacctgtaatcccggca

SEQ ID NO: 162116 - DNA, 522 bp, Homo sapiens
catgcaggagctgaggcaagcggcggttcccagctctcagtgcaaaagacatttgtcatctgagaggctggactcagttattataattttcaattttgtcaataaaaaccgaatggaaatttgttttcttacttgtagaaacctcctcacaagacctcccatcttacattccagggagaattagcagggtattccgccaagacataggttagactgcggttctgacctgcaggcctcgatgccctgcgccagggcaccagggcatgggcaaagccctccccctacacaaagcaagggtgttatgtctacaaccgaacggggacactaagagcccccaacatgcacggttttcattccaaagaaaaccaccagttctgagtacaacttccacctggctctattaactgagtacacgtttccccaacacagaaatcctacaaactcccgtgaatgctgtggtgaaaagcaggagctgccagggcaagatggatcgcacctgtaatcccagcacttcagaaggct

SEQ ID NO: 162117 - DNA, 190 bp, Homo sapiens
aagtgtagcttcagtggcctattgtatcctaggaaaacaccttgatcatgtgaaagctgaaagtaccacagttttctgctttctttccagtgatttcaatagtctaatggtatgcttctctgtcccaagcataatcagcacagtatctcaagacacatcaggaaggagcaagccatgtatataacctact

SEQ ID NO: 162118 - DNA, 715 bp, Homo sapiens
aaggaagactggaaccttgggctccttggaggagccggcagggggcgcgagtgtgagcgctggcagccgggcagtcggagtggctggtgttgcgggggaggcgggcccacccccagagagggaaggcagtggttccactaagcccgggacccctggaaatagccctagctcccagcggctgccatcgaagagttccctcgatcccgctgtgaaccctgtccccaaacccaagcgcacctttgaatacgaggctgacaagaaccccaagagtaagcccagtaatggtctacctccttcacccacacctgctgctccacctcccttgccctccaccccagccccgccagtcacccggagacccaagaaggacatgcgtggtcaccgcaagtcccagagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacaggtaactcagccctgacatcggcctgta

SEQ ID NO: 162119 - DNA, 690 bp, Homo sapiens
taatgagagtctttccaagaagtattgccaaagaataaatctcatcagttggcagattttaatttgggggtaataagtgaagattgtctgagtgttttggaacaaaaaagaacttttagactattgtgttctaggaatctttcactcaatttcccccagttacgtgcctagcgtaattatcctgaacaattgagaggagagtcagataagataaccttttacgaggctgacaagaaccccaagagtaagcccagtaatggtctacctccttcacccacacctgctgctccacctcccttgccctccaccccagccccgccagtcacccggagacccaagaaggacatgcgtggtcaccgcaagtcccagagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacaggtaactcagccctgacatcggcctgta

SEQ ID NO: 162120 - DNA, 298 bp, Homo sapiens
gtgaacaacacaaaaccctgccctaaaagacttgttgaacggcatcgtaggtgagaagggggcctggcgaagccctgctccctacggttctgtgagttcctccatgcccaccctccaaagagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacaggtaactcagccctgacatcggcctgta

SEQ ID NO: 162121 - DNA, 406 bp, Homo sapiens
tgcctcagcctcccacagtgctgggattagacgtgagccatcgtgcccggcctccccttgtaatttcttggcaaagtcgggttttctgccccgtagtgtctctgaacttttggatctgcccagtggtgtcccctgggggtgcctggcctgctccccagcccctggtgtcccctgtgaaacggtagtaaagcgtagacgccatgctgtcaggtgagccgactgctgccggcggctcttccaatgtaaacgctgcacagctgagccgtcaaagccttttcatcatacggaaacttccatcagatgctgctgacccacaggcacgatgggattcaagtttgggtttttggtggtgctggaatcccgtggggaggccgtggctggtgtgacctcagcagccagacccacc

SEQ ID NO: 162122 - DNA, 412 bp, Homo sapiens
tgtcaaagatcatttcagattaagtataacaaatttcacattcatttgtgagcatatatatatgtatatgagaagcatgtaagaaattcgtatatctcacatactttttaaaaaagttttctggtattggagtgtcttcgccatccactgccatgcacaagaattatatttaagttttgagcattagacttttgcacttattttcaggaaaagtcgtggaggaggatagagtagttctgtacatacatagctgtatccaaaagtatttaagatttgatgttatttaattgtaaacattgttaaaacaaatctttcatatgcattaacgttctaggttatactttctgctactggatgcaaggtatttttgtttcatttttagaattaggtggcattgaaaacagattgcaga

SEQ ID NO: 162123 - DNA, 882 bp, Homo sapiens
cctaggatctgaagaaatcttgcaagctgaagcctgacagtttggtgcaaacctccgagggctcaccacttcagtagaacatgcgtaaggaagagttctctctagacaaattgtatctggacaaataagaaggtccagtgatctgcttaggccatatatatgcttttataagagggaaccaagacaaggatgatgtcaccaacagcatcgacatccaagctttggagcttgaagaaactcaaagagtgatgctcgataactgagagagtttcctccacaaacgtcttggactcattggactcattaaccttcagattcaactcccagctctttccttcaataccagttttcatattaatgcttcccttttttcattttaggcattcccctttcaagaagccgatctccagaccctaaaacaactgatctttcccattgactctccacagatggttcaggtggttttacaggaacaacactaacaaagtcctctggagaccctttcttggatcccgctccaccttctcaggaggtttatgatcacctcggagttgttcagcaatgagacacttgccttgaacaaaaaggtgactgacaatgttgaacttttcctgagtcttgtgctccctgaaagttgcaacaattatgaaatcccccaccccactcctttgtgtcccaggaggctaactacagaggaccaccctgcccttgcatattccaagacagactcatctccatccttgcgcgtgactcccgtaggactcgcagatggctccgttagtgacctgcttgcataaaaccctcggtccccttccttttctttgaggaagttctcattaacgatcattctccttataatagcctgaataaaatcatatattt

SEQ ID NO: 162124 - DNA, 425 bp, Homo sapiens
cctaggatctgaagaaatcttgcaagctgaagcctgacagtttggtgcaaacctccgagggctcaccacttcagtagaacatgcatggttcaggtggttttacaggaacaacactaacaaagtcctctggagaccctttcttggatcccgctccaccttctcaggaggtttatgatcacctcggagttgttcagcaatgagacacttgccttgaacaaaaaggaggctaactacagaggaccaccctgcccttgcatattccaagacagactcatctccatccttgcgcgtgactcccgtaggactcgcagatggctccgttagtgacctgcttgcataaaaccctcggtccccttccttttctttgaggaagttctcattaacgatcattctccttataatagcctgaataaaatcatatattt

SEQ ID NO: 162125 - DNA, 482 bp, Homo sapiens
atgtgtagaagttcagagacagggagtgaccagatcgggaagcctcaagtagttaaggatagctagagcatagagtgtagagttagagtagaatggtgatggtgggtagaggtcagatcttaaaggtccttgtcagccatattagaaagtctagatttttttttttttttttaatgaaggcagtggggaggtatggaattattttaagccagggcatattataatcacatttaccttttaataaaataatagcatacatttattgaatgcttgctatgtaccaggccctatttgaattcctttatgtgtataaactttggtatacttttttaaatcttcacaatcactttgtgagagaggtcctgctattatttttattttatataatagaaaatgaggcaaagagagattaagtacctcacccagtttcatgcagccagtaagtggcagagatggaattcaaaccagctacaggatggaaa

SEQ ID NO: 162126 - DNA, 571 bp, Homo sapiens
aaatcaatagctttgtggccatgataaggttggtaccacttcactccgtgtcctcagtgaggaaactgaggcacagaatggcaagtgactgagcatcagcacaatgagtcagtgccttattcctgctctgtctcactttaagacatcaagttgctcatctgaattttttttttcttttgaaacggagtctcgctctgtcgcccaggctggagtgcagtggtgcaatctcggctcaccgcaacctccgcctcccaggttcaagcaattctcctgcctcagcctcctgagtagctgggattacaggcatgtgccaccacgcccccctaatttttgtatttttagtagagacggggtttcaccatgttggtcagggtggtctggaactcctggcctcatgatccacctgcctcggtctcccaaactactgggattacagatgtgagccaccgcacctggccctgaaatcttaaagggagataggtactgtaaggtcctctaaagagtgtcttgagactgggctttggggttctatcttgaagaaggggagtcccaggagacaaatgtgtgcagg

SEQ ID NO: 162127 - DNA, 303 bp, Homo sapiens
gggtaagtaacgcaggcactttgcaggctggtggaggaacacgttttcagaacagagccctgagctttcttcagtttataccttgtccagagaattaaatacacagcaccaggggaacaaatccaatgccaaaccactatcagaacatttccaactgttgaccgtatattttcattcaccaattaaatgttgtttgagattgagtctccctctgtcgtccaggctggagtgcagtcacgcaatctcagctcactgcaacctcctcctcccaggctcaagcagttctcctgcctcaacctccca

SEQ ID NO: 162128 - DNA, 186 bp, Homo sapiens
ccaatggaattctgcccccgcgctgcctttggactcaaattgcaacagcaactcctccctgtgtctctggcctgctccacagatttcagatttgctagtctccacacactcctaacaatcgtttaagtcagttccttaaaataaatctgtgcgtgtgcatttgtgtgtgtgtatacacacatccta

SEQ ID NO: 162129 - DNA, 225 bp, Homo sapiens
ataagacatcatcaggtactgttgggaaaatattaaaatcatgaagatacatgggctccaacaatattcatactgataaatgatgtatacctttaaagaagaagtttttttcagatatctcaggacataagggacatatttcaaatagaagctggaaaaatatgcactattaaagaattgttgaagaaaaatattttctttggaattaaaagacagtcaaactac

SEQ ID NO: 162130 - DNA, 401 bp, Homo sapiens
gcccacctgtgggttgctaagtatccgagggtacaagcatttggtgggagtgggtgaatatggtaaaggctaccaaactgatgtaaaattgaagttggcctacctatagtctttagcacatgcaccataaagagcctgatgattgtcttctattacaaattaaaggtagtacttaaatcactttggaaataaaacaacaacaaaaagacctagagtttaatcatcaatcacctgtgcaagaggccgcactgttggaaataatggacagagatgatggccaacagcagaaactatgtcccatttttaaagtcactcaaagagtgtaggctggtagaataaaactatagatagtgtcaacaatatacaggggatattcttacttcaggattgcttttgtagtt

SEQ ID NO: 162131 - DNA, 362 bp, Homo sapiens
gtgttcatgtatactggtaaggtgatggtgaggaagaccatggtgtggatgcatcagaggtagactttatagatgcacagaggccctggttgatggtaaaattgatgaaaataaatggtgggattgtgacacagagggctgaggcaggaggatcacttgagctcaggagtttgaggcttcagtgagctaggatcgtgccactgcactccaccctgggtgacacagtgagactttgtctctaaaaaaattaataaaatgaaatgtagaaatttttaaattttttcattggtgttttggaaatgttgagtaacctgttttaataaaatacagattacagttggtgcagcaaataaaggatttat

SEQ ID NO: 162132 - DNA, 278 bp, Homo sapiens
acagcctaaccagtaaacaaatagacatacaaatgagtggaataaagagattttaaagcattcaaactaaaaaagaaaaaataatcatgcactttttctcagggacctattggaggatgtgctccaacaaaaagagggagtaaacccagagacaggtgatccccaacataggagaaatatgaagggaatcctgggagtgataataagataactcactaagtatcaccgggagtgatacaaagagtaacttaaggatatcttaaggttagtagctatag

SEQ ID NO: 162133 - DNA, 427 bp, Homo sapiens
cccaaacgcaatggctcagagatggctgggggcatgagcagaatgtcacctactggagaagtgaaggaagaaagaagagaatttcagaataaaagcaagagtaagcaaattgctaaggcaaaacagttttgggtattgctactgatccactttgtatatattgtactggataaaaggacaggaaagcagaggggaccagctttagttagaaaggaggttgcatttgctaatattcccatggaaacaaacccagaccacaaccagctgatggagcttagtccactccaggtctaccacctcactagctgttcagccttgcactaggcacttaagtttatactatgacaggtcctagcttacaagctccttaaggtcttttcaggttttttttgttttttcttacttttaagatttttttttcctggag

SEQ ID NO: 162134 - DNA, 440 bp, Homo sapiens
cacaggatcttacatttactgacaattttcaacacaagaaaatttactttaatgtattgcctgtatttaaaaatactgctaggacaaatatatcaaccagtggctgacaggagacatgcctctgtgttctggttccagagctgttattagtgttcttttcaataacacacagctgctttctttctcacacaggtgaaaggaagactcatgtttttgggtcacagagaaaggtttggtcagcaaccatttactgaacttctgtgactaagggatgacaactgtgccctctgccatggagaatggaaagttgttcacagagcttgggaatctgattggtgagataattaaatgaccacataaggcatcctccacaccccaggctgatgaatatcacactcctgtgaatgtctgggcagtcctccacaccccaacccctaccc

SEQ ID NO: 162135 - DNA, 219 bp, Homo sapiens
tctccatgaaaagccagaactgtgctgaaccttaccagatttgtattcctttatttcataaggccctggtatttgacagatttctagtctgtgttccctgctaacagatacattgtgtaccactccttaaatagtccatactttgctagttggggtagtaggtttcgggaaatgagaattctcatttgactttttgattcttaataatttctattcctg

SEQ ID NO: 162136 - DNA, 477 bp, Homo sapiens
ttgactcgatgtcatttgtaaaacctttttcagtcatttaacttctaaaagaatgcttcaatcaaagctatctaacgtgtcctcttacccttttgacttccatttgccctttcactggccataaagtaggagcatggaatagaacaaagagagtcgctacagaatgtctgttgtatagatgtggtcagataagctgtgcttgggacatgggagagatgcctagactaccacaatattgttatcaaatgaaccagagaatagtgaatatttttgttgccttttcaagtttttcatagaatgaggaaaattaattgaacattacttatttaagtaagtgttcttcaggaatgaagtatcgccttagcacagccttccttcatgaaaaatttaaatactagagataagactaaacttgaggaacaggttctctcttaacctaacaacattaaagcttgtcagaaatccaataggggccag

SEQ ID NO: 162137 - DNA, 702 bp, Homo sapiens
gacaggtctacaaggataagtgtggacaagaagatggggcttcttctcccctcagctcccagtcaggtttaccatatctcactgggaaggccacattgtcaacatttctctacccctccaactccaagttgaagaggctgaaattctggtgagtgcagctgagcagttagggctccctttctccaccaagctcccacttacagaatggaggcttcatcccatttgcagcagaatactggagccctaatcgtcctcaccccagctcactcgtagggcagaggttccactgagagaagcaagccaagaaggcaagaggctactatcccacccagcacccagagtagtgcctcagagacctttcccagggcgagagacagttcataacaaaagagagctccgaggtactctccaaaggaactgactttatttgaaacagtgtggggaagtacaggcctaaggacactttagaaaatgataacataccttaaagaacagtaactaaactgtaggccatctagttcatcagagagaatcagggaaaggtagctaagaggagccctcttcaggtcagaacaaatctcaaagacttacagcaaagactattccttcccaaatttaattggatcagactgctgagcaattgatgccctggaacattgtcaaaaacaatagaactgcaattaatggatccttgagactgag

SEQ ID NO: 162138 - DNA, 473 bp, Homo sapiens
actaccccctgatgacacttttcaggttcccctttgctcagtagtccttctgcccatctagtttctaggaacctataactttggagtattttctgtctcttttctctccactcccagcaaatatctgatgtgtcttaaatgcatctttcttcatagtatttctgtggatatctttcttcatagtatctaagatctgccccttcctttgcatttctataattcattcagtactttataaaaatgtggtctcaagaccacctgcatcataattacacaagtttcactcacaaaaaaaggccaagtcccaggctgtataccaaatctactgaatccaaatatctttagagtaggctaaggaaatatttttaacaaacatccacacccctcactccctgagattctaatgcatgctaagatttgggatttctgtagcctaatccagacccttatcaattcatgcatgtaacagcctc

SEQ ID NO: 162139 - DNA, 373 bp, Homo sapiens
caagcagttaatacagactcaaagtatcatcccacatattacttattacaaaaagaaaatagacttcatgatacagaaatctgacagacaccagtgatcaaacatagcatcatcaataatagaacaattggacattatgaaacttttgaaataatgcactgatgtggaaataatatcccttatgtagcatttgtgccaaaaagtcttaacataaatctattatataaattgtagaatattctacaaataactggcctgaatttaatttataaaaaagaaaaaggattaagtaactgttctaaagtaaaggagatccaagagatgtaacaaccaaatgccctggtctgtattaactgcttggatcctgaataag

SEQ ID NO: 162140 - DNA, 210 bp, Homo sapiens
ccgccagagaagctaaaagcatctgaaattgtgggatctggtttaaccagagggtcagaaaaagcagccggatgatagccatttacagataaagaagggctgctgacaccaggaggttgaaggactgtccaggatcaaacaatgtacctgcaagctacggaggaggtcgcatttttacgttacgcttagaatacatggcactgacatctc

SEQ ID NO: 162141 - DNA, 419 bp, Homo sapiens
acagtatgattacatgatgatcaatctccctctggactgaagcttcttaaaggtaagacccaaggctgtctgcgctgactcatgcctgtaatcccagcacttcgggaggccaaggcgggtggatcacttgaggtcaggagttcaacaccagcctggtcaacatggtgaaaccctgtctttaccgaaaatacaaaaattagccaggcatggtggtgggcacctgtaatcccagctactctggaggctgaggcaggagaatcacttgagccttggaggctgaggttgcagtgagccgagatcgtgccattgcactctaataacacaatcatgggagtgaagttctgtcattataagaggtgagctcagcttaagagcatgataacatccacattacagggaggaacagtggacatgtcaaa

SEQ ID NO: 162142 - DNA, 120 bp, Homo sapiens
ggacattctgttgtctgatttcattattggagttatgctattttccttaaaatgaattgggaagttttccattgtttttccctctggaatactttatatcatgtttgaattattcccttc

SEQ ID NO: 162143 - DNA, 547 bp, Homo sapiens
ggtaatgactcaggctcaggggatgtgggagctgcctctggcagggcagccccctctgcctggtgtgcagggaaccaaagtttgcagcttgtgcaaggcagacctggcctcttcttctcaggcctgaggaaggtgctgctggccaagactgactgtccgtgctggctgagctctggggcggattggccagtcctgctggtgtttccaggcctgatggatgaacagggcctccagagtcatgggtgactacagcaccggctccttgtcaggcccaaacgaaaaccactgctgctgtggcctagcgaccttagagaggagacacaccttgcctttgccacttgtttctggcctgggctctgcactcctctccatcggctactctgactcatcgggagtagacaaagggacagaagtttccaggaaaagggaaagagactgcaggcaggtcctgtggctgtggaagtgggtctggggagccttgacaaggccccccgctccagaggcccacatggccagcagcagccaggccataagcagtcagcagctg

SEQ ID NO: 162144 - DNA, 421 bp, Homo sapiens
gttggaggctggactgagctatgatggtacctctgtactccaacccaggtgagagcataagatcctgtctctcttaaaaaaaaaaaagagcatttactacctgtcaggtgctgaatccatgctcttgctaaatctgccagcagccctgtgaggtgggtgcagtcacgtcccttgcgaagatggggatttgggggcgtgaagaggataagtacctcatcaaaggtgacagatcagatttgaaccacactcttaactgctgcggtttattggccctacaataatagtgcccagttcacagggtggtttgggggattacacgacgtaatgtgtgttaaagggcttagcacagattcagctccagaggaacatagtaaatgttgatttaccgagaggcagaagagcgggatccacatccacccac

SEQ ID NO: 162145 - DNA, 482 bp, Homo sapiens
aggatgtatgggtcattttgaccagtcattccctcgctctggcatcccacaatttttccgcctccctccgaaagcgataataatatttagaggcgttcgctggggctgaatgagaattagccctaggcgcagcctatcattaggacgggacagcagggccactgtgacatttttaagaaagctgagatgatggaaagaataagaaaagagatgattctgatggagagagggctgcacagccctacggcgggcaagagattctccaatttgtccaactcggctggcaatgctgtgctcgaggccctggaaaattcgcagcacccggctcgcctaagcccgcgcctgccgtctgcccccctgcacagcgctctgggagaactccccgccaagggcaaattcgaaatagacactttgttcaacctgcagcacacgggcagcgaaagcaccgtctcctccgaaatctcctccgccgccgagagccg

SEQ ID NO: 162146 - DNA, 433 bp, Homo sapiens
tagaggatcccgctacatcctgcaactctacaaaattagtatctctaaaatcttctgccacgtcccattagtaatttgacttctttggtgcaggctttattatttttggcctcagtaatcttttgttaatttaagattactttagaaaacaatgttaaaggaaagtaaatttaaattagctacttggatttcttgttagaagttcaagaaacaagtttgagagaatcaattgcgatatgatgactaatccaggtattttaagatggttattttttatttatcataatcagaaattagcaaaaaaaaaaaaaaaaaaaaaaaattcgggggtaattttttttaaaaaagttttaaaaaaacggggccatggggcccagggggctgcttggaggggcccctaatagagggggccacgcatagggaaggtcgggga

SEQ ID NO: 162147 - DNA, 552 bp, Homo sapiens
ttctgtgccaggaccttttagatttagtcttttgggcagagctggaatatttgtgggagtgagcccttctttctcaagcctaggattggactttacattcattgtcttgttcctatcatgatgaatttcttgagagagacaaactgtcttcttaaagaagagactggaggagagatcacagtcctcctgccttttctgacctcacccctctctccttcccacttgtccgtcagcatctcggctgctctttctgggagctgaaccaaggaagagaacctctgctgtgctgtcgttaataggctgagcactcaggacagctgtgaggcagaaatgtggctgggccattgctctgctgcccatcataggtcaggtctctgtctttaccacatcactggctcctgcaagggtatgtagacaactggtcaacatgacagcttggtgtaaagcagaggtgttgacagttaacctggagattcaggctgtatagacagtcaacggaggccatttagccctgtggaaaagtatgcatcctccacaccaggttctgaggaa

SEQ ID NO: 162148 - DNA, 531 bp, Homo sapiens
ctgttctcctgccgcatctccgtggtagtgaggccctttcttgcttgtgcctacgcatcgtggtttaagttctttgtcttgtacctgatcatgataaatttctgcgaccacataggagcatgtcgttcttgattctccacaggtggaggagagatcacagtcctcctgccttttctgacctcacccctctctccttcccacttgtccgtcagcatctcggctgctctttctgggagctgaaccaaggaagagaacctctgctgtgctgtcgttaataggctgagcactcaggacagctgtgaggcagaaatgtggctgggccattgctctgctgcccatcataggtcaggtctctgtctttaccacatcactggctcctgcaagggtatgtagacaactggtcaacatgacagcttggtgtaaagcagaggtgttgacagttaacctggagattcaggctgtatagacagtcaacggaggccatttagccctgtggaaaagtatgcatcctccacaccaggttctgaggaa

SEQ ID NO: 162149 - DNA, 472 bp, Homo sapiens
ggattaaagttgctgagttaaaatacggacacatccccaaaattaaaataaaaattccaagttggtataacttgtattattgttaacacagtcaacaaacacaataagaattcacattgttggtataaaaaattcaaaatacaaaaacttaagtctgaactatgacagagatttatctatcctaaactaggcaaaataaattattttaattatcttcaatgacagacctctgtcatttatacttgggacttataagaatatgctaaatgttttgaatgtatttaagaaactgaagcttggttaataacttcagaacaaatatattgagtcttcagtttagacttccttagatagtcatgcatcagggcttatttcatttgtaccttctgtccattagtctgtgcttggaacattcccttcccacagtctttgcagtactgaggggcttatggaatttgaagtatttcacagt

SEQ ID NO: 162150 - DNA, 386 bp, Homo sapiens
ctctctgagttagccaatccctgaagacagaaatggactgcccctggagcatgtttttcaaatacaaataatccattccagagcccacaccctcaacaacctcttttatcagatgcttacactatgaggccgttagccacctgccttatcactccagggcgaggtaccagacagctattaataggagagtcccaatgtcccgtaacccactgaaagtattcaaacgaaccaattctaaacctacttaccctgttcctctcatttcttcctgtggaaatcataataaagactttcacccacctttccatctgctctctccatgccactccctttgcctcctgaccaaccctggtcttccctatgtggccccttgtggcatggcatgc

SEQ ID NO: 162151 - DNA, 497 bp, Homo sapiens
ctggtgactgcacaattccacaaggctttcaattctactctgaatctcacaagatctaaacttttaatattaacatttaaagttttttattctaagagagcaattttttgtaagatctggaaaataacactgtaacgattgactatataccttattgaactacagaaatatctaagattagatatttcatctccctaaatgctagagtaaatcacacagctataattttgttccataaaatcatctagattccaaatttcttatagttcattcttgtctccattaacttgcaacatacaggtatctcaatgagaatgaacattttcatgaaacggttcttggaaaaatcttgatgatttgttaaaagcaaataggagttagcctaatgaaggggatggaggtaaaatagcattaaacataaaaagcatcttaaacaaaacttttgagggatgaaactgtatgacgaattcagagacgtaggtcaggtgtagtggctc

SEQ ID NO: 162152 - DNA, 498 bp, Homo sapiens
attaatccacctatgacctgaagtccccactctccactgcccccctacccattgtcccacctttccaaaccaaataaatgtacatcttacacatactgattgatatcttatgtctctctaaaatgtatacaagcaagttgtaggccaaccaccctgagcacatgttgtcaggacctcctgaggctgtgtcactggcatgtctttaagcttgacaaaataaattcctaaattaattgagacctgtttcagatactttttgggttacatagttttaatgtttaaattaaaaaaaaatgctaactctagaataattttattacacaaaacacataaaacaacagcacacagaagaaatgtaaatcaatacaaataaaatatttctagtaatgaaggaagtaaaactgcatgttggaaaagaagagagttggagttgaattattgctagtaagagtataagttaattgaatcaccttgaagaacaatctggtaattcctact

SEQ ID NO: 162153 - DNA, 429 bp, Homo sapiens
caggcggctcacgagagagcccaggagttcgagaccagcctgggcagcacagtgagaccccatctctacagaaaaaaaaaaagacaagaacagaaattagcccagcatggtggctcacacctgtgataccaatcctcccgctttggcctcccaaatttctgtgattacaggcatgagccactgtgctcagctaaatcttaatttcttttattctcctctcctccacctcattttccacccactaccagaatcatcttctattttaaaaatctgcgtctgaaagaataacattataaaagtagtatattgaggttaaacgtggccacctggccatatgtttagctctcgtccttcacaaaactccattaatgtgacagtgaaaagattttaaaaaggttacacctgcaaggaaaagaaaacaggagagct

SEQ ID NO: 162154 - DNA, 241 bp, Homo sapiens
caaagtgccctgaattttctgtggtactagaagccacaaaatctgaatgctgggaggaatctttttgagtatgggagggccagtcaaccccaactgcattaaaaaatggcacaggtttatacattacttgcttgaaacagaggtaggccaggcatggtagctggtgggcagacagcttgagcccaggagttcgagaccagcctaggcaatgtgggaaaaccccatctctacaaaaaattaa

SEQ ID NO: 162155 - DNA, 277 bp, Homo sapiens
ggaaaagccaagggaggagagaggtttaaggatatgatcagcactgttaaatgatgctggacggtcaaaccagaagataactaaaaagtgtccactgaacatagaaacatggaaatctttagtgacttagtgagagcttgtttgtggaataatggagtaaaagttcaattgaaataacttatgagtgaaagatgaagaaatgcaaacagcatgcatagataattctttcagaaagcttgactgcaaagaaaaaatgggcaatagcttcaggatttat

SEQ ID NO: 162156 - DNA, 344 bp, Homo sapiens
caagaatcacttgagcccaggaggtggaggttgcagtgagccgagatcgcaccactgtacttcatcctgggcaacagagtgagactctgtctcgaaaaagaaaaaaaagagagaatattatccaaatatttatactgtatgtacttcaattccaagctgtcaccaatagaagttgtattattttatatcactaagaaaaaatgtgctaaataaactctgatgtgctatatcaattgtgggtgcattcccatttcagagacattaacatttgtaaaacaagtgctgaaatatggtgttttcaagccttgtctgcattgatgggcaagcacgtttaaggtatttaa

SEQ ID NO: 162157 - DNA, 203 bp, Homo sapiens
ctgcgatccctaaagatctttgagcatcaccaaatgctagctgtaacacaaaagggatatgtttattactgctgatttatttttatttgctatgtgagaagcaaattactactgatttagtatgtaaggcagtgtgaatagtcatatggttatgcttttttttttttttttggaaatggagtctcactgtgtcgcccaggctg

SEQ ID NO: 162158 - DNA, 535 bp, Homo sapiens
atccaagtcttctatacttcccagccccaaggcaggtagttgggtcatgtggctaattcttaacaatggaatgcatatagaagtgccatgtcaattctggtctgaggcagttaagaggggataaaccttctccatgctttcacttttcctgctttggcaattttgggaacaagtattccagacaatagaattgcaaagtgaaggcatcttggatcctcaatttgccatctgaaaagatgttatgtaggacaactactatctgatccacttcaggttctgacatgagcaagaattaagcctttgttgtgttaaactttgttacagcaggactgcctgtcctatcctgactaatatagcctgtttaaaactctgagaagctagcttggctgaggaacatactggggcttcagtgggagccaatatgaaaggaaaaaaagcttggacggacatatctgtagagctagcccttgaagggagttcatttgacagtgtctagaatgatgcttcttctagactaaggtcagtaccaaagaac

SEQ ID NO: 162159 - DNA, 291 bp, Homo sapiens
cagccccctaccgagcctgccagtaacaagccaacaggcagaaggaacgtcagaaaaagttaaggctgcctgtggtgcagggtccaccctggcacagggagccgggggccaccagccctgctagtccactgactgcactggagctgggagctgccagaggctcagcatcctgaaggcaccgccaccagtatcacctggaagcgggaaaccaccagctgcctcccgccactctgcagtgggccttgcctgaccaagcagagtatgagttcctgcagggcggggcctgagccc

SEQ ID NO: 162160 - DNA, 311 bp, Homo sapiens
tacattatctctgatcatcacagcaatgttgcaagaaaattttctttcatggatgagaaaactcaggcttggagggataagtcacccataactgtggggctgaatgtaaaacagcgtctgtctgatatgaaaatcgaaaccatgacgccatcctgcctgctcattcataaaggccagggaaaggtaatagtagaaggaaccagcgtttactgagccgttactgtgtttctgaaactctggtgctttgcctacttacttatttcacatctctgctttgtgaagtttggggtatgtgcctagtgttagagaca

SEQ ID NO: 162161 - DNA, 396 bp, Homo sapiens
cctgtctcgtctccatcctccccaagggcccacttgaagcccagtgactcccattctgagcagggctcctgaacctgtctcacagaagtggggttctaaaatgtggtctctccctaactgcccctagaagcccttctgcagtgcaccatccttacatccgttctctagccctgcagcctcttagccttcctcctcttccagaccagccctgcatctagcccttgtggccaagttcccccgtcccccatgcctcctgatctttgctctgttagctcgattctatcttctgcctccctccctactgagttcttcccctcaacctctgaatacagatggtccctgtcttagaactgtttgacttcaggatggagcaaaagtcaaaatcgtacagtagaa

SEQ ID NO: 162162 - DNA, 142 bp, Homo sapiens
aaagagtttctaacatatatctgagtttaatataggctgccactgagtccctgattcagttgaacaactgaaaaaccagtaaagctgctcctcactgtttagctatgtcctcaaaataagaatttttggtaatatataagaa

SEQ ID NO: 162163 - DNA, 749 bp, Homo sapiens
agtagagatggggttccgccatgttggacaggctggtcttgaactcctgacctcaggtgattcgcctatcactgcctcccatagtgctgggattacaggtgtgagccaccatgcctggtcattaaaatcatatatttctttcccgtaggctacagtaccatcaagataagacagtattttaatgacacaaagtgaggcctaaccaatcctaaactgcacattagctttagacttaagaacgggggatattttagaatgtttccaattatactgttgatataaggtaaatctttcttctggttaaacatgctgcagtggatgtggtcttcattctaaagcttcaggcaggccccatatcatgagtccaggcaaggcttttgaggctgtagacagttgcactagaagcactccaaggagccaagtcctcatctacctccctgaactcagcccccccgctgtttaagatttttgagaagattgaaaggagagtgctctagaagacttcattcatgtaaagaattacggtaagagtatacattgatgcccattaaaaagactacaaatttactacagtgtttctcatgctactaagagaataacctccatataagtgattttttgtgtggtccaagagactggaaagtgagaattgaaagaaaaaaagctctcgttgattctttgtaacttaaagtcgctgcaggaagaacatggcaaggtctctgcacaattattctttgctttcttttcag

SEQ ID NO: 162164 - DNA, 217 bp, Homo sapiens
cgttactatgagcatgaaatgataatgcaaagagcttagtggccggcacaacaggtgagcattcagaaaatgtgagctattattaccagctcccttcccctaaactctataagcctagagttaaattcttactgcagagaaaattatatttgcttacatggggcctccgcagctacagtctccattcttcaaggagagggaccaggttttattcatc

SEQ ID NO: 162165 - DNA, 499 bp, Homo sapiens
taaagaatggactatgatttcagggtggaggtaggagaggagccaggaggctgtggcaggaatccaggtgagatgtgacaggctggtgggaagcgggaagaaaataggtggatttggaatctgtttcagagatgcagtcagatccagcagagaattcagggcctcactgagtatcaaaagctggagggatccttagaacttgtcctcccaattaacacagcttacataggagaggacggaagcactgctgagtcagggacccaactagggtcacaaagcaactcaaggtggctcctacctgaggagtcaggctcctgcctcaaaacccagggctctttcatcatgaaaagactagaaaggggtcagcaaaccatggcctggcaatccagcttgctgactgcttttgcaaataaagctttattggaacacagcactctcattggtttaagtagtgtctatggctaccctcacactacaaagacagattgagtagttgtgg

SEQ ID NO: 162166 - DNA, 191 bp, Homo sapiens
cagatgaagagaactaaggagggctttctataggaggtggtatctaaaactcaagccagaaggaaaactggaattattcaggtgaatgggtgggtgtcaagaaggtagagagtatgacatttgacaacccttgaaagtagttcagtgggccttcagcttagaggaggagggagtataggcaaaaccaaaca

SEQ ID NO: 162167 - DNA, 564 bp, Homo sapiens
tggagaatactggtcaggagagaattatttttgaattaaaataaagagaaattgctaagtgatatgtacaggaaatacagttgtaactggttctgtctgtcgtcctgcctgtttgagagtattttacgtgttcatgtcttgcatctgtctcaaaaagattcttggggagtagacaagatagagagaaaaatcattggcctattggtgtccactagaaagagagagaaactaggatggagtttgggcatagaacagtctgaggttggccgggcacggtggctgacgcctgtaatcccagcactttgggaggccgaggcgggcagatcacgaggtcaggagatcgagaccatcctggctaacatggtgaaaccccgactctactaaaaaatacaaaaaattatccaggcgtggtggcgggcgcctgtagtcccagctactcgggaggctgaggcaggagaatggcatgaactcaggaggcggagcttgcagtgagccgagatcgcgccactgcactccagcctaggcgacagaacgagactccatctcaaaaaaaaaaaaaaaaaa

SEQ ID NO: 162168 - DNA, 162 bp, Homo sapiens
cccctttctttttcatgatgcctctgtaattaagaagcagatttttccccccaaaggagagtgttttttctgtggtcttaacttggattcatatggattcgtggctttgtgggttcttaaaccttccacaattatatacaaaattgtggaatttggtataca

SEQ ID NO: 162169 - DNA, 302 bp, Homo sapiens
caaagataggatgaatccccgtttcatgccttcagagtaactgatcacagaggtccactgtggatcacatccatagagctcacccatgtcctagggacttgaacagtgtccccaaaacttgaacagcacatactaggtttgcaataagcactgggaaaagaaagggaggagttaggccatcctgcttccaaattttaaggtcttaaaccatcccccaatggtttttcaacttttaagcaaaggaagcctattttctttttttctttttctttttctttttttttttttttttttgagacaat

SEQ ID NO: 162170 - DNA, 268 bp, Homo sapiens
ggaaaaagcatttccgggacaggccggctccgacattcctcacatgggcccttcaggcagcaattactctattggcttcaacattctccatccaaaccacgtgactccagtttctgtgctccgttttgcagaggaaggtatagctgagggctccagtaatcccaagatgatgcacgtttctcttgtaggggaccttccccaaaccctctccccaggaggttcccgtggctcagtctgcaaatccacacagcccggacactgatttgca

SEQ ID NO: 162171 - DNA, 119 bp, Homo sapiens
tcaagttctcattacaagttcatgcaagaaacagggatcaaactcagttctgtctcactcttcccagaaacaaacatcaacagaaagtgactcagctttccccaacccccactccctga

SEQ ID NO: 162172 - DNA, 162 bp, Homo sapiens
tttctgttaagttcctgtgttgcttcatggaaaaccgagttcacagaataaatcttaacacactatttttgcctttccaagtgggagaggcaggcaaacattgactctaatctaccatcttgcgggggggtggggatgggggtggggaacagttttatcttt

SEQ ID NO: 162173 - DNA, 250 bp, Homo sapiens
aatgctaacacagatcagatatgctgtggaagttttaccattaacattgctggttgaaccttgggttcaagtgtataatggtctctactaatttacaagaaagtattcatttggttctcttctcccagactgcactgcaatattttcactccgagtctcacctggaactgcctaaaaggggtcactcatgcccataccattcacaacctctattcctgtagcatctgagggtacctgtggagactggagg

SEQ ID NO: 162174 - DNA, 881 bp, Homo sapiens
  misc_feature (25)..(25): n is a, c, g, or t
gcagctccgacccctcataatgagngcccagtgagactcttaagcttttttgagtacaagaacaatgccttatatgtattcatcgcccctgccaatattttacacatagtaggtcttgccctagaggcagaaccaatttggacagcagttttaacaattcagacaccctgtaacatgttgcttctgtaacaatccatggctttggacttaagcccagtgaaagcacattagtggttatgagtttctccctgtaaggtttttcctctttgtctcctttctattttttggtacgtgagcagcctctgtctctctgtagggaagcaacagacagcttcagtgagtacaaatgttatattcacatgtggaacatagccccagagataatcatatgtaccagtgatccgtcagtagatgctattacccgtgtggttcttttatcaaaggaattaagttctcttgatgtgttaataaacagtacttttttggccagctctggagtggatgaataggtgtttggatgtctgtctagattgacagctttagattgcttttttcctgaaatctggtaattccagatttacagtgaattttctcttaagttgtgttttcaagtgatcacaccgaattggtgggcagcaattctttcttttaccaaaaaagtaaaattatcgttaacactttttatcaacaaaactaattctttaagaagtctttgttaattttttgtcttttctctctccctacatttgtatttgtttaccacagatctttagatatgtttctgttggaaggaagtattctctttttttgagacagagtctcgatcttgtcacccagactggagtgcagtggcattatctgggctcagtgcaacctccacc

SEQ ID NO: 162175 - DNA, 931 bp, Homo sapiens
tgaactcaggtcctagactccaggtccgatattgaataatggtttctggccatgctcatttatagtctttgactgcagtttaatgtcatctcagaatattttttagatttttggattatttatttttcctttgtcatttagaccctaacttgtagatcaggtttcacatctgtgctgcagtttagcacccaaaaaagaaattttatatatgaaagagccaaagtatatttttctttatcctttggttatttttcctttcctcttcacatagcttgtggttaaattattttccttagactttcatactaaaataatttgcctttgggtagaggccaagcacagaccattttcaattctctacaagattgtttttctaagcagctcaaatgaaaaaattcccatgtcttacaatgggcatttgtaagttggttattttgggcaatcagtgctaaaatgtagagtctcttcaaaatcttgaatcttctcagtacacctacctttaggaaatgacctaaaataactacatagaaaacaatagcaatgaccccaaagcccacatcagttatcatttccagattcatgcaacagtttgtcttctttatattgagtttaacttttaaacgagacttagttaccttagaggaaactaagaattggaaagaagaaccttcaaactaaacaaaataaacatatggcttacatttgttgagtgcttaccttgtgccaggaataatgctcagtgctttaactgcattattattttcaaaacctacaatcccctgtagtaggtaattttttatgtatatactagatgaactaaagctcaaggaaataatttgtccaaggccactcagcagtaataaatgccagacccagaactgaaaaccaaatcatactggctccagatcgcttgttcttcatctttaaaaaa

SEQ ID NO: 162176 - DNA, 343 bp, Homo sapiens
catgtatgtcatgtgagatacaagttaaaaaccaggatgttatatttaatctggctctaggcagttttccagatcaatgttttgtaccaagtacacagtatgacctctgaagattcaggaaaggaggcaggaagccaaggtaaccctagcaatcagcttcttatttgaactgctacagaagcatttgcctgaaaaaattcacttcccagcctctttctcactggacgtggtgtatcagcctgcagtggctgcctgcaggaaatctccctgcagggaaggttgaaggactcagggattcaggctcctgggtttaccgcagtgcagttacacaatgggaaattta

SEQ ID NO: 162177 - DNA, 409 bp, Homo sapiens
aaaaaggacaaaaagatgaacgtgatatgaatgaaatctgagctttatcttaggagcacaacaaacttactgcgtagcccacaaaacagggacccctcctactctgcagggaagttccctatcaatcagggcataccctgcacattctgtgacccaaaacgaatatggcacacgagtttctagcttgtgtctcttcctttcaagaacatcatccttggtgatgctgaaaagccatggtcttggcactgtggtcacacaatgctaatgcttgatcttgaaccatctcatttaggaaaaatttcaccatgaactgaagcattacactcaaacatgctgaaagacgaggggaaaaatttcattctctctttaaatttgattcatttcaatattaaatggatcccgattttta

SEQ ID NO: 162178 - DNA, 300 bp, Homo sapiens
tcaaatagcaccgctgccgccgttttaccctgtgaccctgcaggatggggatgggactcactcagagaggctttaagatcagatgtgcaaaagcgtacatagagtggctgagaaaatacaagcacttggtctccagagtgagttggtgcttaacaaatgttcactcctatgctgttttgctgtttttccggcatctaccttgtaacaactctaccaaatccctttatctttggacttctcttcctgccctcacccctttgcacttagctccgctcactgcattgctctgctctgcttaca

SEQ ID NO: 162179 - DNA, 340 bp, Homo sapiens
gacagtgtaagcagagtagagcaatgcagtgagggagctaagtgcaaggaggggtgagggcaggaagagaagtccaaagataaagggatttggtagagttgttacaaggtagatgccggaaaaacagcaaaagcgtacatagagtggctgagaaaatacaagcacttggtctccagagtgagttggtgcttaacaaatgttcactcctatgctgttttgctgtttttccggcatctaccttgtaacaactctaccaaatccctttatctttggacttctcttcctgccctcacccctttgcacttagctccgctcactgcattgctctgctctgcttaca

SEQ ID NO: 162180 - DNA, 316 bp, Homo sapiens
agagtggccctggcttctcccaccacagtgtgcttccatgttgccagggcactgttggaaaagaggcacagtcacattcatatttccgcaatcccagcccaaaggccccccaaagccagcttcaaccgcagagtgtctgtgctgtcagagtgggtaggctggttttggaggttgcccaccttgctttttctgtgctcagattccatccctttgtagtcctagagaggctgtgttcccgcccctctcatattactggtaagtattatggaccaggtatctggaaaggcctacagttggatcctagatgaggctggca

SEQ ID NO: 162181 - DNA, 298 bp, Homo sapiens
aggaataagagaggaagaaaaatatgcatagccgagttaattcattcagatgtgttagctgtgcacctgagtcttggagaaatgtcttgctcctctgagctcctccaaatgggatttttgatggagtcttacatgttttgctctcttctcacatcaaaacattccacgtactttgagtttagattcagcccttcctcctggtattaaggaagcagtgaatacatcaccatcaaccttctttctatcaatatgagagacctacctgctgttttctttatttttataagaagaacacctt

SEQ ID NO: 162182 - DNA, 587 bp, Homo sapiens
gattaaaatgggagaaataatactgttcttcgggtaatacaggagggatttttactccctttttctcatcgtttatgaccagaattctgagtggcattggaatttgtgttgcatgaccagctctgtgatacttgaatgtgttagacttctgaatgactgtattcactataacatcagcatccattaaaaaatcactctttcaactgcttgtacagttagagttctaaaaagagagtgaggaccaattaagtatatagctactgcaaaagtaatcattgtaaaggctgtttgaatgggttcagctaaaggtttgcatgaaatacgccatttaagcaagtgtagggttaactcaaggaagcttaattgatcagcaggtatttattgaacacttactgtgtgtctaatgctcagattagtatgtaagagccattgctgttaaggagacatggcttatatttatgaaacaacttgaggttaattgtgtgctgaattctggggcactgcactgtggataataggaggaatccagaggaggaaaaaagtggtgaaggtagaagttggagaagcctttctatgggcagcctaaa

SEQ ID NO: 162183 - DNA, 361 bp, Homo sapiens
  misc_feature (15)..(15): n is a, c, g, or t
  misc_feature (23)..(24): n is a, c, g, or t
ctcgtgcaagttcgngcagcggnncgacgaggtcaccttctcattaacctctcaaaatgaatctatttcaggccaggcttgaaaatgttttctctctaaaaactaccatgcagtctaacagttaattgttattcttatcaaagaatgacccacattaacatttacttggggttattagcatatttattaaaaaagggagagaaatgagcattctttcctcttctgctgtttgttatggggtgttatggaagaaagtcatgagaaaaaaaataaagtacgtatttaccaatatttcaggctaatccataaatatcaaaatgcctatacccatcttggccttgaactggcagactagtgacca

SEQ ID NO: 162184 - DNA, 570 bp, Homo sapiens
cttcccaacctgtgccgcccatggggatacaggacagtaacgagctaaacaaaacctgctgcctgaatggggggaacttgtatgctggggtccttttgtgcctgcttcccctccttctacagacggaattgtgagcaccatgtacgtatgcaaagagaactgtgggtctgtgccccgtgacacccggctgcccaagaactgttctatgtgtaaatgctggcatggccagctccgctgctttcctcaggcatttctacctggctgtgatggccttgtgatggatgagcacctcatggtttccaatactccagaactactactgtctgcatgtaccactcttatgctttaaaataatgaatacatttccataatggtctctaacatttccttatagtaccaactacttcttacctctctgccctgccctcccccaaaaaactacctttttcaaaaggaaatcagctatatctccactgtgctggagtccagtatttcttgatacatgtaattctaccaaggtcttcttaatatgttcttttaaacaactgaattatatcttcagattattaa

SEQ ID NO: 162185 - DNA, 537 bp, Homo sapiens
taataaatgccacagggggtattctagaaactcagaaaaggggacatccaatatacctagagattcagaggaaattccaagaggaaataaagttatgctgagttttataagaatcctcttaaaatattggtatcagagctcaggtaccgtttcttcttcatcctgctcccggccttcctgccttttatgaaagagatgttgttcatctgattgttctgagtcaggtacatgggttgagccacgttttactagtgggtgtgataactgagcctgaagtatcagaagccaagcccctctccctaactcacttcctgtccccatgcatgggagactcttcggcttccatctctatgtggtaaatgcactctcaggagaacttctagagcaggacttctcaacctcagcactaccgtttggatagtttctcactgttcatgagtattggggttagggtagggtcctgtgtattgtaagatatttgagcagcgtccctggcctttactcactagatgccaggagccatcaacctttcccagt

SEQ ID NO: 162186 - DNA, 464 bp, Homo sapiens
atgttcacgtactagttcaccgtgcatgaattcagtaagtcgtatatcgtgaagatcgttcgatagtgatatatacatatcttcattccgttgtgtacctgtctagtactcctttaaaaggatgttcgtaagttcgtcaaaccattttccttttgtgggcacctgcgttgtttacagtctttagatattacaaatagtgctaggtattacaaatagtgctataggacatagacttgtaccatatgtctttttgtactcttaccagtgtatcttgaggagattcctagaagtgggatttccaggtcaaaggctaaatgtcgatattagatattgccaaaaatcaactctctctcctccataggagtattaccattctgcattgcctcagtaatttatgagagtaactgttttccttatagccttgctatcagaagatttcaacaaacttggaattctggcagtct

SEQ ID NO: 162187 - DNA, 466 bp, Homo sapiens
gtaaaatgaagatgattcatattatcttccctacagcaagagattcttaggaagcagaaactctttaacatgcccaagctttttggaaactgtaaaatgctattgcacatgtattttaaagttgtacttgtcatggagaggcaattattgttcagtcgtttaaacatgtcaatatactaagtgtttccaggacacacaattaagaataccttctcccagctttggggagatgatcttcttaggcgacggctcagactcttttgaggtgggcagaaaatatcttggcatcctttcaattttgtgagagtaaagatctgctggcataattaaaacaagccaaccaacaagtggcagcaacatcaggagattacttttcaatcactaatcgaattgatctcaccagtgtggaaaatgcagttgtaaattatcaggtagaataaagaatgtctcataagtatcagtaata

SEQ ID NO: 162188 - DNA, 1733 bp, Homo sapiens
  misc_feature (1733)..(1733): n is a, c, g, or t
gggcttggctggggtgctcagcccaattttccgtgtagggagcgggcggcggcgggggaggcagaggcggaggcggagtcaagagcgcaccgccgcgcccgccgtgccgggcctgagctggagccgggcgtgagtcgcagcaggagccgcagccggagtcacagccgcagccagagccgcagccaaagcctcagagagcaggagttggagcgcaggccctgctggatccgcgcctagctcgccgccaggcaccggccggaggacgggccgtggtgtcagctcactgcccgggcgctgtgggaggcagcgagcccgcgaccccccgggccgggcaccgccaggcgcggagcccagatcgcccccctgccaggcctggtcacggccagagcacgcaggagttcccagggtctggatctgcgcgcaccctaatgacctggggactgaagagaaaaaaggaacgaggatttcatctaaaagcataacgtgggcactaggcgaggaggaaagtggagaccacctggcacggggcagaggtgcctggagcccacgcttgagcatcggagaccctggcatcctagcagccgcgaccttggctctgccctgtctgagctggaaacacagcttagcttctagacatcgctggcacaggcctggcacaagtaagcagtgttctcacctgtctgaaacgggacacggggtcggaggaaccaggatctagcctggccccaagcggaactctctggtggcccagaggtcgtcactggggagcccgcctcctgccctagcctcactggtgcggatgtgccgctgcccgccggagcaccatgatggcaggatgacctcagccgaagtaggagcagcagctggtggtgctcaggcggctgggccccccgagtggccccctggcagccctcaggccctccggcagcctggccgggcccgagtggccatggcagcactggtgtggctgctggcgggagccagcatgtcaagcctcaacaagtggatcttcacagtgcacggctttgggcggcccctgctgctgtcggccctgcacatgctggtggcagccctggcatgccaccggggggcacggcgccccatgccaggcggcactcgctgccgagtcctactgctcagtctcacctttggcacgtccatggcctgcggcaacgtgggcctaagggctgtgcccctggacctggcacaactggttactaccaccacacctctgttcaccctggccctgtcggcgctgctgctgggccgccgccaccacccacttcagttggccgccatgggtccgctctgcctgggggccgcctgcagcctggctggagagttccggacaccccctaccggctgtggcttcctgctcgcagccacctgcctccgcggactcaagtcggttcagcaaaatcctgatctggtccattcagcagaggactgcagaagtctgaggagccttaagatatcaacttaaagcaatgggctcgtcgcagaaaggaatagctgtgccgggtcttcagagaaatcccgggctcggttccacgccctgaaggaaggccaaacctggctcaagcatgttacccggcctggcagggaggccggggtcacctgcaggtccgcgtggcgaaacaagggcacgctaagtcaccgggacccaatccattcagcccgggcaatttacagggacaggcacggagacacagggctgacgcgggagaacagtn

SEQ ID NO: 162189 - DNA, 1764 bp, Homo sapiens
gggcttggctggggtgctcagcccaattttccgtgtagggagcgggcggcggcgggggaggcagaggcggaggcggagtcaagagcgcaccgccgcgcccgccgtgccgggcctgagctggagccgggcgtgagtcgcagcaggagccgcagccggagtcacagccgcagccagagccgcagccaaagcctcagagagcaggagttggagcgcaggccctgctggatccgcgcctagctcgccgccaggcaccggccggaggacgggccgtggtgtcagctcactgcccgggcgctgtgggaggcagcgagcccgcgaccccccgggccgggcaccgccaggcgcggagcccagatcgcccccctgccaggcctggtcacggccagagcacgcaggagttcccagggtctggatctgcgcgcaccctaatgacctggggactgaagagaaaaaaggaacgaggatttcatctaaaagcataacgtgggcactaggcgaggaggaaagtggagaccacctggcacggggcagaggtgcctggagcccacgcttgagcatcggagaccctggcatcctagcagccgcgaccttggctctgccctgtctgagctggaaacacagcttagcttctagacatcgctggcacaggcctggcacaagtaagcagtgttctcacctgtctgaaacgggacacggggtcggaggaaccaggatctagcctggccccaagcggaactctctggtggcccagaggtcgtcactggggagcccgcctcctgccctagcctcactggtgcggatgtgccgctgcccgccggagcaccatgatggcaggatgacctcagccgaagtaggagcagcagctggtggtgctcaggcggctgggccccccgagtggccccctggcagccctcaggccctccggcagcctggccgggcccgagtggccatggcagcactggtgtggctgctggcgggagccagcatgtcaagcctcaacaagtggatcttcacagtgcacggctttgggcggcccctgctgctgtcggccctgcacatgctggtggcagccctggcatgccaccggggggcacggcgccccatgccaggcggcactcgctgccgagtcctactgctcagtctcacctttggcacgtccatggcctgcggcaacgtgggcctaagggctgtgcccctggacctggcacaactggttactaccaccacacctctgttcaccctggccctgtcggcgctgctgctgggccgccgccaccacccacttcagttggccgccatgggtccgctctgcctgggggccgcctgcagcctggctggagagttccggacaccccctaccggctgtggcttcctgctcgcagccacctgcctccgcggactcaagtcggttcagcaaagtaagtgcctgggtggccaattgagaaggtgggggtccgggtgggtgcatggcctggatggccctgtgaggggtatggctgttgtcccattttacaaatgaggaaactgaggttcatggctgtggaggaagcagaactgaggctcagagagggccaacagttcagtgagttccaggccccagactcaggctctggaggcccaactcgtgtttatttgtttatttacttatttagacagggtctggctctgtctaaataagtaaatcaacaaatatacactacaggttaacacaggatgtgtgaagtgagagacgatgtagagaacagacttttgtcttttgctttc

SEQ ID NO: 162190 - DNA, 393 bp, Homo sapiens
atgttctaggctccatgcaaaacacttgatagtctgctcttattcattaagcaacaatacttttctttaaaactatgcacaacagaaagcttttaaaacaagcaactattttcacaaaggtacaggagttttcatttttgtatcagtgtgaaaaataatgcttctaacattaagtgggtggcatggttaagcattcactaaaatatagagattgtgcaatttcttgaaacatttcactatgacttaatcattataaacactgtgaccttgtaaatcaaacattcacatccatatgtaactagaattctctgtggcttcaaactgctgcatgagttcagataacagaaaatgatttgtttctgaaactcaggatggcaaattggtctcaagggg

SEQ ID NO: 162191 - DNA, 215 bp, Homo sapiens
accacgtccagcctggagccattatttactgtcacagtagaagtcggaggaatattattagcaactggtgtgtagaggccagggttgttgctaactattccatgatgcataggacagcccccaacaacaaagaattaccagccccaaatgtcagtagtgctgaggataagacacacattttcaaggtaccttaccataggactcaaagtggcaga

SEQ ID NO: 162192 - DNA, 348 bp, Homo sapiens
aagtagtctgaagcaatgtcccttctcccacagaatttcctcctgtgcctgaacaattctgaatgatttctagtcacagaaatgttcacaaagcagcctattccaatgttggccaaaacaaattattcctttttgaaacacaaaacacaaatctataccttctttcacatggctttaaatacttaaagataattatcatttacatttccctaattttccctttatccaagcttaacatctttggctatttcaactgttcctccgaagtccttgtttctaggtaacttagttgctctcctctgaacaaactctactttgtaaaggtactacttgtggtattttgtggta

SEQ ID NO: 162193 - DNA, 211 bp, Homo sapiens
cctcccaaagtgctgggattacaggcgtgagccaccacgcctggcccacattttgaaattttaaacttgtagattatcattcaatatttcagtatgccatctattatttgtagtaaatgttaatatttactttttcttaaatggaggtgatgtttctcttttaaacaagaatgtgtgaaaatatatctaaaagtttataataactgctttg

SEQ ID NO: 162194 - DNA, 385 bp, Homo sapiens
agattagcaagattcacattccattctagccataggacatgtcagttcatctgtatgtgtcagaatcctttagatgagagtgacagaaaacccagctcaaactggcttaagctacacaactctacgcatgtcactgaacagtccagagtaatatgctggatccaaaggcacatgtttgtttttggggcattgtttctctttgtctctcacagctgatttttgctgtgctggcttcattcccaggaagattttccccatgtctaacaaagaagggcaccaacagctccagactgttaatctattgacccagcaaaaagagagactattagatcccgattgttccatcaaagcctagggacagattctcattggcctaacttgggtc

SEQ ID NO: 162195 - DNA, 455 bp, Homo sapiens
aggaggcagaggttgcagtgagccgagatcgtgccactgcactccagcctgaacgacagagtgagactctctcaataaataaataaataaatactcaggagggttcccagtaggaaagggtcacagtctgcggttttagcttagaggttgaggggagggaagagatgagactgagccccagaagggtggatgcttgggggtatgtggtgcaaaggagggagcagagcggaaaggtaagaaagggacataaaacatctcagaagacttagcaactgctttgacttggctcagggcaccaacaaatggctccttgtgttttcctggacatagacaaagaggtggaaaaaggagtaagaaccatgggtgctccactgccctctgctggcccctgcaagaagtgtccagtgtgctggcaaagtgtcatggggttttctcttgaatgatggctgcacaca

SEQ ID NO: 162196 - DNA, 362 bp, Homo sapiens
ttaactgaacatactgcaggtgtgctatagcagtatacttgcttgaacagttttaaggcaccagacaagtacaggcctgaatttttaaaaagataattccagtttccttcagaatcagtgacatatttacaagatactaatataagcttagaattggcaagagcagctttattctgaggtctacaggaagataatgtgaacacatttgtcatcatcagtgtgctaaaatttccaataaaatttgaatctgtgggagtttattataatctctaaaatcattaatatattaccttaaaaataaaattgaatactttttttgcagagttttttttttttgttttttttttttttttttgcagagt

SEQ ID NO: 162197 - DNA, 385 bp, Homo sapiens
ggcaagaataatgatccccatttaacagataaagaaacagaggcctggaaagatgaaatgacttacctagggcaattgaattagagttttagagagttgaaataagtttttatgctatcttctccagcccttgattcattaagcaaaccttaaccaagcacttcttctataactgagctatccctgagatgctgagatactgatatcaatgtgacaagacctctctcattccccagtagttgagagggagactgggatgaagaaccaagcactgacatgactaatcacacatgactatggtgtgattagtactgaagggaggtgggctcaggggctgcaatgcccaaaggggctctggccagccctggggagagcagggtgactg

SEQ ID NO: 162198 - DNA, 402 bp, Homo sapiens
agtccagcagaaagaaaaccaagccccagtcgtggagttcacaccaagcagaagctgctgatgagaaacaaagtcccacacaggcaatggcccaaatcaacagccaaagcaaatgagatgcagtccatgagccaaggtctcagatagctgttctcagccctgcttttatgactttgcaaagggtgtgctcaggctggggtttcagggcgtgctgggagtccagagaggcaagggattcttccaaagtcattctcagatgttggaatctcttgcagttgaggtctttttatatctttaccccagcgatttggggtaagaataaaacttcattttttttttcttgaagatagatacagatcaacttggaaatgtccaatgttatggggaaaagggaggaaatgg

SEQ ID NO: 162199 - DNA, 184 bp, Homo sapiens
tgcagactcaggctcacagctggccataggacctgggacaggcccttcacctttcaatggcctccgagacgatggtatgtgtgatgcttaatattgactgtcaactcgtttgattgaatgataaaaggtattgttcttgggtgtctttgagagtgttactaaaggagattaacctttgagtcag

SEQ ID NO: 162200 - DNA, 317 bp, Homo sapiens
caaaaaaagatggctgactaaaagcatttcatatgctcacctcctccacttagaaaaaccaaaagagtatatagacaatcatacttctgataaattatctaagatagaacactggaattcaacaggaaagtgacaggaaacacagaaagcaaggaaggagaaagaagagaagcagcctacctggctgagattggctaggaaacagcaagtgacttcccaagggtaagcaagagacttctagcagcccacatccccacgtatggaatcatgcattcctggcaacgagagccctttaccttcccaacccctgaaactga

SEQ ID NO: 162201 - DNA, 196 bp, Homo sapiens
actaaggttttcaaagaagtccaactaggagaagaaacagcaatccaggcagagagaatcctcaggaaggactcggaggcattcaaagagctggtgcgaaaagatctgcaaaattttctcaagaaggagaataagaatgaaaaggtcatagaacacatcatggaggacctggacactaatgcattagactgggtgg

SEQ ID NO: 162202 - DNA, 494 bp, Homo sapiens
ttacttttccacaggtaaggaaaagaaggtttatttctagtggagcaatttcctgcacataaaaacaacaaagaaaagatctaggttcgctgtgctatatcgaccgctggtaatttaaaaaaaaaaaaacttaccaatttaatcagtcagctttgcttacactaaaggctctaaatctgccccaaactactggttcttctaagataagactctaagaagagactgtacttaactcatataaaggttctcaggaaattgagtgtgagtgccaatgtaatagtctgcctcctccagttcttctttcctagaagatgcttgtgctgtttagttttcttctttttcctttgtataatttctcaatgctcttaatggcattgttttcttgtttgtttgtttttgtgtttcctcatgagcttatgtttcatgagaatcaacccaagatgctatggaatcttatgtagaaattatctgtatctgtccctgtggaaaagtga

SEQ ID NO: 162203 - DNA, 275 bp, Homo sapiens
gggagttcgagaccagcctaggcaacatagtaagaccccatatccataaaaaatttaaaaaaggagtttgtgttcctgtagtagcagacttgggaggttgaggtggcagtatcacttgagcccaggagttcaaggctaaagtgagctgattgagccactgcactccagcctgagcaacagagagatacgctgtctcaaaggaaatacaaattaaaaaaccagccgggcatgctggcgtgtgcctgtagtctcagctacttgggacactgaagtgg

SEQ ID NO: 162204 - DNA, 414 bp, Homo sapiens
gagacaaagtttcactcttgttccccaggctagagtgcaatggcacgatctcggctcaccgaaacctccgtctcccaggtccaagcgattctcttgcctcaccctcccgagtagctgggattacaggcatgcgccaccacacctggctaatttttattttcagtagagacggggtttctccatgttgtcaggctgatctcgaactcccgacctcaggtgatccacccgtctcggcctcccaaagtgctgggattacaggcatgagccactgcacctggccgatatgtgaagcttttattcactgctgcatccccagtgtgtagaagagtgtctggcatatgggagacactttagcatttgttgactgaatgttgttaccaccctgttcagtactgtcttgagctggccagtgga

SEQ ID NO: 162205 - DNA, 154 bp, Homo sapiens
ttttgtaattggtttttcatgactttgttcccccaatagcctttcactaccacaagaagaatgaccctatattttattccaagacagtcctggaccattgggccagtccagtaggaactgactaggtgatgatgtgctcacaacaagcccttgt

SEQ ID NO: 162206 - DNA, 606 bp, Homo sapiens
tatgtattgattttcaacattcaaagtgttttttaacatgttttttcttgtgtgcactaataaaactgtaacaatgtgggctgggcacggtggcttatgcctgtaatcccagcactttggcaagctgaggagggcggatcacctgaggtcaagagttcgagacccgcctggccaacatggtgaaaccccatctctactaaaaaatataaaaattagccatgtgtggtggcaggtgcctgtaatcccagctacttggaaggctgagacaggacaatcgcttgaacccaggggggcggaggttgcagtgagctgagatcatggcactgtactccagcctgggcaacagagcgagactccatctccacacacacaaaggtatgtgtgttatctccatgtatatatggataaccatctcatacccattaggatggctactatttaaaaaaaaaaaacaacgaaataggccgggcgcggtggctcacgccggtaatcctagcacttggggaggctggcggatcaccggaggtcgggagttcaagaccagtctgaccatcatggagaaacccccgtctctaataaaaatacgaaattagccgggcatagtgg

SEQ ID NO: 162207 - DNA, 538 bp, Homo sapiens
aaacgacccgaagacttgtctaattatgccccaggtatatgataatgtacagtcacgtttcttagagtaactcagaacatttatgacacagggttatctttacttctctagtctcagagtttcacttagcaggtcatctgagtgaaatctaagccagattcctgtggatcttaatgaaaaggtagtagaaagtagtggcatagcttgaaatttaactattgtcagatattgggcaaaaaccatctgtatacctcatggacctccagtaaacacttgtacattatgagtttagattgtttaaagtagatttcagtatttccagagtgaatttagtgttactgtgaggaggagggtgagaatatgtttctgttgagtggaagtacttgtgtgtctgcgggtcgtaacggccatgcaacaccacccacggaatcgagaaagagtataaatctgtcaatcctgtacgtgtccggaccgagtgaggtttcccgtgttgagtaaaattaagccgcattctccactcctggtgttgcctaacgtc

SEQ ID NO: 162208 - DNA, 251 bp, Homo sapiens
gtcatctgtcagcaaaactaattaggaccctgaaaaaattgtcagttgcagggatacatttctcactaatgaagaaacatggaaaatatctgtgtaaggggatcacgctgtttcttaagttcagattattggaagagggtggtgatgtaggtgtgtactcttcctgaggttgggtcaaactaaaatgataattgagaatgtcttgaatattgcccttgttaataagttgatctgttttattttatttagaa

SEQ ID NO: 162209 - DNA, 237 bp, Homo sapiens
gagaggatccccgtcccaaggatgaggaatgtatgcttacattaggtggatgttatggcatgtaaattatacctcaaaaatgcaaataaataaattttgtaaatgtaaataaatgaaaattttgctaagagtaccaactcagttgataaagttggtaaagtcaacatactagcattagaaaaaaatatgttaacatgtaagacatttagtttaaatcactatataaaaagccttcca

SEQ ID NO: 162210 - DNA, 571 bp, Homo sapiens
gggattactgtaaggatcagagtgtgcaataatatacacaaaagtgctttgtaaactgtcaagccatgtggtaaacacagcagtcacaagttattcaccatacaaggagcagggccacattacaccctaaggtcgagagcaagaacccactgctcagagacaggatgatcacctctcatgccaggtcagataacatcctctctagatttttttctctttccaccttgaactcaagctgtgtgatttcattcactgttgcaattgctgactgtcatctaagtgccactgtcaaaacattagaggccaaagaagtcaaaaagaactaaacacaaaaagatagctatcagcaggtaacaaaaccattctcaataaactcagcttcaagaactcctgtacatgaaaatgcccatagtcaggcacaagtagctgttttttcatatgttaatgtcatttattctaagagagaagcactctcagatacactcgactctacctctagaagacactagaatggtggagtagaaagcgcaccctccccaaccctccctcccccactgcctccaacaagcac

SEQ ID NO: 162211 - DNA, 1415 bp, Homo sapiens
gccaggatggtctcgaacccctgacctcaggtgatctgcccatcttggcctctcaaagtgctgggatcacaggcgtgagccaccatgcctggccgtggctgttcttaagcagggagacaggtgtgatcactttcatttagttaagtttctttgccagtggaagaagctcaactgaaaccagctcaggcacagaaggaacttaattggcttctatacgcaaaccacaggccaagctaggttcagttgaccttccggtcccccggggccagggacttaactggcagcctgcccctctcccatctccatgtctccacgtctctttgcctgccagctccctctctcagggatgcctcttccacacactggcgttcgtgactgccaatgtttcacacctctcaggttcatgaccacaaagagatcgaggtaggagcgcaggaacttggttaagcatcagggctacttgcttactcattgttttgtctaatttctctgtcttcagtgtcctcacataggaaatggggataacaacagcaccagcttaatgctgtgagggtcaaaggagatgatgtccatcaagtacttacctcggggatggacactaagtgctccatacatgttatgagctctctctgttcccaagtccagaaatctagacaaaagcttccattggcccagttgagttggggttcacctctggcaaatcaatgatggccattaaagtgggttgtgcaataaatgagaaggtgaatttcaaagcaaataggttggggtgcagaatgatttccaagaaggattggcgcagttctagaaaaagaacagaggtcatccctctggctgccagcagaaaagggtttgatcaggccccaacagcctggaggtagggaagtacctaagaggcaccacagttgtccaggtgagaaataacgcaggtctgagctaagcaacagtgcagatggagagaaggcggaggcaagagaagttttggaggtagaaatagggggcatggtgccaagtgcacgggagagatgagacagaatgaaaggttgaaggtggccccaggtgctagcccagaaacctacaaacagagcctctccaaaatgttgcttcattactcaggttaactcttcccaacaccactgccactccattctgctcagtagcacaaacttagttgaaggtaaacccagccacatctggacatttcaaaagactatcttaagtagattcttggtccacttccagctcctctgcttcccactgctccttctccttgtgggtagtcagtgttctgggagcttctattctgacctggcaccaggggcatacaagtgattcaggtctgccagcaactatccactgccatccactgagccacagaatccctactaaatctttgtcctgaccatgaggcacct

SEQ ID NO: 162212 - DNA, 650 bp, Homo sapiens
tttattgagcatctctatgtgtcggacactgtcctaggttggacaaagtggtgaatgagacagataaagtccctcaccgtctagtgggaaagatggaaaataaacaaacacaaacgtgcaatacagcttcactgtgaaagtatcaggctcattatcttctgaggcaaccaagcatttgagtcatataggcaatgacctttgctttaatcatttgccaattaaataacttacaatgtcacttggctcagtacccgtacttctgcctataagtaaactctttttctgtagttccacctataagaaaattctcatcctctcttcctactcagattaacaagagcatttcaaactatgtgataattatagctcctgttgaaaattattgtttatgaccctgggtttacacatcagtttctgtgaatttggttattgtagagtctgtacctaacagaaagacctactcttagtgggctcacaaagtctaatttctgaatgagcaagtttgagggtgaaagccatattgttaatgaactcatcaaggtaaataccacaggcaagcttctggaaattaagtcacctggcctcactgtccacacctaccctctttcaaataactcacatgtaatacattaaaaaatttatctctagga

SEQ ID NO: 162213 - DNA, 127 bp, Homo sapiens
taaaagaaagtgtatcagcatgtgatatgtcatgccaaatgctgcagataagtcaagaaagatgagaactaataggcctttggatttaacaatattcaggtaattgatgaccttgaatttcagtgat

SEQ ID NO: 162214 - DNA, 395 bp, Homo sapiens
tataggccacgtatgtaacatttatatatgtgatgactcaaatttaccttttcacaaaatgcaaaattgctattttccttttaaaactaaaaaattaatgtattaccgttagtgaacagaaaatataaataacaatgtcatataattctttagtacttattacctgagatattctaaataagattctgacttaaaaataccaaaagatatatttactcctaaatcaaaaaattacttcaaaataaatacttttaagaaagtttttaaatattgcctgacagtcactatttgtgtctaggacatctaattattgaaaacaatggcaaaaagaagagaaaatcacaaatggctaagtaaaaagcctctgcaaaacagcttatgcaataaataaacca

SEQ ID NO: 162215 - DNA, 484 bp, Homo sapiens
tacaggtgtgaaccaccacccctggctgagttgggattttttaattttccatagatttcccattaggaaggcaacctggtgtgacggtatttgagagtcaagagatctgggttctaatcctcatttcatcatgtaatactttgtgtgtttcagaattcttcacagtgatccttgcttgtcctcactcctttgtacagcttttttttttaaaggattttatccactgttgtgccagtaactatgctagtgtcactttttatgctagtaatagttctattttcaagttcattctgtttcctgagtttaaatttgtgtttcctagtgccaactgaacatttctgtcatttcatactccatttccaaaaagaaactcattattgttccgctttgaatttgcttcccttctttatgatcttttcatctcggcaaatagcattgctatgtacccagctgcctaaggaaaaaccctgagtcgtcatctttc

SEQ ID NO: 162216 - DNA, 600 bp, Homo sapiens
ctgtttccatgtgttaaaaccctggcagaccttagcgggctctgacttggaaaaccttgcggcaagtgctgggatacaggcgtgagccaccatgcccggccataattttcttttcttttttttaaaaaatattttgtggagatggggtgtcgctgtgttgcccaggctggcctcgaacttctggtctcaagcattccttccacctcagccttccaaagtgctggaattacaggtgtggactactgtacctggcctggaagttgactttttaaaaataaatttggattaactaaggagcctctgagtaaccgcaatagaaccctcggtttctacagaatttgaaaaaaagttttatattccatatttaaaaaatgacaaccatttactttcctgaaattgtaaacctgttatagtcatacccccttgttcatgggggatacattccaagacccccattggatccctaaaattgtgggcactgctgaacccagttgctatcaattggaagacgtttctgtttgtattttctacccacaaatttaatgccttctccatcttaactaagcacttatcatacactgtggctataactttagcagt

SEQ ID NO: 162217 - DNA, 270 bp, Homo sapiens
ttcaacctccacaaggtcttctaaaaacacagctgcgctagcagggctcgcaaggctgtggggttctacagaaaaaaaggacttgaagttccctccttctaacctggtgacaccaatcagacaggcagttgggaacatcaacatcatcatcatcatcaaataacctaagtgggaggactggaatcttccatgctggtcccatgaagacccacccatcaggaggagcccatctcatctgcactgtgtatgctcagcccacctccttgcctc

SEQ ID NO: 162218 - DNA, 453 bp, Homo sapiens
aagcacttaacacagtgcttagcggctccccagcttcccacttccaaggcttccttttactttctctcttggatcccatgttttgtcaggatgatgtctaccaaccaaaatgcatttaggaagtattggttcacttttccctttttcttaaaccaagacatcttcaaatgtctgctagagctctggtcaacatggaaccccggtattaacatactgcatagatgtaattccagcaaaaagcaaagaaacaagacatcttacatagcttgtgtggtcttaccaagggaaaattcatggtttgtgttcatcttttgaaatagtaaaaataactcgtgagtttcatttctactttcttggagccccagtcattgcagaatctaccacagccacagatcccatttcattctctcctgccccctgaggcttttatccttatcctcattttcaaggtga

SEQ ID NO: 162219 - DNA, 141 bp, Homo sapiens
ctatcctaccccaggctcagaatgttggggtatctccacctgcctgagaacttcaaacatacaggggctgggcttagagggcagcagcaccttcgttcagtgcatgagtgaatgaatgaatgagggagagaaagaggaagg

SEQ ID NO: 162220 - DNA, 493 bp, Homo sapiens
agtagaatcagcatttatgatcaacatcttctgaatgaacaagacctgggctttccaatagaccctctgagttcaagtcaggcactgtctacccagtcccctgcctgtccaaggattctgactttctgggcctcatgttccagagggcagggacaagtcatcagataactggacttctccactaagctgaaggcaacatgggagagtaagtggaagacatggtgctgtcagctagggtccaaggaaaggaagggatgatacagacagatgttgtcgggaggtgacatgagcatagccaccccagtgtcaccatgcaaaacaccgaggaggccgcccctccagccactcacagggctgcctgagccttaaactgacttcatgggtctccttactgatcatcatgtccttaagcagatgcccgtgacctccttctaaagagagctaagtcctgaataaagggaagtgactgcttcctcctaagctttgatgcgtg

SEQ ID NO: 162221 - DNA, 171 bp, Homo sapiens
tgtgactaaatgaaagactctgagacaaggagaataccctggatcatgcagatggatccaatacaatcacaagggcctatgtaagagagaggcaggagggttggagtcagaggagcagatgcgatggcagaagcagaggaagaagggtgatgtgatactgggaatgggaag

SEQ ID NO: 162222 - DNA, 362 bp, Homo sapiens
gttctcactggccgtgtggaggaagaattgggggagggtgttgaaatattctgtctaatctaatacaatatttaagtcaaagctgagagctttgatatggagaggacacacagtgggcctaatgtttgccattatgtatttttgaaaaatcttgtcttcagaactccattcctagaaattcaattatgcagaatgttatacagaattaaccaatatcatgggactttccggagctcctgaaaagtcaaaaaaccctcaacattactcaccacctaaggtagggggcatggaatctgcagagtggtgaacagtcaagtggactaccctctccccgcccaccaatgttggtctgttccttttct

SEQ ID NO: 162223 - DNA, 161 bp, Homo sapiens
aaaaggactccatcttctagcctaggatcttgtctgaagatgtgttgcctggatctccttgcaaccaagatggcagccaacatagaacggaacagaacagaaagaaactagatccctgaactgatgaaataaactaacctgggggctgcctcatctttggg

SEQ ID NO: 162224 - DNA, 416 bp, Homo sapiens
ctgcttcaccttttgatgtacagggcctaattgtaatacatttaaatgttaagtctccaccccaaagtgaacatgggatgtatgtaacacgaatgtttgttcattacgcatgcatcaggaccccattcacggatattcatagctcctcctataacctgttgaataggaatgtatggccaacctgttcagcattaagctcttgtcccaactccatctccttctaagtgcctttcagtgtctgccagaagctacgcttccaagactgtcaaggatggccaccttacaggttgtaaccctttataataaatagtctcctttctacttttttctttcacagctggagatcctttctaaatttataattgtgtcaatctttaggttgacaccaccaaaggtaaattctgaaattccctgag

SEQ ID NO: 162225 - DNA, 555 bp, Homo sapiens
gattgattgagattttagatactggcagagtagggaggatgggcttaagggctaaacctagtggctgacactccgttggggttgagctagcgactgcctaggtgtccataaggcatggaagtcaaggccctgacatgaaagcctgagataacttgggggtggaggagtgtgacccattagggtcacccctctgccctgggctgtccacatctccactggccatgccagacagaagcaaagggtcccagtctggctgactcagccgcctcatcacccctgctgctcttcacctcgctcctgtatctccctcctcacctggcactgggcacaaaagcccccacgtgtcccagcccagggcaaggtatctagagataagacagggaagctgtggacagaaatggctcgtgctgccccagactcctctgcctgggctctcctgtggctgtttggattccaggagagggcaagctcctctctaaatgctgggggctcatgaaggctgcagagaaactccctggccaggaagccccaaggcactttctgttgtcctgccct

SEQ ID NO: 162226 - DNA, 221 bp, Homo sapiens
ttaataaataattattaaattttgaaaggttagcccttcattatgaattattcataaattctacataagaattacatgaagataatatttttcagaaaggttaaaacaatttaacatttctttatctattttatgctctactttttacataaagtattgtcaacttcaatcaccacaacctaagtaaatttcacattaacaaatggccatggccaggtgtg

SEQ ID NO: 162227 - DNA, 320 bp, Homo sapiens
actagatgaacaaatctttaaaaatagccagtgcagacaaggtggtgaagcagaacatgcgaacctaccatgcatcattcacggctagaaccctccaggtgcggaaggtagtattttaataactttccatagctacaaaatattattacatagaagggagtgatttttttctaatatttatcctaaagaaatagtcaacaaacatttttaaaaacatcaattacagtcgtacctatactagcataaattagaaacccagtatccaacattgaggcagtgggtaaatgaatcgtggtttatcaagtcattaaaatcaatct

SEQ ID NO: 162228 - DNA, 104 bp, Homo sapiens
cggtacataccagttcatcaatggtagcaaacacatctcacgaatgtaagacgttaaataatcagagaaactgtgtgcaggctgtatggaactgtcacgagaca

SEQ ID NO: 162229 - DNA, 253 bp, Homo sapiens
tgtaccttgtagcctagccgactctgtcaaaggtaatcctcccagtgcaataatcctctgctttcaaaggcgaaaactgtgtaaattgaattttacagaaatctttcttaaatttcaaaattattgttatttaaaacgtatatttaacttatttttgcattgcaaaattggacataaaaacaaaccacagtctggccccaggtgaggtagggagaggattgttaggggaagtgtgcacagcccataataggcc

SEQ ID NO: 162230 - DNA, 267 bp, Homo sapiens
aggaataataagctagttcctgaaagccccttgtacagtgcacagacctgttcaccaaacactctggaccttccttcctccttcttcccatttacattttgcctgttcaggaaccagccagatccccttcactcaccatgagtagctggtgcactcaattaattctcctggaagcacatgcattttagaaaacgattttagagactcactcattcacttgattgattatttatcaagcacctattttgaatcagaacctatgttagg

SEQ ID NO: 162231 - DNA, 374 bp, Homo sapiens
gaatcccaactgcttcctcctgcccttttgattaaaagaacggtaagtcagcaggagaggtgctgcttttaacaagcaggggtgtgcagcaactgattggtatctttctttgaaaaaaagtagaaaagattgatgttaaacaacactaatcagagttgattacagggactgaatgaattcattgatgggaaagaaccatgcttccagagacaacaaaagagattagataattgtcaggggaagagtatttggaatagtgctgctcatctctgacaaccaggaatcagttcccctagctctttaaccattccttaaaataggcatatatgtgcaataagtacagttctctgctgggaacgttgttctcaccaagc

SEQ ID NO: 162232 - DNA, 349 bp, Homo sapiens
tgcacctgcctgtctgtgtgctcaccctcctgtaaggggtttgagctgtcgggagaccaaacagccgagccgcacctctgttagacacgtcctgcaaggggaatcagggaactcttggaagtcttctgtttcactactattttaaaccagttatggaggtaattttttattaaaatgttattcatgccttcttaaatatttaataaattctaattctcttgcagatataaagatcatctggattatccagtttatgaatacttaataaaataataatatttaaataatatataataaacatcaaaactgagtatgatatttctttttttttttttttttttttttgaga

SEQ ID NO: 162233 - DNA, 365 bp, Homo sapiens
ccgctagagcttaactatgtgggaagttttgcaaccttaaatacagcctgctataattattagacaaaagtaatgtttcagatttcagcgtggctcttatacagccgtacctgtatcagtgaaatgccttgctttagattgcacgacttaacaagctcaaagattcatgcaagcccgggattccgaactcccaagccattgttctttctatgacatcttcctgcttggtctacaaccaaccactttatccaaattcatactcaattttgaaatactcagataaagctttcaaaaatgctgtctgtgtctggctgagtgcacactcaatggccactccacataaaagggcacattaggaggcctgg

SEQ ID NO: 162234 - DNA, 519 bp, Homo sapiens
tgtcagttatttgttacaacataacgtaattacagtcctttttgcgaaaggctgatgaaggcaaaaggagaagagatagcagaatacaaataccttaaacaactggtttacaacaaagtaaagttcaattaactattccattctccaggtttttccgccggacatgaactccataatttggatacagtgtaattcacttaaattgctttcattttttatttgcaccaactgaatattgtaacatttttcatgcactgacatcaatacacaataaatgtgttgagtcattttctctagccataaggaaatatcagaatgctttcacagtatttctaaaaaaaccatattgctaaagcctttacttaatatgatgtgatcttttctcaactggttaaatgcccgttttccatcaggattgcacagacctttaaagcaatcaaagccatatcaaatgtccatccatcttaagatgaaggaacatgtattttctagcattaggaaaccaagtgattatcttaa

SEQ ID NO: 162235 - DNA, 176 bp, Homo sapiens
caatggcctcaagagctagactgcccaggcagctcatatttcatacagttttactattttaaataaaatcaatttgaaaaaatcattatgttgaagaataaaaatgtttaaatattacctgatttttttttctcatttcttttttcccttttgaccttcctccttccccatgcaag

SEQ ID NO: 162236 - DNA, 237 bp, Homo sapiens
cctgagcaatctctttaatctctatgaacctctcactgtaggcatgagacagtcaggatcctacagccccctacaactctcattttctctcagtgcacgtgtgcacgtgggtgtatcctgtacaagggtcttattttgctatggtagattcctccttttcccctcttgacataagtgaattttaaggtccttggagttcctcatcagagccagccaaccttcgtattgtcagttcat

SEQ ID NO: 162237 - DNA, 401 bp, Homo sapiens
atacattgtctgatgacataataggcttcttaccctaaatgagagtattcacaaagttttcgctagtgtccactcttttaatgctttccctttttctatcatttcttaaatgcttcacaaagaacacaaaatcaaggccacagcaaagacactgtcagctacgctgagtagcaggagcttgctgtcattggcagcagccctattcagagtaccctgaatttctttcattacttctgtatttagggagttattctctgttgatctagttaatagcaggatctgagtgaagccatctttcttcctcaccacagtatctcagtatctgtcggcactttgttagctttgtgctgaaacgcaccctcttgacaaaaggctggtttcttctgtcatcaataagcttt

SEQ ID NO: 162238 - DNA, 507 bp, Homo sapiens
ggccgttacaacagctcaagttacaacagctccagttacaacagctccagttactacagctccagttacaacggctgcagccacaacagctccagttacaacagctccagttacaacagctccagttacaacagctccagttacaacagctccagttacaacagctgcagttacaacagctccagttacaacagctccagttacaacagctccagttacaacagctccagttacaacagctcctgttacaagagttttggtatatgctttctcaaagatatgctgactatatgcaatttttgtctgttttaaagggcaggtctggggcaggattaaagggtagagagagggatcttacatcaaatcctctgggttagaataggaagtcagatgaaagttcatataaaccactggtgctactctgctgacaaacatatccaggagggttgacatgacctttccaggactatatacatcttacaaatgtaactcttacagtgaaagaca

SEQ ID NO: 162239 - DNA, 246 bp, Homo sapiens
tgggaatgagaaagcactgggagcttggccgttacaaaggcacacggggcattttgtacttggcacacacaagatcaggtacaccctaaaaggaagcagcaatggacagatgggagtttcacaccctgcttatagcattttctgtttaaatccagagggtcctgtatcctttgtgaatgctggcttttcttctgcattttgccatagtttttgcttttttcttcttgtcttcttttgatacatttc

SEQ ID NO: 162240 - DNA, 445 bp, Homo sapiens
aggggggcctggcacctcctggcgctgacggattgtcagcgggaagcatggggggaagtcctatacaacagcccctccaggcttcaaaacactctgttccatctcaaatcaccttcttcaagggttctcaagagagtttggatgtgctaaaatttgtagaacaagatgacgatatataacacttttacgaccttaagctaagtcgccatccgcccaccagagctatttatgcatcacgtggcactcctccccacaggcagggaccaggcataggcaaatgatcatgactgtccacgagcaagtcagcccggggctcaacgggggcactcatgacacaaaactgagggttgtgggaacataaaagcatgccctgctgttcctgagtggatattaggtaacgggccaaacaagcggcttgaagagactcaagggactgggacgtgtc

SEQ ID NO: 162241 - DNA, 425 bp, Homo sapiens
tagagaatagtgtcacacacttgtaaatatttatttcagttttgtttttttaaagttttttagaactagatcctgatgagtaatcatgttattttcaagcaataatttgaggcactattcttttaatgtaacttttattatttatattaaaccaaatgatatcattgttggtataatcaatatatgacagaatttgttactgtgaggaattttagaggttatctagtgtgagttatttttcttccttcatgccagcccattcacaagtataaaagatacatctttaaaatctccaggacatcagtcaattaattttagtggctgcgtcatttttcattgtagaactgtactgcatgatttaagcaggttcctgttaagtgacatttaggctgattcactttttcactattgcaaatggtgctttg

SEQ ID NO: 162242 - DNA, 630 bp, Homo sapiens
tagaagtttattttaacatccatctatgacccagcaactccacttctagatatttacacaatataaatgaaaacatgtcttcatataaaacttcttcaagactgtttaaagtagttttttccataatagtaaacaaaacaaaacaaaactagaaaacctaaatatccatcaataggagcatggataagcaaattgttaggtatatttatataatacaggactcctcaacaataaaaaacagtgaactactgatgcctgtaacatggagtgaaagagggctgacacaaaagaatgcatattgtatgattccatttatataaagtggttacattttataagtaggcaaacactttataacacaggcaaaactagtgttaaggccgtggaaatcagaacaatgcttgctcataagggtggaagttgacaggtaggggcatgaggaaatgattggggtgacagaaatgctctttatcttgtctaggatattattccatttgttcaaactcataaatttatatacttaagatctatgcatttcactgaatgcacttttttttttaattaaaaatattttagccccagccatggcaaggacacatatacaaattatagcacaataaaaaagtgacc

SEQ ID NO: 162243 - DNA, 914 bp, Homo sapiens
ttgcctcaccctcccgagtagctgggactacaggcaggcacacaccaccatgcccagctaatttttaatttttttttgtagagatggggtctttctttgttgttcaggctggtcttgaactcaggtgatcctaccactttgggttctcaaagtgctgggattaaaggtgtaagccactgtgcccagcagactgaaatcattttataactgtgcttttcaatgttatcttaaaattagctggggaagaattctgtttagtttttgttttttggtgtcagtctcatttaaaaattgacaaggaaatgaatggatttgtggtaactgccttttaactttgtaaattttaacctaatgtatgtttaaattatcagaaatagaaaattcagatacttctatacttactgacttattataaaaactgtgcctaaactgaaggacagaaccacttaaattattcatttatttgagaagaaattttctattttaattcaacaatgacttttttcactatattttcatggttgaactggctagagtgggtagttatttcaataggtgttggaaattaaaaaaagtgtagatagtttccagtttactgattttcttccaaaaatgtgtttgggacatagaaaatgttttgcagaagcagcaaggaaaatcatgtgatgaaggttaggccctaggctagagccagaatgtttcttaacttgtgccaaaatgtccaacatttggaataataatggcaaacggtgcaatcactgaaataaagcatgaaaaccatgcttaaacaagagggttcgttctatacttgtgttagcttttagctttagggggttttgtggatggagaaagaggagtggtgtaagggatctttaagattacttggaggagactggaaaaaatggattctttgg

SEQ ID NO: 162244 - DNA, 265 bp, Homo sapiens
gcatggtctcttccaggtcaagccacactgtagttatttgggggataaatgcttggctaatttatattcctttataactgtctttattaaagtgaagacccttgaccctgagtcagaatcacctggatggttcctagactccactcctacaaactgaatcagaatctctgggattggagcccagaaatttgcatttttaatgatcatttccaggtgatcattaaaataaaattgtattttataaaatttatttaataaaatgtat

SEQ ID NO: 162245 - DNA, 368 bp, Homo sapiens
atgaaaaaaaaatataaaatataccccccccccccccccccaaaaaaaaaaaaaaaaaaaaaaaaaaaaaaaaaaaaaagaaattgagtagtattagctttttattaattcattcagcaaatacatatgacgcaatcacgatgtatcaggttcactcctactagatgtacatgaacaaggcctttccctgaaggaaaagtggaatagacatgagattaagcatgcaaattacagcctcttcctcagagagctgccgatagcaactaaccctgacaaaagtcaatcacaatatcagttccttcctctacagagtgttaaaagtttctcggctgggtgcgatggctcacgcctgtaatcctctgtaatcc

SEQ ID NO: 162246 - DNA, 337 bp, Homo sapiens
ggaaaaaaaaattttttttgagacagaatctcactattttgcccaggctggtcttgaactcctgagctgaggcaatcctcccgcctcagcctccgcagtagttgggattacaggtgtgagccactgcacctggcagaggtcagagactctgtgagcaagtgacttcctaatactttataagacttaagcctaaaatgagacagacaggcctctaaaccttactaagtagaggagggagtggtaggccagctcctaataggaaaaagggagagaaagaggctacacatgtcagtttgtccttccagattccccatataggtgacaaggggaacaaggc

SEQ ID NO: 162247 - DNA, 557 bp, Homo sapiens
atgaaaaaaaaatataaaatataccccccccccccccccccaaaaaaaaaaaaaaaaaaaaaaaaaaaaaaaaaaaaaagaaattgagtagtattagctttttattaattcattcagcaaatacatatgacgcaatcacgatgtatcaggttcactcctactagatgtacatgaacaaggcctttccctgaaggaaaagtggaatagacatgagattaagcatgcaaattacagcctcttcctcagagagctgccgatagcaactaaccctgacaaaagtcaatcacaatatcagttccttcctctacagagtgttaaaagtttctcggctgggtgtgagccactgcacctggcagaggtcagagactctgtgagcaagtgacttcctaatactttataagacttaagcctaaaatgagacagacaggcctctaaaccttactaagtagaggagggagtggtaggccagctcctaataggaaaaagggagagaaagaggctacacatgtcagtttgtccttccagattccccatataggtgacaaggggaacaaggc

SEQ ID NO: 162248 - DNA, 684 bp, Homo sapiens
tattggtcaccgtggctcccgtccccaggtggaagtgtggctgaatcgagtgctggaccgaatgtgctctaccctccggcacgaaatcccagaggccgtggtgacctacgaagagaagccgagggagcagtggatcctggactacccagcccaggtctgaggcgggtgggggctcggcggcgcctcgtggctgagataaggggcgagtttctttgcgttcatgggctccgctgttaactgtggtcccctggaaaaccatctaagctttcagcaggaatgtctgcgttagcaggcgccagcgatcgctcactgcgtgggcaatggggggtatgtactttcaggtggccctgacttgcacccagatctggtggacgaccgaggtgggcctggcatttgccaggctggaggaaggctatgaaaacgctatcagagattataacagacaccttcagaaatatgtactttgatttctcgcctgaaaattggcagatgctactgagagtctttaaaaaaaaaatgtccttggttagaaatatggaaacaaaagatcatcttgaaaagaaggagaatttacctgtaattccacaacccaagcatgacactgcagggcccttatgcaacctgttactctgtgtgtgtataattgatttatatgtaaaaatatacagactctggatggcgtta

SEQ ID NO: 162249 - DNA, 181 bp, Homo sapiens
tatttgccatcataacccatctgttttctcatcctagaaccctggcatcatacttgacacttcccaggggaaccaattcattaccatattctgtccattttactctgaaacaaatcttgatattttcatccattcccttaatccaagccaccattactttcagttgggctaccatgttagt

SEQ ID NO: 162250 - DNA, 120 bp, Homo sapiens
aagattcccattatcctggtgtacatgtccgtataaatgtcttccccttcagtgtgggcaagacttgtgaatatatagtcggccctctcaatctgcagattcaaccagccacggatagaa

SEQ ID NO: 162251 - DNA, 568 bp, Homo sapiens
aaattatagcgtatcacctaagctttaatagcttctgattttgttctaattttcccaaatattaggtggtacgccagatactgtttaagtgaaaaatcatttggttaccttggctatcttaccaactttttaagagacctacattgatgataaacctccagaaattggagattattgtaggaaacccaggtccatttagtgttcactgatgccctttcagtttaacttttctcattttgatgatcatcagcttcctgttctaaaattaactggcaaatcattctagcatctcccttcagatagaattttgtgttaatgatttttctaagtgtttacttggcagcttggttttacttaaacattccttctcatgcaggttccatgatgaagatatttctaaaaacataagcatgcttctactttagttatcactttgaatttgatttttaaggtatgtgggcattttgtgtttgaaatgcaatgcaaagctgtccgtaaaactgacacaaatagatcacctgatattttagctgtcttcatgatggaatcatactacgctggagcaatt

SEQ ID NO: 162252 - DNA, 546 bp, Homo sapiens
gcagacagcaagtcctgcctccaatgctaatcagtgttgaaggaatgaagtagatggacttgtcccagagcacccggcaatgaggggtggcgctggaagggagctccagccccataactcacaccggtgtccggccctcctcgaccccattctcttcccttgaggatgtctctggaccaggatggccggaggcctgttgggtggcgagggggactggctgctgcgacggcgggggcaggggaaagggcctgttccccaggacactgggaggatatttgggggaaagccccgcactgggttctccccattttgcccgctcggcttaggggctcggagcccggagggagctcgggcgtctggccgccccctgccgccttcgtcccatcggccccgaacggagaaagggcggccccagagagcctcccggggtcggcggcccctcccgcgcgcagccccgacggccgcgcagcgccctctagtgccgggcagcggggcccgcgcggtccagcccgcctgcccgcccgcggctccgcttcccgcggccgc

SEQ ID NO: 162253 - DNA, 437 bp, Homo sapiens
gagaaaaaaaaaagaagtttgtgagggattcctaagaaagtgaccgagggagaggaggaaggggagagttggaaaagttaaatgattcacttgtaagctactagaactttgttaagtttggggacatcatggttttgtgaaatctactttcgctgaaatttatgtccatttctttgcctccttctctctgcacaccgcctctactcagaaatttaaccatttacacacaacagaaagaattttcctcaagatcgctacttttgtccagtatttctgattgtctttctgcttcaaatctccagaaaatgtattccctttaacaacttaacttggagaaggaggaaagagacctaagcagatatgactccacctaagttttatgaggaaccttcgaaggaaactctgagaaaaatgagtctgtatctttttctccctct

SEQ ID NO: 162254 - DNA, 199 bp, Homo sapiens
cctgaatttgtattgctctgtttttaaaggaattttgtatttttgtttttgagtgagattggcctataatttttccttcttatatgacccttttcaaattttgaagtcagaattattctagctcattaatgtgagtggagcagcattttctcagaaagaggaaacaatgtcggtctgtttcagatgacattttattaat

SEQ ID NO: 162255 - DNA, 202 bp, Homo sapiens
atttgtaattagcgatacctagaagtgatttggctactgtaccacatcaattttggccacctccagtctctggcaatactattttgtgtcctgggagcaattcttgtggatatggagaataaaggttattgatagtgtaggggattttcaaagacattaaggaaggctaagaggttgcattggctgtaggattggaggccta

SEQ ID NO: 162256 - DNA, 415 bp, Homo sapiens
tgcatcaccagtaccaaggaaggtgataacacctcctttccaggtgccttttcctagctgggatcttcactcatctctgaaccccctcacagaatccacgtcagataaagtggctgtgggagccaggagagacccagcagagacgatgggtccacctgagccactgcctccctctgcctgaaagcccagtgatcccttctgcttcactctgaggcccttgcagttttcagcaggacaaagaaaaactgtgctttgagttaagacacttgaaaaaaagttcatttgcacagggagtctcagggactcctagccatgcatcccaatacctgcatcccaagggtaggaacacagctgtaagttctgggttcagagcctcacaccatgctggggagagcggagagccggggcctcttct

SEQ ID NO: 162257 - DNA, 342 bp, Homo sapiens
tttaatattctcataatctagaagctattctctacaatgataaaataatccaactctcaggcaatactgagcaaaatacaacgtaactaatatctcaacatacttgaccctatattttatatgaaaataaatgaggtcaggcgcaaaggctcatgcctataatcccagcactttgggaggccgaggcgggtggatcacttgaggtcaggtgttcgagactagcctgaccgacatggtgaaatcccgtgtctactaaaaaaaaccacaaaaattagccaggcgtgttggtgcatgcctgtaagcccagctgcttggcaggctgaggcaggagaattgcttgaa

SEQ ID NO: 162258 - DNA, 166 bp, Homo sapiens
ttttatacagaattctttacataactctcatttcagaacatcagtattttatggagcctagtttttgaaaatgctaaactaatatctggaaagaaatactgatatttaaatcctaggtgcttgtcatctactcagacagatgatgaagcagctaaccttcatttgt

SEQ ID NO: 162259 - DNA, 517 bp, Homo sapiens
tgtggccactgctgggagaagggggagggctggcattggcacttcaagactgtctttcctattctcttcaatgtctctttcagtgatatgaaattaaaaccagctactgtgaatgctcacctgatttttggttatttgagatggctgccttttgtatgtagttagttgttaaaatttgatgttcctcctgggggtgaggggggtgacaaacagtgtaggcttcttctattccatcatcttgctctgcccctgtggctgctgccttagttcagcatgccaaagtgccgtattttggggtattgttttcatgccctaacagttccttgtggcagcttttgtgtatctctaatctaatgcttgtctcattggatcatgtttgtttacaaggatctagcacctactacaagttactgccctaggtgcaagctcttccgggcatgtctttccgttccctttcaatccctctggcttagcccttgcctccctagccccttccaaaactgccttttattgctga

SEQ ID NO: 162260 - DNA, 566 bp, Homo sapiens
tcagggtcctggggagggagatgaatactcctgcagcaccttcaatctaacctgaggtggagtcctagcctctaacagaggacaaacaccctttaaaggctagaatatccagttacatgtaggctgaccagattagcatgagctgcctccagtcgaaggctacagacaactaaagacgtaacaactcacaagaatcaattcatatcccttaggtaaatagctccagcttcttctagaaacttctacacctctattttgtcatctgtgaaatgcagatacccaccatacaggatcactatgatgattaagtcagatctatgtataaaagatccttatgaaatacagagtgctggacttctgttaccagtgcttcctgggtcttcactaaggctgtaggactggattctagctctgcttctcttggctactaccctggataattcaggcttggagtggtctgtctctcaggaagatgctttttccctttttgctttagttgggacctaagtggctagaggcacctgttttttgtttttgtttgtctgttttgagacagagtctcactc

SEQ ID NO: 162261 - DNA, 392 bp, Homo sapiens
gaaattggcacattagactctgctacaaaacttacctgtttctgatctctcgaaatcaatgaatctcattattattcatagctcttcctttaaaaaaaatgaaacacatcatttgcaaaaagaaaattttgtcccatgcagtctaggttgttccaggagcttactgagaaactacaacagccctctgaggttaactggtactattcactgaactctcaagtttctgccttgtgaatctggtggtgggaaatttggctgtagtaaagaaggagcctcacttgatctctgcggaaatcattgagaattacaagtaggatgcttcatccttgtttaaaaaatagaagtaattgtttcttttggaagtagcatgctatttatttaactgcacaagt

SEQ ID NO: 162262 - DNA, 436 bp, Homo sapiens
tgtactggtagataaggaaggagggggatgctgggaatcacagtgacgttagagaaatacggtggcttgcaagcttcctagatgtggctttaatttcatgggtaaaaatttttttgtcactttccttatcacttttgaactgccaaatggttaaacagacgaatcctaccctgccccaggcctctttgaacaagtgtagtaaagctctgctctgttggagttgctccatgccattggcctgagaacccatctatgtaggaacagtgtccagtgttcttgtggtaccaaattgtgccattggatacaataatctgttgagtctgggtgggataagtgatttgtatttgttttggtttaaaaacatactttgatagaaattagtccctttcttttccttctcttctacaatgtcaattgcccatttcatttgtgtgtt

SEQ ID NO: 162263 - DNA, 399 bp, Homo sapiens
taaaatctagacagttatattataatgtgataacagaggtatttaaattaacagcagcaacaagatttgatgctgggattaacaagaggagatcttcattatctggctatgtcaggcaaaccagatatcagcagatttggcggggggagagtggtggctggaaggaaactaattagtggcccatgttaattttctataatgctcagaataactagataataatattctcttcatttcttgtcatcgcagaatcccatgacaatatctcttgagttgtaatttttgtgtgtgtggacaatcaagtcagattcaacaaatattcatgttatctattataaccaagaagtaaaactatagtttaagaaaaattatctgccattatattgtgacttgacaact

SEQ ID NO: 162264 - DNA, 124 bp, Homo sapiens
tactctgattaaagccaccaatttattgtggtttgcaatcttagttgagcttactctgctgcctatcagttatttgtctttttttgctggagtttattctttctcagcacatattccagatttt

SEQ ID NO: 162265 - DNA, 349 bp, Homo sapiens
agccatgggatgctatgtgaaaacggttccaccatccagtgcaggcaggagttacaaagaccagaagcaggtgggcagggtatgagatgtcagctgaaggctgttgctatgatcccagagaggcaaggagaaaggcctgactggaaacagtggtgtcacagatggaaaagggaggatctggggtagctagaatgggcctgcggggagaacgagaaggagagactccaggcgtagatgttggttcaggtgtgttggcgacatcagtaagaggatcggggtgcaaggagaagacgggacgctgcgttccaccgtggaggtggtaaggctgaggtgcccgcgctgtgcatgc

SEQ ID NO: 162266 - DNA, 336 bp, Homo sapiens
caggtttgcactcggaaggaccactgtgggctgtggagggagaaagaccagaagcaggtgggcagggtatgagatgtcagctgaaggctgttgctatgatcccagagaggcaaggagaaaggcctgactggaaacagtggtgtcacagatggaaaagggaggatctggggtagctagaatgggcctgcggggagaacgagaaggagagactccaggcgtagatgttggttcaggtgtgttggcgacatcagtaagaggatcggggtgcaaggagaagacgggacgctgcgttccaccgtggaggtggtaaggctgaggtgcccgcgctgtgcatgc

SEQ ID NO: 162267 - DNA, 506 bp, Homo sapiens
cttacagccgcttcatgaggaactgctgttggctccattttccagattaagaaaaattttgaataggtcaattaaacccaaagtcagaggtgataagcagcagagcaggaatttgaacccaggccatgactccagaatccactgttggctatttcgccctggagacccaaacgggagtacacaggaagatgcccaaacaaggacatgatggtgttacaaaagctttaaaaactcagaaccaagtagggggaaaatgctgagggttacatcatcctcctaaaagagatttatcagtgtgcccctgaactctggcccgtgataaacggtcgtggcagtaagataaacagaacaagtacacagcagatcggctttgctgctaaagggggaacacattctaacattcctgaggcgcactgtccaagggcaggccaggcaagaaacacacgataaatatccaaggcatcaccccatccaccagctgctgccgtggctggagacgcagtcca

SEQ ID NO: 162268 - DNA, 243 bp, Homo sapiens
ctggtcttgaactcctgggatcaagtgatcagcctacgttggccttccaaagtcctaagattacattttattttattaagtagtttaattaatttatatttaaaatgattgcttaaagaaatgaagttgttatttccagttacgttattattgttttgtgtgtttctagtagttttatttttctcatttcctgttttactttcttaatttttatttaattttgtactggcatgcattattttt

SEQ ID NO: 162269 - DNA, 109 bp, Homo sapiens
tgtatgaccttgagtaagtcacctaacttctctgtgcctcatccataagatggggatactaatattatttaccttatagggtttaatgtgatgattaaatgatttaata

SEQ ID NO: 162270 - DNA, 456 bp, Homo sapiens
atatagccactagtgggactcctggctcacacagtagttctatttttaattttatgagaaattagaaaagcatgggggtggacatagagaagactttataaaagaagcaaaaagtgtgtccaatcttaaaagatgagtagcatttgaagaagtaagacatgccaaggaggatattttaggcaaaaagataggtatgaagagatctttaaaagctacagactgggaaaccaaaaactgaactttgcaggggcagtaagaaaactggtgtcaccagaattaacattcatactgaggactagtatgacactggataggcagcctagggctaatttatggaggtcttaagtaacaagcatagaagttgagatgtgatgggtaatagttcataattcagcataggttcttaaggaggcaagtaacataattaaaatagtgttttataaatggcaatcccac

SEQ ID NO: 162271 - DNA, 137 bp, Homo sapiens
acaaacaggtgcttgttgaagctactagacttgatgagatcactagagtaaacacatagaccggcacctcttttcatggccagatttcactgtaaagtcatagaaagtatgaaatgggtttgtatttatttctatat

SEQ ID NO: 162272 - DNA, 242 bp, Homo sapiens
cagtggaacggtaaaggggcgggtgcagtagggattgttgtcctaaatccttaatccatgagacacctctgtgaggttgagggagtgtggggcttactatttaatataccaggggctcccacgtaaagaatgtcaaccaaagcagtgcaaaaacatttggtgtattttgagacctccatgaatggccttctggcccaccacacagccctgatggtggggggcaggagagcccatggcctccc

SEQ ID NO: 162273 - DNA, 141 bp, Homo sapiens
ggtttggggagacctggggagttgtcatcccatcctctccctcatctctgggagagggatattatgagaaacgtgaactgagaggcccctgggaaaccactggttacccagtcctccctgaacctggaaatggggatgcaa

SEQ ID NO: 162274 - DNA, 525 bp, Homo sapiens
gtgacaggggactgcagtaaagaaatgggtaaaatttcccatttttagggaagttatgttttaatagggagtaagacaataatcaagtaaatatgaagaacctcaggtggtactaagagctatgcaaaaaattaagcagacagatggatacattttgggatttgtgagacagagaggctaccatgtaacaaaatgctcaggaaagacttcactgataaattgagacttgaccaaagacccaaataagttgagagtctgagccatgcagacaccttaaggaagagtgttcctgatgccattttattttactgtaatggcacttgtaaatttctgcccaaaattatctctcttcctcaatcataagtgttatttaccaaaagcccaccattgtgcagaactgccatccacgaagctcaaatataaaaaaatcaaaggtagaaatctgcctagcaaagtgagtgacaggagtttccatgtcacttgttatgacgatattaataacaagcatttattgaggacttatta

SEQ ID NO: 162275 - DNA, 424 bp, Homo sapiens
cacctgtatggtttccaatcagttttttaaatgttctgttcttaaagtgggtaacaacaaaatgcagacatgagcaatgagtaagggggatggaagaccaggtgaatgtgtttctgcagagaggggacataagccagtccttccaacactgtccttagacggacaaagaacctctgcccctttccttcctgcttctcagaataacaatgtgagcatttgggctgctctcaaaccctaaagggattcaaagtagccaacagtcgggtatcctctccttctcgaggtatgggtctcatgggtctcggtgcatcaagccaagaacagaaaggatccaatcgactgtccccatcacttctatttgaattgctgggataattcctacattttaggaaacagacaacctctctaagtgacacagtgtaac

SEQ ID NO: 162276 - DNA, 579 bp, Homo sapiens
aatcacagattatagttgtagtttatgtcagaaaacagactgcttcttactaagtcttatggcccacataagatgggaaagggaattattttagtttttaaaaaatcatatgtatcaatcactttttaaacatttcctgctttaacaagatttttaaaataattaaactaccaatcattggtcctaatttcattaaagggcttctactacattaagtcttcccatttaaaaaatgttacttgtctctatttagaccatcttttaaatctgtaagtaaaggtttagtgttggtctaacagatcttaaatactgctggtaagatttattttcccttatccatagggatacattccaagacccctagtggatacccgaaaatacaggtagtggcaaaccctatataatacacccacacacacacacattttttccctatacatacatactgatgataaagtttaatatatactataatacaagttatgtgaatgtggcttctctcttaatatatcttattgtattatactgcaagtaactgaaaccatggcaatcgaaacctcggataaggggagactactg

SEQ ID NO: 162277 - DNA, 422 bp, Homo sapiens
ttccagtttatgaatgaaagcaagtgaaccttaaagcagcatttaaaaaaattgttgatggatgaaggcttattagaagatataaatataaaaatcttgctcttgttaactttcttttttggatttctgtgccccagcctccctcgcatttgtgtgcctgatgtgaagtgcatacgccctggagctgcacagctgtgtttggcttcagctttgtacgcatctgtctatgtgacccttttgacctcttggagccctggttttcatgcctgtaagatatggcttacaggaagaatcagagagtcatgtttgtaaagtgtctcacatggcccagcacatagtaggggttcaaataaaatgattttcctttctttccaatctcaccttcagccactttactttcgagtgttgcctggacactatat

SEQ ID NO: 162278 - DNA, 488 bp, Homo sapiens
aatccggtttcacaaaagatatgtagatataaaaatgatttgtaatagcacatctatattgctgatgaaatacattcataagctgttttgtctatacatatgcatacattcaagtaacagttgaaactgctgaaactatgtcagtatattttggcacatattatgaattgccatttggaagaaaaaaacccaatattaaaaatcttttcttataaaagaatataaggtctctctctcgttagtcttgttagtattattttttctcccctaaggaaatccaacaattatgttgggaaatcaaggcaaccttcaaaccagggaatctagatgtacaggaaacaacaggtagattggcaaaaagataaaggccaatttaagagcagaattaatttcttctgcagtgaccctagatcaccacagaaggggcaaaagtccagaacaactggcagtaacataaaatccaaaaacacagttgtttgaaagatggc

SEQ ID NO: 162279 - DNA, 453 bp, Homo sapiens
cgctctaggaggatccccaactcagggcgagctgcctgggggtcaagcagctgcgactccaaggagtcaggcagggtgtccagggcctggagagccaggcccggcagccccagaggatcagcaagaggttgcaggggtggcagctccagagcttccccgagcggctctagtgcctgcgggtccaggaagcggggctgggggtccaggagctgaggctccggctcgggcgatggtggctcgagggcctgggcctctagcagctgggcctctgggcaagtgagggaggccagctcactaaggatgtcggcgtcagcaagttctgagtaatcagtgctgtctggctcaggctctgggggcagacccgtggccgcagccgtggctccgggactatggccttggccaggctggggactgtccctaggctcaggctcaggctcgtagaggggatggctg

SEQ ID NO: 162280 - DNA, 344 bp, Homo sapiens
agcggtcacccacacgcgaagtcggagcggcccagaccatcccctctacgagcctgagcctgagcctagggtccaggaagcggggctgggggtccaggagctgaggctccggctcgggcgatggtggctcgagggcctgggcctctagcagctgggcctctgggcaagtgagggaggccagctcactaaggatgtcggcgtcagcaagttctgagtaatcagtgctgtctggctcaggctctgggggcagacccgtggccgcagccgtggctccgggactatggccttggccaggctggggactgtccctaggctcaggctcaggctcgtagaggggatggctg

SEQ ID NO: 162281 - DNA, 441 bp, Homo sapiens
caattcagtgtcattaggtacattcgcattgttgtatgaccatgactgctatccatccccggaactttttcattatcccctactgtaactctgtacccattaaactgtaactctccattctctgttcccctcagcctctggtaatcactgtctatttctttgaaagtggggttgtataatacctgttcttttgtatctgccttaattcacttagcataatgtctttaaggttcatccatgttgtagtaccatcatgtgttgcttaacgatgaggatacattctgagaaatgcattgttaggcaatcttataattatgcaaacagaatatactaaccaggctgtatggtatagcctcttgctcctaagctacaaacctgtatatcatgttagtatactgaatacagtagtcagttgtgactcgtggtaagtatttacatatc

SEQ ID NO: 162282 - DNA, 399 bp, Homo sapiens
aagtattcctgaatttggtgaagggactatttaataggcaaacaaataaaaacatttgctgcatttgaatttcatatgctctgttttgcatcatctgattgattaaaaaagcagtgtttctgtgttctttgatgttattaaaacggatttgggttttccttgcacagttattctttcagaaggtgttaggaagtatgttataatattttttttaaagtttagttatggtcgtttcttagcttgtgtcaattattttctttttgcacacttagaaaggcaaaagaaaaaaagaatatagttctaatcataaaaaggtaacaatgagctttaagatataaacctgcattgtaacccaagtaagtcaaagtcttcaaataactttgtatacattgagtcaaa

SEQ ID NO: 162283 - DNA, 568 bp, Homo sapiens
caatctatggtaggctaacttgttagcatgtaattaggagggcaaaatctcaagattctttacagttcttgacacataaaattcaggatgatttcagatttttttttgctttttgtgtaaactgtcccacttgatcattccattttagtttgaaatgacaaagacattattcacttatcataaatatattttatctttttaattagtatgggtcacctgtaactattcacacacaatagtctctatgatgtagcatgaatgtgtacggcatgtgactacagaagctcaacaagtttggatgccttaatttgccaaaaatttgaaaacctgaacttactggatcttaatattaaataatatagttgaaccagtataaaattaatttattaaattgttcttttcaagtatagatttacatttcctctttttagtccaactctttgcttcacaatttgctttcacaccaataaggagagatttcatatcagaggtttatttctgtgactttgctcaattgtgctgcttctgaattcgttatcagacagcctatatactttattgtagctaa

SEQ ID NO: 162284 - DNA, 234 bp, Homo sapiens
cttttagagctatttggctaaaattaatccacacaatttacgtttaccttggatttgtaggcagtcatcccacatactcaggagttcttgtaaagtgacaaaatctaacctacaaattgtaaccacttttttcaagataaatgatttcaacattggtaacaaaaatcactaaattataatgctgatcttggaaaagacagacatccaggcagaaactggctgggaaacccggag

SEQ ID NO: 162285 - DNA, 557 bp, Homo sapiens
tcgatctagacgatccctcataggttcgcaggtatagaaggaaagtatgacttgagtctggaaaggtcaggactgtcaccactcttcactgaccttgagaacaattcccagcccagcccttcctagcttataaaaacattgtgaccttccatatgtcagtagtgtttctgctatctagttgttcatctcactggcgaacaagcgcgcagcctgtgggaagctcccaagttcctcgggccctttttggaagagcttctaagatatatgttgtatggctgcctacagcccagggggagtgcatttttacaatcattagcagtgaccttgtgaggtgtaggtgctattattcctggtccggggaggaaatcatgtggtcggtccagccctggctgttaggcctgagcccacactctgagggacctttttgggagcaattggtttacatttgcttctcaccagataattaactagttaagtgctttaggatgcttagttactagctcctttgaagcatttcatttgttttcacctgggattgacctcctgcgaacctatga

SEQ ID NO: 162286 - DNA, 281 bp, Homo sapiens
gaaatggtcatcttttctcgatgccaccccagcgagcagccaatggataaggccagccaataatcccaccactaagctcgccggcactgaaatggccaagctggtggttcaggagagctggaagcctggctcaggacagagccctgggaagttgagtctgcaaacatgccctcgggttcttgttgacgagcaaagctcagggttgtggggacaaagaccaggacttaacaaatatttaagacatctttgttgatgctgggattttgtggcatcgataaaca

SEQ ID NO: 162287 - DNA, 271 bp, Homo sapiens
cctgcttttcacttggcctccactgacactgggatggaggggtggttaagttatcactgagcagtgctttgagtttggattctccagtaggcctctgctgtcatatctctgtagagggagggatagggatatgtccttatcattgggtgggtgttgaactcaggctccccactttttttccacccacactctagagggaggaagccacgttactgctcagtgggtatgagtgtcctgtgtccccacttggcctgctgtggtatcatgttgt

SEQ ID NO: 162288 - DNA, 178 bp, Homo sapiens
gttccatgtaaaggctccagaatcagaactggcgtcacaccttggtgtcaccccttcctgctgagcctgtctccccaggagtgaaatgagggtaatattcctcctacaaagggtgcggtggtgggggtttacatgaggtgggcgcatctgtacaaacgtgtttatcattgccagctac

SEQ ID NO: 162289 - DNA, 222 bp, Homo sapiens
tgtcagccgcatcctgaccctttggccactctctcccctccgaaatcctctctggctccagtaaggcttttctgcatattctaccacccaggccatgcctgtctcctatcatcctccccctccaccatcatcttctttccatcgacctcccaaaccaacttctccagccctccaagcagacgaccctcatacttagccctctccccacctgcctatcagcca

SEQ ID NO: 162290 - DNA, 511 bp, Homo sapiens
gttcacattaacatcaaaaggaataaaatattttgaaataagtttaaccaaaaagtcaaatgattataccctgaaaactacaaaagattgctgaaacaagttaaagacgatatcaatatatggaaacacatttcattttcatggattggaggaatcaatattgttagaaagataatattcccaaagtgagttgcggattcaatgtaacacctaacagaatcccagtaacattttttgcagaattagaaaacactgtcctaaatctcacctgacaggctcttattaatgactgccacaacagatacactgagaaaaagaggcaaccatgaaaaggtggaaagttctgatgacatagaaaatagcaatcagcctttctcacatcccaaggccttcaaaaatatacaagtgcagcatggccagtatggaattcaccgaaaactaatcaccaagctagaaaagtggtgagagaaaaaaaaagggcaagaatatctttggcttatcacctcccact

SEQ ID NO: 162291 - DNA, 407 bp, Homo sapiens
tcctgtgcttctttcctaaaaaatcttgctgaaaatgtccatcaggatattagactgaaaacagatgtaactatatctaattttctctgacaggaaatcagacatggatgtcatcatctcatctacctatccctaatctattcttcatcctcctcaataaagtaaagccacatggtataataaaacatcaaagtggtataatatagctgtatttcacatggaaatatgcaattccttaagctcttctccaagattttgtattgtgggaaaacaaactatgtgggaattattgcattattgatttttgattaggacttagcattatgaaaagtttcattgtttactataaagatatttcatggcaaatagaagtatgctgttgtaaaataaactaaggcagattagta

SEQ ID NO: 162292 - DNA, 262 bp, Homo sapiens
ggagattttcaggttgtttgtgtgcttagtacaaatatatttatatacagccacaggtattggggcttgctaatttaggcttttttttttaaataaagcaagtgttttattttcactttgcaataaataacaacacttgtttgttcctttatttcaactacattaaaattaaggaaaacagaactatcatctctaatttccacagtgtttgatatcatttgatttctgtgctttcatggcctgctggtagtggttgttggta

SEQ ID NO: 162293 - DNA, 151 bp, Homo sapiens
aacgcctgtgtggttcaagggtcaactgtatgctgaagccatcttttgaccgtctgtgctctccaccatctatcttttgttgttattcccctttttcatgtacagtacaattcccttttttggtgtacagttctatgttctgacacacagt

SEQ ID NO: 162294 - DNA, 243 bp, Homo sapiens
cgacatccggcctttgcgttctctccaccagctcccggctcacccacccagcagctcagcacctgcgaaatccgtctcccgatgcacacttgctaaccgcgtgggtgtgagcacaacgatgggaaacagcggaagtccccggagtgcagactcaggagtgaacctgcctgaagagtggcgtctaacgcacacactgtggtcagctccaccccactatgggtcccgggaataggagcaagtatg

SEQ ID NO: 162295 - DNA, 274 bp, Homo sapiens
cagataacctcagcccaaatctgtgccttcgactctagactctacctacttatttgcctactcaacatctgtttggtgtctaaaccagaatctcaggcataagacgacacaaaaaaacaaaattcccgattctcttcacaccacaaacattttgctctatagtcttcctcatctcaataagcaattccagctaatgcctgcttcggcttaaaatcgtgccccccacacacactcctaactcccgacaggatctcgctttgttgcccaggctgga

SEQ ID NO: 162296 - DNA, 592 bp, Homo sapiens
ttctgccagcagggttaatccaaagagcaaacagttgcaattttaaaattaagatggaatactcagaaaaaagaattctagagagtcatctgacactaattggtagctacagcatgacaacacccattgggaaacatggatgcaggcaagacaaaattcaaaaggaaattatctgatattgacatttggtgaaaaccaccgatgttccaggttgttcctatcacgttattgaactgtgaggctcttgttctgcctctgtttctctaagtctccaaggtttctttttgtgccctcctgaaaaaggagctccgttttcttctcttaggtttcacaatggccaaccaattcaattaaactcttaagaagggttgcaggctttcctccaactctgataattgacaggtccagttttcccactttggtgggcatcaggaccatgtgggatgcgatttaaaaacacagatgctggccccaccccagatacggcacatccaggagtcgtgcaactgtgtctgtgttgggaacaacagctctgctgtgattccaatactcgtgcttggttaaaaaccaccgtttttcccctgtggaaata

SEQ ID NO: 162297 - DNA, 1046 bp, Homo sapiens
  misc_feature (869)..(869): n is a, c, g, or t
  misc_feature (962)..(962): n is a, c, g, or t
  misc_feature (1046)..(1046): n is a, c, g, or t
aggactgtctgcatctgtgtggtatttaaaccttaggattaagtgagatgaacaagacagggacctgagacctagctcttctgtgggtggacattgaagggtgcagcaggagaggtgtcctccgatgcctgccttgggataagaggaatgggattacaggagccaagagaagtcctgagtttataggaatcggggcctagaacaatacccggcatcgatagaggaaagagaatcagctgtgatgctacggagagggtaagacaggacaaggggattgcatgtggaagatagagaaatagagtatgcgcctgtggcagagtttttaacactgttttttgttcgttttgagatggagttaatgttgcccaggctggagcgcaatggcgtagtctcagctcactgcaacctccacctcctgggttccagctattttcctgcctcagcctcccaagtagctgggattacaggcagccgccaccacgcctggctcttagttttgcatttttagtagagaggggttttaccatgttggccagggtgatctcgaactcctgacctcagatgatgcacccacctcagcctcccaaagtgctggggttacagggcaagccaccatgccgtttcttcatattttaatgtaacagaaaaatcacgtaacaaagtttctggtgatagacaaaagactaacccatttggaccatttggacccaaaattctggctagggattaaccggtgggtatcaatggtggctaccttaacatgtcttcaaacaagcatccctcctgtgtaacagcatttaatgttcacctgggggttatgtttcattttccagggaactgtaagttctaggttggtcagagtagagcanaggacagcattagaagcaggcatatgagatatgtgaatacagctagtggctgcttggttgaaaggaggcattgacttcagcaacacaattatngttttaataggaatgtgccataccgaatccgtgtgcggctgtccagcgtaatgaggatgaagattcacctgctatatctttgtn

SEQ ID NO: 162298 - DNA, 1144 bp, Homo sapiens
tgtgcaagggtgaactgtactcttcctccctgcttgtacaattattgcagtacatgtcacgaagtcagataaaattatggcatcttaagggttggaaggaaacagaagttctgttgctcagcctcacaccaaagcaaatccagaatgctcacaacagggagtcaccaaattacagctgaagttcttaacaagaaaacatactaccccataaacctttctgttttaagtagttctagtttgaccttttttctcctatttgtgaattaatgtagctccccattaccacacttggtcctaggtttttcattcacattacagaagagctgttatatctcatgccaagtcttcttttttctagactttacatccataatcctttattcctcaaaagacatggtttccaaagccttcaccattatttgccatttagatgtgccccaatttgctaaagttccgcttaaaatgtggtcacttgcataagttagcatgcttctgtctacaagtaaaggaaaagccaactaaaagtgttaccctattcacataaggaaacatctggcgatggggtggttccagatgcttactgatgatgacggaccctagctctttctgtctttcatctctgccatcctcaatgcaggggatttttatcctcatgttcatggttgcaagcagcttctagcaaaacctctttaaacataggcacattcaaaggcagaaaaaactcattttcctcacacttttctttttaagtaaatctctcctttccagtaatggctcagttgacttccctttacatgtcactgtacctgaatgcatcacattccctcctgaaccatctggttaagataaatcaccctgggctgggcgtggtggctcacacctgtaatcccatcacattggaggcaaaggtgggtggatcacctgaggttgggagttcgagatcagcctgagcaacatggagaaaccccgtctctactaaaaatacaaaattagccggttgtggtggtgcatgcttgtaatcacagctacttgggagtctgaggcaggggaatcgcttgaacctcggaggcgaattttgcagtgagcctagatcgcaccattgctctccagcctgggcaacaagagcgaaactgcatctcaaaaa

SEQ ID NO: 162299 - DNA, 394 bp, Homo sapiens
tacacagaataaggaagctctccatataccaaattgaaaagatttctaggataactgttaaatgagaagagcaaaattaaggaggcagaccagtgtttataggatgttacctttggggcaagaaagggaataatacgaataaacatttggatttgcttgtatgtgtgtaaaaactacgaggagaatacacaagaagctaatagtagtggttatggttaggaagcagggtggaaaggggtgaaatgtagtaaatggtacaggagtagaagcaagacttccccatgtatatctttttatgttattttgatttttgaaccatattaatatgttatctagctaaaacaattctgctaaaaatttataaaggaaaaagtaatcagctacattaaatgtt

SEQ ID NO: 162300 - DNA, 246 bp, Homo sapiens
cataacatacaagaaaagcatatcatcataagcttgatgaattttcactcaggtaagcagcatccaaaagaagaaacagatctattgcaaaaacctccaatcactggctcccaaagaccaccaccatcctgagttctaacagtggagaaccattttgggaggcagcaatttttaatttgattcctttgacagtgcaatttacagcaagcctggcaaagtttcctggaaggggtcagacagtaaaca

SEQ ID NO: 162301 - DNA, 445 bp, Homo sapiens
ggcacaatttagaaacttgtttattgattgcttctattgctctcctcattggccaggcagcatggaattccaaagggcattgtgctggagtggagccacttgcatctgaggttattttttcttttgaggtggattcttgctctgtcacccaggctggagtgcaatgcgattatcgcaatccactgcaatctctgtctcccgtttccaacctgattcctcgctctgtcatccttcccagaccctttcatctccaattatctctgcctcctccaactaacctgcaaccacattatctgtgttacacaatttagaaacttgttattgattgctttctattgctctcctcattggccaggcagcatggaattccaaagggcattgtgctggagtggagccacttgcatctgaggttattttttcttttgaggtggattcttgctctgtc

SEQ ID NO: 162302 - DNA, 101 bp, Homo sapiens
cccacatttaataagaagcgtttgtttagaggctccacagggtcaggacttggatccatgtgcctgtagttctcttggtccttcctcaaggttacaaaatg

SEQ ID NO: 162303 - DNA, 532 bp, Homo sapiens
gtgcaaagccgcgttctccacaacaaaaaatataaatctattagcctagcatgctggcactacacctatattcctcagcctgttggctgatgttgaaagcaggaggttgcagtgagccaagatcgcaccattgcactccagcctgggcaacaagagcgaaactccatctcaaaaaaagaaaaagaaatcaggctaaagtttacccttgtggggaagggagagactataagagggcttctagagttctactaaggctctgtttctcctttttcttgagctgagggccagttgtgcaggtatgctcattttataaagttcattaaactatatacttaggatttgtatgcttttcagtatgtatgttatacagtcatgttacttaatggggatacattctgagcaacgttaggcaattttgttattgtgcgaacatcatagagcatatgtaacacaaacgtagatgatatgacctactgcatacctaggctgtatggtgtagcctgtcgctcctaggccacaaacctgtatagca

SEQ ID NO: 162304 - DNA, 707 bp, Homo sapiens
aagcacccgccaccacgccaggctaattttgtgtttttagtagagacggggcttcaccatcttggccgggctggtctcgaactcctgacctcaggcgatccacacctgcctcagcctcccaaattgctgggactaaacaggcgtgagccaccacagccggccgcaaatgtttgtttttaggttagttcagaaagcgtgcagtctggcctcaggcccgtgctctccccttcctgacaacacagcagccatgcttgttcctcactggccttccaggcactggatccagtggtggtcagagcagccccgccctcacgagggcaggcagacagtgaacaagtaaacagcccgaccaacatgtgatttcactagtgatgccttggggcagcacaggggccagggagaggaactgggtggcgggttggggagctccttgggacgggcagtcagggaagccaccacgagaggtgacacaagcagaagcttacacgatgagaaggaccagccagttgagggtcgcaggctaggggcgtgctttgtgagtggacagagcgtatcaaagcaggaagatcacttgagcaggagtttgagaccagcttgggtaacataataagacccagcctctacaaaaagtttaaaaactagcaagatgttgtggcatgcgtctgtggtcccagctactcgggagactgaggcagaaggattgcttg

SEQ ID NO: 162305 - DNA, 851 bp, Homo sapiens
aagcacccgccaccacgccaggctaattttgtgtttttagtagagacggggcttcaccatcttggccgggctggtctcgaactcctgacctcaggcgatccacacctgcctcagcctcccaaattgctgggactaaacaggcgtgagccaccacagccggccgcaaatgtttgtttttaggttagttcagaaagcgtgcagtctggcctcaggcccgtgctctccccttcctgacaacacagcagccatgcttgttcctcactggccttccaggcactggatccagtggtggtcagagcagccccgccctcacgagggcaggcagacagtgaacaagtaaacagcccgaccaacatgtgatttcactagtgatgccttggggcagcacaggggccagggagaggaactgggtggcgggttggggagctccttgggacgggcagtcagggaagccaccacgagaggtgacacaagcagaagcttacacgatgagaaggaccagccagttgagggtcgcaggctaggggcgtgctttgtgagtggacagagcgtatcaaagcaagaaagagcctggcttgcccagaggatgcagctagagaattccagcaggatggcagggcctgggccttcagggcaagccctttccctgtgggccaggcatggtggctcacacctgcaatcccagcactttgggaggccaaggcaggaagatcacttgagcaggagtttgagaccagcttgggtaacataataagacccagcctctacaaaaagtttaaaaactagcaagatgttgtggcatgcgtctgtggtcccagctactcgggagactgaggcagaaggattgcttg

SEQ ID NO: 162306 - DNA, 743 bp, Homo sapiens
tgaagctgagatttggtgggaagggaagcagaaaaaaaggaaaagtaaactaggttagtttgaggaagagaaccttcctgcatgtaggggagcccctacctccatctgtccctgctggttgctttgataggggaacagggttggactcaacaagggctaagtctgaagatatagatgatggtcacaatagctactgagagagctcccagcatccccctctctgcgcgttggctcaggtgactgatgatgttaatgaggttaaggtcatgagttcaaacccggcaatggataccttgccaaggctaggggaacctccattgtgcaaccaaggagcaccatggatattatagccctcgcagatgaggcggccatcacccacatacaagttattatgacaatgggccccaggaaagctctggggagcagagctcagcaccatcatcccctctcttgagtaaacaagtcaaagcactgtgctcccctgcctgacataggggtagtggtgccaccttcatatgcaatttgcacactgttctatagtttccttaggggggagtcagcctctgtgactctactactgtgggcagtgctgaatccccagcctgaggagcttcagagggtgctgtcctctctccacatgggttgatactgatagagtcctcactataatatagtgagagatccaggaagaataggtagaacaagctagtcctgggccctcccaacacggagcagcaacatga

SEQ ID NO: 162307 - DNA, 276 bp, Homo sapiens
atagagatgttgcccaggaagctaatgttctattagcataataagcagcgaagtgttggcacctctgctgtctccactggagcatcttctaggtacattcaccaggaaagctgtccttggatggtgagtaggtcagtttcactaggtgtgatttcactttctgtcaaagaggaagaggcagaaagtgaagtgagagaactggaaaatgtccagggagatttcctccggtgctgctattggggaaatacagtctctttgtgggcagcaactatttct

SEQ ID NO: 162308 - DNA, 274 bp, Homo sapiens
aaaaaagacttatctatactgatttactaaaagacaggagacaaaatatggacttcactttcatcataggaacaaaatcacttggtatactccattatgacacccacatggtccaaatccatgccctggccaaatgagggaaaaaaccctcttttttgttgtgctggcactagcacctgactgaagagctattctcctttgaaatttttggagacttttagcaaaccacatcagtcgcctccctatgatttcaaggtagcattatataatagca

SEQ ID NO: 162309 - DNA, 527 bp, Homo sapiens
tggcaacaccctcacagatatactcaagatcaatacttcaatccaatcaagttgacacttaatattaaccataacacagcccaataatcttgggccagagtccctgactctcctcctgcttttagtcaacggaaactcctgatgctttttcatttgcatctctggattctgtttcgtccttcctgtgctgtgtaactggttctttggaatcaagtggagaacctgttactttttaccttgttgcattggctcattgttctaggtttgttttagcctaataaacttgtgttttgttctttttcttttttttttaaatcttaactctcattcaaattatttattctaattcccaacctcatgacatcttgaaatttgtaaagttaataaaaggtatgtattgtgataatctcatttcatgttattctgttgttattgaatatatctgaggagcaatagattaggatagtataagttggggtacctgtggatcagaccctggaagacttggttgaggtaatctgtgaggg

SEQ ID NO: 162310 - DNA, 117 bp, Homo sapiens
cctgaggcccaaatagatgacacgatctggctcaagataactaatcctgccagtgtactactactgagggaaattcctcctggccccttgagaaactgccactcactaacctcacag

SEQ ID NO: 162311 - DNA, 536 bp, Homo sapiens
taggtggatgttaatgctattaactgatttgacatgttgaatttgagatgttagacatcgaagtgaatgggtactctgaaagagcatcaagaaaatctgactgaaaaaagattgactgagatgggcgctggagtataagccagagtttcacaggtaaaggggtgcagacccagacctcaagaaagggctcttggatctcgtgtaagaaggaattcagggcgagtccatagagtaaagtgaaagcaagttcattagaatactagagttcaaacaaggtatggggccgcccagctggagactccattttccagactcctttgcagctgtctctggaatgtgacctagttatcaccaagggaatatgaatggaaatgataagcgcaatttctgcttcatcgggttaaaagcaaattgcttgccctcaacatctgttcttttcccctgctgtaagccagaacatgcacatgcttgcaattcaacttttgatcatgcagatgaaaacatttgctaagaaattaaagatcttttaaaacgac

SEQ ID NO: 162312 - DNA, 266 bp, Homo sapiens
ctcggcttcccaaagtgctgaaattacagatgtgagccaccatgcctggtctttaaatattttcagtggtggcaaatcttcatactccgaggtcggatttgatttgtggaaactgacaaaagttattctgaaccaaagctggcacatgaggtacgggtgatcaaactggctgacagtattttggtcagagcaggatatgacagtttcttatttaattttgaaaactactgatgaaatctagaaataataataatagctaaaatttg

SEQ ID NO: 162313 - DNA, 516 bp, Homo sapiens
atatatatacagctcacttaattttgagaagcactgatccctccctttcaaattttccttactatttgtctatttccctatcattattgtggcaagttccagaaacaacttgtttatattttccaaaaaaataatgggttgaaaagtatatctattaactaagggggaagctgatgtaaactggaaataggcatcacagattagtttaaaaaaaattcagttaacttgagaagatactttttcctcaaatactctaaagaaaaaaaaaacaaaaggactaataaaccaataaaggttgtcctcttatttacatatgacagcaaatactagcatctactgtcaaaattagtatctaaaacaggcagctatagaccaatttcaaatctcattatgcttctgcatgctaattctgccttgctttttctctctagctccatttttcacattgtaaaaatggtggaaataatatctgctaatctttaaaattctagatttaagagatgctaaaaaaaattg

SEQ ID NO: 162314 - DNA, 384 bp, Homo sapiens
gttgtcctctggatcaggaattgggaaacattttttgcaagagaccagagagtaaatatttcaggctttgtgggccatagggtctctgtcacaactactcaactttgagtaagaaagtgagaaagcagccacaggcaatatgtaaatgaatgggtgtggctctattacaataaaacttcatttacaaaagcagatggtagaccagatctgccctatagtttcctgacctctgctctatctatgtatcacacaatgtgtatcttttaagaggctgcacagaaaaggcattttgtttagatcctaataccaggaaaaggtatgcttctcccaaggaatctggttgtctttattttataaccactatgagtcttggaacagaggttt

SEQ ID NO: 162315 - DNA, 465 bp, Homo sapiens
tagatcaaggcgtcgttcatagttcgtgagtgggaagaccgtggattgaatggtccaggggagggtgagggtggcttggaccagggcagcagtggtgaaggtagtgagacctgaccagctcctggacaggcgtggaaggtgaagctgatggtgtttgctgggatcaggtgtagaatgtgataaaaagcatggaacttgacatgatctcaaggtttttggggtttgatcaactgaacagggagttgtagaaggctgcaaaaggaagactcgtttagcagttcaatttctgacatgtcaaggtaggaatgccctttagatatatagcagatatttggcatagcaatttgtgtgagtctggagttcagagatgaggtctagggcagagatataaatttgagaagcatcggcaaaaagatggtatttaaaactgatatagtttgaacacatgtccctgcgaacctatga

SEQ ID NO: 162316 - DNA, 493 bp, Homo sapiens
gttggctctaagacaggtggcaggagaaaagacaggaggacctcaagtttctagggtgggtaattaagggaagggcagttattaaatcagcagggaaagcaagaggaggaggactgggtttttttcaagagcagaagataaaaatttggtgttggatatgtattatagatgcctgcaggacatccatgtgggcaggaggcagaatgtcatagtggaaagaacaaagcggcagaggaccttggatttgggctttgtcatttaccagctatgtgacctagagtgtcatgaacctctgtgaagtcagatttctaatttagaaagtggagataagaatctctgccataattacctcaggatgattttataataatctaaaatttaaaaatgtgtgaggaagtgctttttatttttatctttttgagatggagttttgctcctgttgcccagggtggagtgcaatgcctcaatctcagctcactgtaacctccacctc

SEQ ID NO: 162317 - DNA, 270 bp, Homo sapiens
atacttgatcgtgtgccatgaggagctctgaaataacaaaacgtggtcactgcctttgaaaaactttcagagtgatcaagtacatgaaatatttattcaaggaaggaactagagtatgatatgtaaatgtataggcttttttaatcagatatcctgagttcattttctacctccatggtttactaaccataatgataggcaaggtgtactttggtttcctcatctgcagaatagaactaataacaggattcaccttagcactgttgtgag

SEQ ID NO: 162318 - DNA, 646 bp, Homo sapiens
tttgttataggtcattgggacactatatctagcaaacatttattcagtgttttggtataattaaaaataaaaaaacccaccaccaccaaactacttgtgcctaattgaggcaagagttgaagcttaactttttctaatttagttgggtgactaatgaaccggtgaggattcaggacaggcataccagagggtgctcagaaatgaaggtaattgagtcaattatagtacttttgaataaatgcagggcagattgtcattatgtgcagaactctgatttaaaataatcattgttggcatgtctccttgctgcatgtgtacaatttcatactcctataatgagtgttttagcttgggagaaccacttagggatttttctcattgcacttggccatcgttgttttatcccattgggaaatgagaaactcaatttttaaaaataaatcgtgatagcatcaggtgatatcttgggcttgaaaatataaaatcttgagccactctcatttcactttctttctcatgacagatgtctttatgaatggagttggctacagattgtctggtagaattgcaaaattgataccttgatttagtttatagtggaaatcctttgtcctttgaacttacctattatactgcttaatgataa

SEQ ID NO: 162319 - DNA, 502 bp, Homo sapiens
aagtgtctaggctgagtgtactcaaatctgtctaaaaccaaagcttagtagtggcaggtctccatctctgtgcagagccaggctaagctgtctgatgaaaataatgggacagaggtagaattaaaaaaactaaaataaggctgggcgcagtggctcacgcctgtaatcccagcactttgggaggccaaggtgggcagatcacccaaagtcaggagttcgagaccagcctgacgaatatgatgaaaccccatctctactaaaaatacaaaaattagccaggcgtggtggtgcgtacctgtagtcccagctactcgggaggctgaggcagaagaatcacttggacccaggagggggaggttgtggtgagccaagatcatgccattgcgctccagcctgggaaacaaaagcgaaactccatctcaaaaaaaaagatatatcaatcagtcatcagtgctatgaagaaaaagtggagcacagcaaggggactgcaagtaatagggtg

SEQ ID NO: 162320 - DNA, 246 bp, Homo sapiens
atggcgatcatcaaaataagccatatgcagctatgcatcctgtaactctgagaatgaattattataatagtacaaaaggaagtaaggacatctagagtatctattctctacctgttgcattccaatgaagtcaatacaactatcccaatgtcctgagtacatagaacagccagatattagaaatgaaacacatttctaagattcttttctatctggatacaaaaaacaacacagtcaatattcatt

SEQ ID NO: 162321 - DNA, 713 bp, Homo sapiens
acatcgagtgccgggcggcgcagcttcccgacatgccgctggaggagctgggccagcaggtggactgtgaccgcatgcgggggctgatgtgcgccaacagccaacagagtcccccgctctgtcacgactacgagctgcgggttctctgctgcgaatacgtgccctgtggcccctccccggccccaggcaccagccctcagccctccctcagtgccagcacggagcctgctgtgcctaccccaacccagaccacagcaaccgaaaagaccaccctatgggtgaccccgagcatccggtcgacggcggccctcacctcgcagactgggtccagctcaggccccgtgacggtcaccccctcggccccaggtaccaccacctgccagccccggtgtcagtggacagagtggtttgatgaggactaccccaagtctgaacaacttggaggggacgttgagtcctacgataagatcagggccgctggagggcacttatgccagcagcctaaggacatagagtgccaggccgagagcttccccaactggaccctggcacaggtggggcagaaggtgcactgtgacgtccacttcggcctggtgtgcaggaactgggagcaggagggcgtcttcaagatgtgctacaactacaggatccgggtcctctgctgcagtgacgaccactgcaggggacgtgccacaaccccgccaccgaccaca

SEQ ID NO: 162322 - DNA, 643 bp, Homo sapiens
ataaagaaacagactcagagaaagaggcttgtgtaaaatctcatagtaactgatgcaactgactggcatctgtcgcgcattttagtttatttgtgattgaccatgatgcttccagctatactaagaagcaggcagtcaggtgacatactgtacagcaaagaaatactgagtccctgtttgagatggagggagagctgagagaagcttcttctgatatgtaatttggagtttgctggtgaagttttcttctgcatatgtgctttcccacgcatatcttacttcctgattggcactggctgtgtatcacaagttgtaattatgttataattagattgtttatttctttaacatctgacttctgcagtgttctatcctataagttacataaatgtaggactctgttttgttcacagtattccagcacagtgtcttgcatgcagtagtcactttatgaaaattctgaatcagtaggcacatgagaggtaattaagagagagagataaattgacttagtcaagattatatagcagtttggtagcacttctgggactagatctgattttttctatccttaagcccagaattctttgtacaacatagtgctgcttgccacatgcctatcatgattagagctatatgattt

SEQ ID NO: 162323 - DNA, 305 bp, Homo sapiens
agggattgtcctgcctcagcctcccgagtagctgggattacaggcgcctgccaccacgcccggctaattttttgtatttttagtagagaaggggtttcaccatgttagccgggatggtctcgatctcctgacctcgtgatctgccacctcggcttcccaaagtgctaggattataggcgtgagcctccgcacctggcatgcctggccatattttaaaatattttttttaaggaggaaaagatccacgaaagtaaagtgcctagggcccatcaatgtcagatgcagccacgtggacaaagaacact

SEQ ID NO: 162324 - DNA, 544 bp, Homo sapiens
taatataaatgacatggtgggctctacttttatgaaagttatctcaatctatatagaaaataatgtacttctgtgacttcagtaactatagaaaagttgtctaaaatgttaagtaaacataaaacaagtaaacaagtttaagatgatgtggtctcatcatcggtttaaactgctcattactattacgttttaaatcttactgttaataaatgtgttaattatgatgcctcaaaggtatttcaacaagaggacacaatttaaagactaaataaattactcaaaatgagcttcagaggtgctgtaatggggtccatggtcttgctgatgcacaaagcttcatccaccccctcattgataactaaagcaagcccatgttagcattctgatgctgctactcccgcaggagatcaaactcactgccagctacaaacgggagaaggtaaagtcacacacagccccctccctcgctccaaacacactgcatgggtgtgctctgcaatgcactgaagcaaacaaaatcctcagtaacaacaaaaactgtcta

SEQ ID NO: 162325 - DNA, 103 bp, Homo sapiens
actggtcctttttgcttggagacccctttctctacagaaagagctattttttctttctcttcttttcttcctattaaaaaccttcgttcctaaactccttgtg

SEQ ID NO: 162326 - DNA, 213 bp, Homo sapiens
agatgtgaggcctaacacctgatgatagtcaacaactcttcgggctcagagaggactggaattctgtgaagtcattagaaatgaatactccacccttctctcaggttattgaataatctgtatcttaaatgactttgataggaaaatgctactccaatttagccagaagaggagtcgctggtaaggagttgctggtaaggatttttaccccag

SEQ ID NO: 162327 - DNA, 134 bp, Homo sapiens
gtggaaagaaaacacccaacccatgctgaaactcagtgacggggaggggagagtgcaggcaagaaggcaagaaaatggcagtctaacgtgccacccgggatctcattcagaggggtcaccttgtcctgccaggt

SEQ ID NO: 162328 - DNA, 226 bp, Homo sapiens
aacttagaggcatcagacaagaacagagaacctgaccgggcgtggtggctcacgcctgtaatcccagcactttgggaagccgaggcaggtggatcactgggcaacagagtgagactctgtcttgcaaaaaaaaaaagaacagagaacccccaaaatgagacagaaagtctctgcatccattaatcccaaaatctcaactcaggtcctactatgagaaacagacaga

SEQ ID NO: 162329 - DNA, 260 bp, Homo sapiens
gggggacaacaacaacaaaaccctaatgagttctaaaagtgaaaaaaatccaggtatattactcataaaaatgataatcagtggcatctgacttcttagtagtaacatggaatactagaagacaagaatgcaattactttttttttttttttttttttttttttttttttaacccaaccctgccaaaaattcaacacagtcccccaaattaagttttttctccgtctctcatttagcagggcccccacactctcttgtgt

SEQ ID NO: 162330 - DNA, 438 bp, Homo sapiens
aaagcagttaatacagactcaacacacccaagcaaataatcaatgagcttgacaactggttaatagaaaatccccaaactgaaatgtgcagagaaaaaaaattaaaaagccagacataacatccaagaattatgagacaacttaaacaggataccagaagaataagaaagaaagaacaatgcagaagaaacagttgaagtaataatggctgaaaacattttattaacaggcacctaggcacagatccaggaatcctagagaatatcaagcagaattaatagcaaaaacaaaaccaaacccaatatctatgacataaaaaaaacatagaaacgtcacatttaaattgaaaacaaccatcttatattcaacaaggctgatgaaagcaagtaatggggaaaggatttcctattcggtaaatgagtctgtattaactgctag

SEQ ID NO: 162331 - DNA, 309 bp, Homo sapiens
gcacatctgcacatgcctgtgcctataactacattgggcagcgagctgtctggggtgtgctggtcaacaagcttccctgaagcaggcggccatgtggagggacagcatgtctgtggtttcacatttgtccccgtcatggccttgtctgtccacttgtttctgtgggaagcaccgggccccagaggccggggtgagtggtgcctgcctgtctcctgggcaggggcagcatgtctgcatggatgactgtgtgccgggtctggatctgctgtgtgcgtgtttttgtctgtctgctgggagcctgctgtctgc

SEQ ID NO: 162332 - DNA, 441 bp, Homo sapiens
gactatcatgtgactgctcacttatctacacaggccactaagatgcactgcaccggtcctcaccatgactcctccctctgctgcccttctcactccaggctcctaaacacaggccacctatttgatgggatatttcaaacctggctttgattgtgagggtcagtttggcatacaggtgatttccttgtagattaagaacatttactttcttcctgctggatccctcccagagataccatcaaacctctacctacgcaattagttttcacaggtggctgttttgcctccagtaaaactactttctttctccttctgcaagtcaaagcacagcgaatacacacgaaaacatttcagatatgaaataaacatgttcataaaggcagctatgatgtaatgtatcatttttgactgatccaaattatggaatgaactccccacacc

SEQ ID NO: 162333 - DNA, 611 bp, Homo sapiens
caatttgcgaatgttagggaaaggaacaggcatgtttcaacaatattctgaaagtttcttggagttcagagctggaaacatatttttgtaaaaaacttttaatcagttgacaaacttacatttttcagggggtcagttttagcttcttcattgaatttttcttttctgaaccagcaatcaagactccctacttccttttgctctccaagttcctgtatcggtaaatgaattgtccacttgctgtaattttgccatttagccctctctaaccaagatgttgatcgaggcctttctagacattttggcgtttcatcaacttctttgcaatttcttaagcattagagctttaccacttttagccatgcagtgcatgctttcaacctctcctattttctccaagtgttaatctttatttttctttccttacagcagttctctcaatctcatttttatgttcaattcttacattctttaggtggaaagttccactgtctcaaagttggtgaattctgtgtgtgttggtgtgcatgtgtgtgcttaacatctgaaatcagtttacctaggagtgacttacttcttgaagtacaggtagctagctattctgggagcaa

SEQ ID NO: 162334 - DNA, 337 bp, Homo sapiens
tctccattctgacagtcttaagtcatcacatcaggttattgatcacaacccttcagtacctctcctgtgccctccttggttcaaaatccttagcaggcaagagccaggcctctcccatgtgattccagaccagctgttcggtcctgttgccaagcccggccatcaccccgccattcagaccagctttcctgggcttgctttctcctttgctgtgcttaatctgggtgttttccttaaaatgtagcctcttgtctctgctcattgaaatggaactcattctataagcaccttactaaagactttgttattcactaagctataaacattttcctgaaaa

SEQ ID NO: 162335 - DNA, 123 bp, Homo sapiens
tcaccatatttgatagtgttgatctcctttgcctctgcaaaattctgctcttaaacctgtggcaactctggtctcacgttgtcttaatctttgtactgcttaacactcactcacttcttccca

SEQ ID NO: 162336 - DNA, 231 bp, Homo sapiens
atgggtgctatacaacatgcctaactctgtgattgatttttctagaaccaaggagtagaggtggggcaccaacactattccagctggggctccaaattcctgtctgtaggatggcctctgcctgaggtcagaaagcaggagcaccgtgaggttcaggaccgtcttctgcacactggctaccaggaccagtaggctattctatgctctgtccatcctcactattctttacag

SEQ ID NO: 162337 - DNA, 432 bp, Homo sapiens
ctttttacctcttcccataatataaagaatacttcctaactcattctatgaggccaatattatgctggcatcaaagctatacaaagacatgccaagaaaagaaaactacagaccaatatcccttatcaatacagatgcaaatattctcaacaaaacagcagcaaatcaaatccagcaatgttattacatgataaggccttaaacttttaactgttaaaaagataaggctcgctgcggtggctcatgcctgtaatcccagcacttcgggaggccaaggtgggtgaatcacgaggtcaggagtgcaagaccagcctgtccaacatggcaaaacaccgtctcaactaaaaacacaaaaaattagctgggcatagtggcgggcacctgtagtcccagctactcaggaggctgaggcaggagaattgcttgaacccg

SEQ ID NO: 162338 - DNA, 325 bp, Homo sapiens
tgttcagcattggtggataggatagaggctgattttacacactcttatattaggtcttttgtgaaatggtagttggtcaagaagaggatataaaatgagaagaaagcaagagaatgagagagattaaagtcagaagaaatcatttcatgggtgcctttactatggttgaggggaaatcaaagacctagaccccaaaacttgtggagccagagaccatggttcaacataaacccatagatctaggcaccagaaaggggtggagtgctaattctggaacctgtggttgagcaaatttaatggtgatggattagacgttggtatgttc

SEQ ID NO: 162339 - DNA, 380 bp, Homo sapiens
atatccagactatcagctgccagaaaaactgtttccctccccttccctgctcattttaaaggtcctatttaccagaacactatgaaggtagtaaaactatggtaagacaaacacatacttacatattttcagtttaaaaggtgaaagtacacagaggtaacttccatttagctcactcccctaagtcattctccttgtggatttcctctttacaggccttaaggtgacttgcatcatgttcacgcccagggtgaagtgtatcatcaccacctgcaaatatttctaaatgggatcagttctattaataacaatgactatttctaaaggcagtaataagtaaaacagggttgttgtagcaaacttaaaactcacaccagcaa

SEQ ID NO: 162340 - DNA, 121 bp, Homo sapiens
agatttaggggttagctttcctctgttttatttctgaagcagtaacccttggcctagccttacatataaacaccccactgactaccttctatttatcttttctttgcaaagccctcatttc

SEQ ID NO: 162341 - DNA, 271 bp, Homo sapiens
gcgcttaaaaactgtacctaactccctcccatagcagacagaataggataggcttcttccctacctggtgttcaagttctaccactgccctcctcccttcccccatttacctctctagaattaccaggtatctatgcatacatgaattctctgcttccattagatttacttgtcattccccaaatacaccatgcacttgcatattagcaaagccaagtttgtctttcacaaatgcagaggttaaataagagttaaggatgaaggtaaacca

SEQ ID NO: 162342 - DNA, 352 bp, Homo sapiens
gacaagcaacacaggtttttccacctcagagctgagtggtggcatgaggatggaggttagggtttgcaaatctataatttgttccaaacagttcaaaatcatttagtgtgaagatgaattggactaactgactaatatcagaagttacacagtttgctgtgtttagctatgggtagcttgagctactcccaaagcaactgagtggcaagaaagggtatctaagaattataaaaacttctcatgtattatgtgtgtagctagtagaatgtttatcatcttgaaagtatgttcttgtcaaagtaaaaatgtgtacttggatttagtaattatttatataggaactttctttttc

SEQ ID NO: 162343 - DNA, 210 bp, Homo sapiens
gtgtgccagacagaccatcactgtgctgttcagagacacatctcatgtgcaaagatgcacatagactcaaaataaaggaatggagaaaaatttaccaagcaaatggaaatcatattggtggtaatgataaatataacccagttttcttccttgcttggattccatattttaacctctcactgattcagagggttggagataaaatatttg

SEQ ID NO: 162344 - DNA, 304 bp, Homo sapiens
aaacttggatattgtgtccttggactttcagctcacagaaatctgcaaatatgcagtctcagaatgtactcccaccctactctaatggatgcagtgagtgagttatttcaggaagaaaggcatcagggcttcctcctgtctcttggggctgaggaaactcttggagatggccttccccacattcttaaggataataacggtgtccaggtctatggagtgcaaagccccattttgtttttacaaatagtgccttctgtgtggcattgtattccttaaaaatagaattgcatccatcagcctctgt

SEQ ID NO: 162345 - DNA, 407 bp, Homo sapiens
taccacaataactgattttccttaatttgcttgttttaatatattttctgtagattccccaatttttaaaactttttttggttttattttttattatactttaagttctgggatacatgtgcagaacgtgcaggtttgttacatagatatacatgtgccgtggtggtttgctgcacccatcaacccatcatctacattaagtatttctccttatgctatccctctcttgtctctcatctccctacaggccacagtgtgtgatgttcccctccctgtgcccatatgttttcatggttcaactcccacttatgagtgagaacatgcagtgtttggttttctgttcctgtgttagtttgctgagaatgatggtttccagcttcatccatgtccctgcaaagggcatgaac

SEQ ID NO: 162346 - DNA, 333 bp, Homo sapiens
ggcaccggttatggtgatgctgtagagtgactgaagcaactaggaatctggggcatggatgcacttgagaaacgaattgtacttaagatgggtcagatggacgaggcctttgagtttgtgaagcagaggcgaagcatcaaagatgggtcagtggacgtcatggcaacagccagagggcgtgagacaggttgcaggctcagtgccggcaccggtgggtggcaaaggggtgcacagaccgcactcagtgcctatgctggtgacaaaagaaacacgcaggcagagttagtcacccgtcaaggggagaagcctccgcgcccagcaaggacgctgcag

SEQ ID NO: 162347 - DNA, 301 bp, Homo sapiens
tcccaccaccaaaggttccaggggtcagataggaaggaaagtacagtgaaaagggagattaagcagacagtgcagtcatcaagtcctctgcaaattcaaatgggagctaaagaaaacaaaaaacagaaaaacaaaaatgtcatactatagcttacccttttgtcatttcggtatttttcatgcattaggtttcagaaacaagagctgtctccagcaaacagattattatttgacaaagacaatccccttattcaaaatagggaactgccgtgtaacatggaaggtggcctgcgacaaaggc

SEQ ID NO: 162348 - DNA, 489 bp, Homo sapiens
tcccgtgttttgctgtattcagatggtaaccctagaaggcagtcattaggcagaacctaatggaatatacaatacaagatgcatgtcgtgtaactagtttctattcatttctgtgttaaattggttcttagaatttgcaagaaagtgagacaactccaaattactttagtatgaatccttagtactcaagggaacatgagggaatagtctttttcagttgcacaattgctgtgggttccaaaagtgtattcatttaaagaacactaatggaatgctgagaggtactgtgtacaccttggtgagaccaaagtttctatcctaatggaggttctgtactagtaagggaggcaggtaatgaatgaagaaacaattagtcacaaattgtgatgaatgctaggacagcataattataattgcgatgaggctaggatgggtaaaaacaaggtgatctccttagggctgtcaaagaaggcctgaagagcaaagagg

SEQ ID NO: 162349 - DNA, 583 bp, Homo sapiens
ccctaacctctacgaatgagacttgtatttcttctagatacttgtaatacgtgaggcctggccctggcgttcacgccttctacagagctgttttcaaattaaaccagataatgtggggaaactgttcaggacagtgtgaggatagggcgtgctcaattagtttactagcaagaactagaactacagcaggtattaacacaaaatgctatcctggagagaaagtggtagctattagctgagcaccgtgtaatcaatcatccctcaaccaaccacctcaagcccttatcttctaccaatttcactctttctcccaacctgcctcacctaagcaatcagtcctcataaaaaaggaagacaaaggccaggtgcagtggctcacatctgtaatcccaacactttgggaggccgaggtgggtggatcatgaagtcaggagtttgacaccagcctggccaacatggtgaaaccctgtctttactaaaaacacaaaaattagccaggcgtggtggcaggtgcctgtaatcccagctactcgggaggctgaggcaggagaattgcttgaacctgggaggcagaggttgcaat

SEQ ID NO: 162350 - DNA, 143 bp, Homo sapiens
cctctacaaaaaataaaataaaatagagaccactggccacaatcttatttctttccttttcacacatagttgaaaacacaattcatacccaaaggaaaaaaaagcattatattaaaaagacacctgcacttgtatattgatcg

SEQ ID NO: 162351 - DNA, 329 bp, Homo sapiens
agaaaaaccagcgaaggcccagcttgagcagccaatggcacaagaaaatggcacaaggaggccactgtaactgacagacacgcctgctctgccactgggactgatcttgtgtggggagttctgatcagcaccaggcactctttagaagcaccgtgtccggcttctgtcctcttctactgtcacgtggcagaaaattcctctctcatgctatcctgggtaaagtcctttcttcaaaaagatctcccttccatagtcctcccattagaatcttttgcactctgtacaaaaagacaaacattctgatgagtccatcaacattaggcagagtt

SEQ ID NO: 162352 - DNA, 555 bp, Homo sapiens
tccaagaaatcacttcctaaaacagagggaatgtggaagagagaaaatctgatatgtcctgcaaataccctcagaggctctggaactgatgatatcaggtatatctagaagtggagctaaaggaggagttaaaatagggttgattaaaagactgggaagcaagcagaccccagacctcttgccagacttcacgtgtctgggtgcctgtccctcccaaccctaatggaagacctggaggtatattctccggagatgttgtttctgagcaggagggcatctgtcctagtccaaggtagggagggttcttaatgaaaaggggaggattaataaaaagtgtatacactgacttgttagtttcctatggctttgtaccaaaatagtacatacctggtggcttaaagcaacacacattgattctcttacagttctggacaccggaatctaaaatgagttccctgttgttggcaggactgtactttccctggagattctagaagataatctgttatttgcctctttcagcttctgggagcagttggcagtccctggcttgtg

SEQ ID NO: 162353 - DNA, 164 bp, Homo sapiens
aaggctgttttaaagtggactgaagtatgaaagggacacacctgctctgggcagtgggctggactaggtgttctgcgaggccccccactcctaaacaactacaaagaataaagaaaaaagcagggtagacacaggcccatgaaatcctgagcatgtgtgaccgg

SEQ ID NO: 162354 - DNA, 222 bp, Homo sapiens
tgaaggaacggtgagcgcacctgccttcagccctcacccacccagcaggcaaggctgagcagaacctgtgtgtggggccctcaggccactaggccctccttcttccaactgcacacctgtgcggggccagacttattccacagactccaaaagaagagaccgtggcagatggacgcagacacgagatgctcccatcttctatttcaccagacactgaagaga

SEQ ID NO: 162355 - DNA, 459 bp, Homo sapiens
cctcagctaagaacaatccttgggaagttcatctgcaactgtatacctagtgagaggtctccagagaaatacgcctgccttgggaagaatgtgtgtacattttaaggaaacatagttcataaaatccatactggagagagaggtatttacatttctaggatcttttccacctgttctctatggagtaaagttttttcttcctcatgttttgcctctttatcctgtatataaacagagaaactctgtttttctccatccctcgtctaggatacagatgttgtatgtataggagattttaacctagtttgcaatgttacttcaggggtagaattgggacgtgagggaccatgtggttatggatggcttttaaaatgaataatgagaatctgaacctacccagataaccttgggtatacatttatgataaaattaataaagacaaatgttaaaaatttaaca

SEQ ID NO: 162356 - DNA, 532 bp, Homo sapiens
agttcgacggagactctctctctctctctctccttgaggtgaaacattcaacttcggtccttagacattcccactcttgattcctggaccttcagactcagatcaggagttacaccatcggctctcctggctctcaggcctttggacttggactcagtttcaccactggctttcctggttctttagcttgcagatggtggtgcttcacagcctccatctctgcccgagccaattcctatataaatctcttcttacatacacatcatatataccctattggttctatttctctggagaaccctaatacaatgggtcctccagcactcaccccaaattaagcatgtttccttttacaaaaggtagaaatgtccactcttcataagtcctttaatcaggtcccattcaaactcctctaaaataaatttctccaaaattctatttctatatttcactttgcatgctcactgtttatgccacttcaagggcatacgatctctcaaaactgatcagtttgcagagtctcctcgaactg

SEQ ID NO: 162357 - DNA, 337 bp, Homo sapiens
ttctttcttttctttctttcctttctcttctttcttttcctttcttcctttctttctttttctttttgttgttgttgttgttgagacagggtctggctctgttgcctaggctagagtgcagtggcaggatctcggctcactgcaacctgtgcctgcctccagggctcaagtgatcctcctgccttactttcccaagtagctgggaatacaggtgcatgccatgccaccacacctgactacttttttgtatcagctgctacaaaagttactgcattttttgcatttttattttttaaacctgattgtgtatgtgtgtgtatgtatgtgtgtacgtgtg

SEQ ID NO: 162358 - DNA, 259 bp, Homo sapiens
gccgactctagagcgatcccccgtactcacaatttacgaaagaattggcatctagattagaagaagctatccagaatgcagcccagagagaggggcaggtaaagacacagaaatcatgaaaaagtttctgatgtcagtgattgtaactgtcattcctagaacttgtgtggttcttttcatattatttgtggtcatatataatgatttccctcatttccttctcttctcttgggttttgttcaggtacacagggaggttg

SEQ ID NO: 162359 - DNA, 153 bp, Homo sapiens
aggcaggctgacgtagctgaaatacagtaaaatcttagaaaatttttgctgaatgaataagaaggttagaattgtcccaaatgaggatgtatcaacctagaccatatattgttttcaaactataacagcatataaaggaagaatgaagaaggt

SEQ ID NO: 162360 - DNA, 169 bp, Homo sapiens
cttattcctgtccttccattcctcttgaaccccttccaagcaggcatttacccccaacactccactacctttgcctcataaccacacagctgaatctgatgctctgccctcctcttgcaaaaccagggacctgcgctctcctggcccctgctgccgtcccctccacagc

SEQ ID NO: 162361 - DNA, 377 bp, Homo sapiens
caaagcgctgttctatgtcttgacgggggttggacgacataagggtgtgagccaggcaagttcctggtatagcatagccttcactcctcaacgatatttttaataaaatataaagtggggccggacacagtggctcacgcctgtaatcccagcactccgggaagtcaaggtggacagatcacttgagatcaggagttcaaaaccagcctggctaagatggcaaaaccccatctctactaaaaatacaaaaattggctgggcgaggtggcatgcacccataatcccagctactcaggaggctgaggcaagagaattgcttgaacccgggaggcagaggttgcagcgagccgagatcgcgccactgcactccagcctgg

SEQ ID NO: 162362 - DNA, 374 bp, Homo sapiens
agaggctggcccaggtgcccagtgtgggcctgctactggggtccaggggagaaaatgagcctgagatagggcagaggcccaaagagtcccagatatcaggcctggcataggcagcaccccttggtgccttgagaatcccttaggtgaggccaagctgtgtggttaggagtcttggaggcaaacaggcgggcatagcctagctctacttaccctctgcgtagccttgggcaactgagcctcagtttcttcctctataaaataggataataatagggtccttcctctaatgcttccctttcttgtccctgagaccgaggtgtcagatattcaggatgtccaagttccctcctgcccttaggtgggcccactgcttt

SEQ ID NO: 162363 - DNA, 696 bp, Homo sapiens
atttccccattgcttgagcaaattatttaatttcagagagactgagttggctcatctttgaaatagtgatcaagcctaattcactggagtagtgcaaagactaaatgttgtagtcaatgttaagtgcctggtaccatgccttggattgaatgcttacaatgtatgcattccataaaagataattcttcatttttcctgaggaaccttctgagtttaagttactctttatttaaatcctcctcagctttataaaacacatcatcattgaatttgaatcttccagagtcgtgtttctaactcacatttttctcataagcagtacaaatttacctgagatgtgacggatacataaatttgttaaattagcccttccaaatgaaataaataaatgaaaggaaagggaataaactatcaaaatcctcatgcgtctatttgtggctgaagtgttttattagattttataacaaagtttaaaaacaatatcaagtaggaatgtgtatgtgcttcttaggtaggtaaccggatgagcccatgttacaatatgttgaattttgtctatatgggaatgcctttaggatgccgtcatggtgccaaaacttaaggtggacagagaatgagaggaaggccctgacacgcagagcaggaactgtgatctgctaaccagggtccagatgctggccaggaaagaatttcatt

SEQ ID NO: 162364 - DNA, 361 bp, Homo sapiens
aggaaagggaactccctgactccttgcacttcgcgagtgaggcaatgcctcgccctgcttcggctcacgcacgatgcgctgcacccactgtcctgtgcccactgtctggcactccctagtgagatgtacctggtacctcagatggaaatgcagaaatcacctgtcttctgcgtcgcccacgctgggaactgtagatgggagctgttcctatttggccatcttcgctttttattttttaaaatagttgtgtcatcttggtgggttgggcgtggtggctcatgcctgtaatcctggcactttgggaggctgaggctaatggatcatttgaggtcaggagtttgagaccagcctcgtcaacatg

SEQ ID NO: 162365 - DNA, 686 bp, Homo sapiens
ggagttcaagaccaccctggtcaatatggtgaaactccggcccaactaaaaatacaaaaattaaccaggcatagtggcgcaagcctataatcccagccacctgagaggctgaggcaggagaatcacttgaacctgggaggcagaggttgcagtgagccgagatcgtgccagtgtactccagcctaggtgacacagcaagactccatctcaaaaaatataaataaataaaaataaaaataaaaataaaataaactgcttcaaaagaggctgagcatagtggtggacacctgtaatcccaggctgaggtgggtggattgcttgagctcaggagttcaaaaccagcctgggcaacatggcaaaaccctgtctctattaaaaaataaataataaagtgctgaaagaaaacaaaatattatcaacaaagaattctatatccagcaaaactgcccttcaaaaatggagtaataaaacattcccaggcgaacaaaagttaggggagctcgttacctgtagacctgccctgtgagaaatgctaaagggcagccttcaagttgaaacaaaatgacactagatagtaacttgaagccatatgaagaaatgaagatctccggtaaaagtaactgcatacaaataaaagccagtaatactgcaagtctggtttgtaactccattttatttcctacatg

SEQ ID NO: 162366 - DNA, 229 bp, Homo sapiens
ctcgcttagtggtcatcagagtttctagtctctcttaaggattaacagaaatctctctattagcagtccttgtcacctggaagcccctgttgcctgcctgggcagctagtaataggaatagagatatctgtatgcacttgagaccacataggttttgtctttccaatgttgctaagagtaccatagaaccacagaatttataacagtaaagggaatttagagatcgtct

SEQ ID NO: 162367 - DNA, 226 bp, Homo sapiens
agtagctgggactacatgcacgcaccaccacgcctggctaatttttctatttttagtagaaacggggttttcccatgttgtccaggctggtctccaactcctgggctcaatcagtccacctgccttggcctcccaaagtgctggcattacaagcatgagccgcaatgcttggccccagctcattctctaagaccagtatcaccctgatatcaaaaccaagcaaagg

SEQ ID NO: 162368 - DNA, 411 bp, Homo sapiens
taaaactgagtacaaacttccaaagaggtgggaagaaaatcaggaaagtatgatgtcctgcaagtcaagtatccaagaaagtgaattagagaacgaagtgatcagtgatagaatattctacagataggtcaagtaagatgagggctgagaccagaccactagatttagcagcatgcaagttactggcaacttggactagagccctttcagtggtgtggttgcaataaaaacctggctgcgtgggtttaagaggagaactgatataatcagatataatcaaatataaacaacgctactgagttttgctttaaaggaaaagaaattcagcagttgctggcaaagtgaggtcaagagtattatttttaaataagtggaagaacagcttaactgtatgctgacgggactaatcca

SEQ ID NO: 162369 - DNA, 566 bp, Homo sapiens
atctttttctgagatgaaatgatattgcttgtcatagaaataagagaaattttattattccttcagataaaggcaattagctaaaacaaactgctacttcaattatcaggtgaatttaggacgcactttatgaaataatttgcaataagcagtacagtcaaatcttatgggaagataagatgcagccaatcttaagaatttatgtttgtaggctgagcacgatagctcatgcctgtaatctcagcactttaggaggccggatggacgaatcacctgaggtcaggagttcgagaccagcctggccaacatggcgaaaccctatctctcctagaaatacaaaaattacccaggcgtgatggtggatacttgcaatcccagctactcgggaggctgaggcaggagaatcactggaacccgagaggcgaaggttgcggtgagccgagattgtgccactgcaccccagcctgggcaacagagcgagactctgtctcaaaaaataaaattttaaaatcctgatttttttttttaataactctgaacaagtttctttaactctctgcctcaat

SEQ ID NO: 162370 - DNA, 540 bp, Homo sapiens
tagctgttctagaggatctccgacggcggtgtttacggtacgtgtagcagcatccgcggcaggaagaaagatcccaagctggtacagtgtttcaaggacactcaaatatttctggctttctggcagcaaatatttttctacattttttgtaacagagtttggggtggcaatgggtaataggtaaatattatgaaactcttgaactaagtaccagcaatggcagttactttttgttctgaacgcattatcatttagatattatgggcattactcatctattttcataattttcagctacaaaatatatgccttcaaaatcatatctataatcctgaccacgctcctgatccagacccgtatttccaactgatattgtggtatcattacttacctaaaaagcattattacttatctgaaattaaactcagtattctctctctcccaaacttgcatatattattctattgccaagccaggaaccttagactcatactcaacttctaacaccttctaacattaacaaaatctggaggactcaaa

SEQ ID NO: 162371 - DNA, 506 bp, Homo sapiens
ggatggctagccaggattccgaaggcaggaagaaagatcccaagctggtacagtgtttcaaggacactcaaatatttctggctttctggcagcaaatatttttctacattttttgtaacagagtttggggtggcaatgggtaataggtaaatattatgaaactcttgaactaagtaccagcaatggcagttactttttgttctgaacgcattatcatttagatattatgggcattactcatctattttcataattttcagctacaaaatatatgccttcaaaatcatatctataatcctgaccacgctcctgatccagacccgtatttccaactgatattgtggtatcattacttacctaaaaagcattattacttatctgaaattaaactcagtattctctctctcccaaacttgcatatattattctattgccaagccaggaaccttagactcatactcaacttctaacaccttctaacattaacaaaatctggaggactcaaa

SEQ ID NO: 162372 - DNA, 854 bp, Homo sapiens
cattagaacattggaaattttattagaagttgctaagtatttcaaaaatctatcagaagtttgcaaatgattttataaagacagaccctcaagatgacagctcaggatgcaactgaaatttgcttttttgagtgtatttggcgtttgctgtttgtgaccctgattttcatgctctgcagcaggctgtgctccctggccaggaaagggggtcatttgctcagagccaggagcccttccctgcgggttaagttaccggaagtcatgtctggcagggcaggatttggctggttctggtctcaaccacagccgactccacagggcttggcctatgtgggattcagcccacgaaaacaatttcttgttaaaagcacctgtcttaccctccctagtgatctcactgtatttaaaatatttatttaaacaaggcaagtattccctttttattacaggttgagtgccccaattagaaaatccaaaatgctccaaaacctgaaacttttgagctctgacatgacatcacaggtggaaaatccacacctgacccgacagtcacagtcaaaacttatttcatgcacaaaattaaaacagtgtataaaattaccttcaagctacgtgtatgaggtgtgcgtgaaacataaatgaattttgtgtttagactcgggtcacgtcccaaatgtctcattatgtatatgcacatagtccaaactctgaaaaaaatccaaaatccgaaacatttctggccttaagcattttggatatgggatacccagcctgtaggagatacttggccatgtttagtgggagccaatggatgtatacctaagaatctgcctaaacctcgaccgtgcttcctg

SEQ ID NO: 162373 - DNA, 430 bp, Homo sapiens
ctcttttggggtctttgctcttttggggtctttgctgatacacgaagatctttctctccagcctaatgcatcacaggccaacatcagaagcacagatttggcccctggccctgaaaagagagatgggaggagaggatggagcatgggatccaggcactgctctgtagctggggctctgagctctactctccataccctccttcagaggagacaggtggggaccgaagccatttccccatctcccacagggggacacagactgacaggcagtcaatgacccttgtttctggggccttgtcttctctcctccaggcatctgaaccttgcagcttccctgcccctcacttggcagccctcctgtctcagcagtggagagaggtgggggccctgggaaagagttgcccgttcctagaccagactgcagagctga

SEQ ID NO: 162374 - DNA, 378 bp, Homo sapiens
gaaactgtacttggggcagttctggctgtgaaactccttttaccacagattagagtccatatgcttcccttcatctgatatgcatttgacttatgaaggggagaatagcagatgattagatgcctcagttggaagaaatttgcctcacactggtagaggtatgtctgctactgtgtaattttataatataaattggatttaacaactgcattctaaattataattcaatctgaaactaggcacatcctaaacaaggaaaatgctagagtgtgaatcacgtatcttctttcttggaaaggcattgtttttgtttcctaacagagggttgataaagaggataaaaatatggaaaaagttctcacccaataatgtggcata

SEQ ID NO: 162375 - DNA, 974 bp, Homo sapiens
caccactcctagctaacttttatatttttagtagagatggtgtttcaccatgttgcccaggctggtcttgaactcctgacctcaggtgatccatctgccttggtctcccaaagtgcggggattacaggcatgagccactgcgtccggccagatcttcttatttatattgggctaagcatcatatctggcaaaatgaaagcaagtctttgttatatgttcagtttgctactgtcttccatctcctggttcctttgactctatgtcttcatccttttccaagaagtctcttgcacatcttccttcccacaccacaaaagcatctcttgcacgtttgggagtttgtgttgtccaggcggatgctgtaggttcaacttcagccaataaaacttcctctcacctgaggctataggtgtctctgggatcagtaagtcacttactgagcctactttcttaccccagattctgtgcaccaaatcggagaacaataggctggttgtgcaaatagacaatgccaaattggctgcagatgacttcaggaccaagtgagttggggttggacagggatgggaaggagccaagtgagagttggggttggatggggatgggacaatgccaagttggctgcttctgtctcatgtggcatcggatgtcattgacccagaccccaacccagtagttcatagcagaagagaacaaagggcattaagctcaagatcctgaaaaactatccgctctccagtggtttagcattaacagtttacaacatgtgctagaatgcatcatccacctggtaagcaacttgtgaagcaggcgggcagggatagaatctcctccacaggtggggaccctgaggcttggggtgctggtgtgacttgccagaagccatgtgggtaccgagtggcagagctgggacttggccttaaattttgtaccaaattttcctttcttgctatagcaatttcctgtgaaactgt

SEQ ID NO: 162376 - DNA, 564 bp, Homo sapiens
ataaaggaaccagcacaataaaacagtaagcaaaagatctaaacagagaagatatacagatgacaaataagcatatgaaaagatgctcaggctgggggcggtggttcacgcctataatacgagcactttgggcatgtaaggtagaaggatcacttgagttcaagaccagcccgggtaacatagtgagacaccatctctatttcaaaaaaagaaaaaagaaaagatgctgaacattgtacatcattagggagttgcaagttaaaactatgagataccactacacaacggtcaaaattgaaaatacaacaccaaatgctggcaaggaggtaaagcaacaagaactctcattcactgctggtcagaatacaaaatagtacagctactttggaaaacagcttggcagcttcttacaaaactaaacactcttaccataaaatgtgctgactcaatgaattgaaaactcatgtccacacaaaaacctacacataaatattcagagcggctttatacataattgccaaaacctggaagcaatcaagatgtccttcaataggtaaatgaata

SEQ ID NO: 162377 - DNA, 386 bp, Homo sapiens
cctcctcacttgagctgtgcaaactagggcgggttgcctgacctctctgtgttctctcatctctaagatcagtacagtcgcagtctgcgtcgcggcgagccttgacatgagatgctgtgggtaaacatgcctcccctggctctcaacgcgtccgcagtcagtcgcatgcatccttccttccgctcctggacacccagaggggtatccggcgggcggagaagccatggctctggaagcctgggaccctcggatgaggcaggctgtggggagagaggctgggaggatggcccatcgtcgcgctgtcacgtgggtaattgagagtttgcggaaattcaggggttctggggaagcgaggttggcgcgtctgtgtgtgtataatttaatgc

SEQ ID NO: 162378 - DNA, 262 bp, Homo sapiens
ttcccaacctgtgcccgggccagccagggtaaagtggcttaatcttcaaccatgttttcatcttactcaacagatgttgcccaaggccttgggtagaagggacctagggtcaccaccctcctgtggggcactggtggggcaggatggagaggcaagagggcttgtttgccacggacactcctgatccttgcaaagagctgaagcagcttttctcaacttctgaaaaataagtcaaaagaatttttcaagggtgatcgccaaa

SEQ ID NO: 162379 - DNA, 248 bp, Homo sapiens
gtgacccatttctggccaatgcaatgaaaggggacacctgtatggggcttctagaaaaggttttcctccaccagggaagagatctccccactaactaccctggccatgcccctgtctcctccggttttgaacacatggtgcctggagctgccgccttcatggaagcatgagagaaagaagaggctcaccagagaccaaatcagagctctgacatcacaaggctgagatgagagtcttcgaggatgcat

SEQ ID NO: 162380 - DNA, 261 bp, Homo sapiens
attagaaaaactatgcttttccaaaacttaagcaaattatcctcttaattctctgcaaaaataactagatcttttaatagaaaccatactaaacaagatgaaatgagtatttgacattttttatgataaaaaagtgaatatattaataagcctctaaatgacgattaattagcaacagagtgttattctgttttgttttttactcaaaaatgcaaattatttacttacaaaaatccatttaaaacatcaaggttttttccc

SEQ ID NO: 162381 - DNA, 500 bp, Homo sapiens
tgtgcagaagtgcatcaagctgaggccctaggacctgcagggataatccaggggctcaagaaacactgattgaatgaaatgaacaaagaaagagcaagcaagctatgtattttgctggaaccttttacatgagactcaggtttcattttgaagacacccaggtcaatgtgtagattatcttgactctgcctctttaaatagagcacagattgttatatgcaagttgcgtgctagtgtgttttaagtagagaaacaaaaggagtgtctttacattagtgttttcttcaaagaagatagagatcattcaggatgctaggttttttttttttcacttattttgaggatctttacaaaggaaaatggcactttgaaatcgcaaggatgatgtagctatctggttgggtttgatcctgccagttccgctaggagaaatcttacttcatattggctgaattgctgacatgagttttaaagataaaacaatttgagaaattgaaaat

SEQ ID NO: 162382 - DNA, 493 bp, Homo sapiens
ttaaaaagaaatcctccttactatcattcccagatattcttgtctcagctaaagatacttgtttttcattttgagtaaatattccaagtaactaaagctctttcagatttaggaagaaggcgtttttcctttcccttcctatcccacatccggtttatcagcagtgctgtcatctttatcttcaaaatatatccaggttcctttacttcttaccccttccacttccgtgtctggttcaagcccctgtagtttctctgcaggttggttgctctgtctcctaactgcttttcttacttctgtcctttcttctcttgcagcctgtactcagcaaggccagacggatcctctgctccaaacttgccctggctgcctacctccctcagcatgaaagctgaggttctcgcagcagactgcaaggctctttattacagccgagccctcctgacgtcattttcctctctttcatgtctctctggtcacttggcctcctttc

SEQ ID NO: 162383 - DNA, 512 bp, Homo sapiens
tctgttttgtagttttaactgttcagaaaactagttgtggaatttatacaaacttgagttatttctaagctgccctaatgcctgtccgtttttcccattaataagaaaactattaatttaatgctgttattaaattgtctgttttaattctttagatgatgtgacctatctcctttttaccctctacaatttttctacttaaattaagaatattacttaagcctattataagttaaagcatgtaaatattctttaactcactaaatgagtcagtcttgtagaaaaatatttgaccattaggtccaggggagtgattaataatttttacaggcatttgtttaatatcaacaaaatattctagctgtcatgatagcaaatatagtaagacataactttttctccagatatatcagaaacgttttaggaatgtgatttagagcctagcaaaaactcacagttagtactaagtcatctaaagtgagttggtatggaagcatcagcaaagctactct

SEQ ID NO: 162384 - DNA, 274 bp, Homo sapiens
cctgttccccctaaaatcagtcagacctgaccttaaatcctggctctaacactgaataaatgaatgagcttgagtaagctgccactaggagcttcagagtaacaggaatacattccctacacctcacaggctggacatagaggtggtgctcagtataaagggggatcataacttcactggacttttcaatcttacatcaagagcagagggcagtgttagacattcagtaaatagccgtcattataataaggcatgggctcatgaggattaaatg

SEQ ID NO: 162385 - DNA, 766 bp, Homo sapiens
tggaggcaaaactaatataagtggagagtttatttgggccaaacttgaggattacaacctgggaacatagattcaagtttccctgaatatacactcctgttagcagcagttacaagtggagtttgaaaggcaaaatagggggacagggggtggactgtacaaagttgtttgctaggaattctcactggtttacagaaccagtgagaattgattagtgattgactatacgttgttaacctataaggtatggattatagtgttattataattcacacctgatgtggattattaagctaatttatggctacttatggcaatagtaagcagtttaaacagatgaatacatagctcaaaggaggggagtaggcatgattgtaatctcattttaatatctatctgggcctgatatttaaaaggacttgcattcctcagataaaagttcttttcttttctcagttgctacagtgcttcagtttaaacttcacatctattggaagtctttcaacgttgttaatctggattagagatccttgagagaaaatgccactttcttttttactatactgtatttaatatgctcaatagtatcaataggcatatttctgtttatgtaagattgtagtgtggctgaaggctgaaggggggcaagagcacatgagaagctattgcttccacttatctgcttttcccaggttgaatgtgtgctagattattttaggaccttttgggctcaaaaaatcaatggggaagcctgaatttagatgat

SEQ ID NO: 162386 - DNA, 221 bp, Homo sapiens
gccagcaatcgactagagccagactctacccccagtgcaggaaactaggacgaggcagaatcagccctcatgttaccacctatgagcatacacatgtgcgtgcatgcgtgcgcacacacatacacgagcgtgctataggaaaacagcaagagtgacgccaccttgaagcgtaaccgccaggaggactggtgtctgacccttgcatacaatgtgtcctgcag

SEQ ID NO: 162387 - DNA, 265 bp, Homo sapiens
aaaggtcacttttgttatgtgttagcaaagagactggcagcattttgcccctgccctagagatctgtggaactttgaacttgagagagatgacttagggtacctagtagaagaaatttctcagcaggaaagcattcaagaggtgacttgagtgctgttaaaagcattcaagaggtgacttgagtgctgttaaaagcattcacttcagttttatgtattcacaatgatatggtttggaattggaacctatgtttaaaagggaaata

SEQ ID NO: 162388 - DNA, 624 bp, Homo sapiens
acgctggagtacagtggcacaatcatagctcactgtagcctcagactcctgggctcaagtgatcctcccacattagtccctcgagtagctaggatcacagacgcagaccaccacacctggttaattttgtattttttgtagggatggtgtttcaccatgttgcccaggctggtctcgaactcttggactcaggcaaaccttctgccttagcctcttgagtaggtaggactacaggtgcacaccactatgccttattaatttttttttcatttttgtataggcaggatctggctgtgttgcccaaggtggtctcaaaatcctagccttaagtaatccaccagcctcagccttctcaatacctgggactgcaggcatgcaccactctacctggtttgattttttttcttagtgggcagtgagggatgttgaaggctttgcacaagggagtggcatatttagagtcacgcaccaggaaaatgagcgtgcagggcgagggctgacattgaaggtgaccctggaagttggggccctgctggacatgggtcaggctgtggcgtccagctgtgtgagatggaaaaccattctgttgtcatgactccaacgtgtctttacttctcttatagg

SEQ ID NO: 162389 - DNA, 151 bp, Homo sapiens
aaaaatggttgtaacagtggttttacatcgttaaaatgaatgtttattatttcaattaagcttctcaccaagaagcttaagtacttaaattatttacaatttatcacccagtgagttttcctcttggccctagctgccagaaaacttaaac

SEQ ID NO: 162390 - DNA, 263 bp, Homo sapiens
agagctctttgtgttggctgcctggggacttgaagagctttgcttttgagaactttggtccttccctgaaccggctgctgcagctgacagctctgcctgagtgggaaagtttaaacgaggacaataattcagtttgagtgcccctgaatcatgtctttgtctctgctcttgacagaacagaaggaagtttttcattattaaggatgccagctgcccacagattgatatatctgtagccagggctggctcactctcaagtaggt

SEQ ID NO: 162391 - DNA, 246 bp, Homo sapiens
aaaaagtcccccaaactctagggcagttttcccgttaacacccactttttgctgtgcctcagacccgcgctctcctccaacttcttttgctttcccataccaaaagcaccatcttctcccttttccccgaacccagggggctcccctgaagccttcactttctctttagcttcacctcgcacccttgctcttccatgtacaatccttccctcctttcgcctagtctcttccaagactttcctgaca

SEQ ID NO: 162392 - DNA, 152 bp, Homo sapiens
atgttataaagacattaagtgtccactcaataactttgattcaaactatcttcatgttcttcacttcacaagataaagctcttaaaatggactttgtgaggttccatgtgtttggtcagtcatgagaggaagaataattcagagtgagagga

SEQ ID NO: 162393 - DNA, 656 bp, Homo sapiens
tttttattggctctataaagttgacttcaattcctaaaagcaatctgataatatctgaaaatatgctattccagtcaaagccttggaaaaataaccagtgtctccaattgtgttccattataaaagaaaacacattcttactgaatttatgcaaataactagattgccacaaaataagaatactcctgaatagtttccaaattttggagaactcaggtagagaaaaaggtaaattttgctctttttgagtatttgaaaaaatactcaacttcttggtacaataaaaacttcagctgaattaaattagtgtttaattgaacaatgaaagatttgcgaatcaggcagcccccagaatcacagcagtttcagagagactccagggatacctcgtggtcagaacaaatttatagacaaaaaaaaagggaagtgatgtacagaaatcagaagtgaggtaccaaaacaattggattggttacagctctgcagttgccttatttgaacacaactggaacactcagcagtgtgtgcgtggttgaattacggctgctgggattggccaagactcagtgactgttacaggtgcatactcctaagttaggttttcaatcttgtctacctattaagctaggttgcagttcatccataaggactcaaat

SEQ ID NO: 162394 - DNA, 495 bp, Homo sapiens
tcattctccacaaggtgaaagtttagtaaacagtgaatagcttaaggaatttaagaaggatgaatctcagatcttggtgagcaaaatgaggacaaacaataaatcttttcctcaagagtatttggttgcgtatgctaagtctgaatctcttactgcaagtaaactgtgtgatatctattcttacagacaaagtaaatacagctcttcaaggaacaacctgcagtcatcagggacaggagcgtctccatgaaggaaacctcacaggcctttctgctgaaaaccttgcaactccttggagagggcagccctggcagaaactcagacaaagcaaaccctacaggggagtgaattgattataattttagcacagatttcacagcccaggatcccccactgtttgttgcaggataggaagtccagactgttttttatctgcctattcccaggttatcaaaatgattcattatggccaattcctgagagattgatctagaa

SEQ ID NO: 162395 - DNA, 574 bp, Homo sapiens
cttttggtgttggagttacttgtggctcaatgttataatatatttcagaggcaaacaagatacttcccaaaatgtcaaacattaacaaaattataaattcaggaaataaatttgatgttctgggaagatgtaatttcctgacagtctctaaaatcatgtcctttagaccttcaaaacatgtaaagacatttgtgtaaatctcacacttttggaatttttttcctcttgattttccctctaaaaaacattttataactttgctattaatttgtgacattctttttacctttcaatagaactttaacaaaattagtctttgcgatactcttaaatagattaatttgagaattttaaatgattttaaactttgaagaagcagattgtaaagacatttatgggaggagtgttacaccatgcctcatatttcagactttaaaaccaagacacattacttttttttgtacgtaagtattttctaactttgggcaaatacttaaattccactctctgtttcagcgtgagattatttaagtcatttaaattaactcatgaactttgctttagaaaaatgttt

SEQ ID NO: 162396 - DNA, 448 bp, Homo sapiens
ctcataaaagacagctgtatgagcttcactaatgtatttgtcctgacctgttgttgagcccgctgttcactacaacccatgccatgctcttcatgaagatgaacaggagaaatctttcttagggtttactatgagaaagggctacactattctgaagcaatatgtttgtttcaatttaatagatgttacaaatttggcactggattaccaagaagtataatggccacctgcagcaccacgggaactaaccaactaaccttccctctagatccatctcacagcttttatccctctacccagcacactatccctctctttctttaggttgattccctcaattatttattctgttcttttagttatctttttcacttaaaatcctttgggagaacaaagatgtattaatcaatttcaatgtgtttatatttaataaaaacttctttaaata

SEQ ID NO: 162397 - DNA, 700 bp, Homo sapiens
aatcttgtattttcccataactaaaaaaattataataaagcagtcaatgttaatattaaatacaaacactgccctacatcacccattctttttcagattacataagtacttttgctccctctctacaaactccttgtatctgaatacttgatccaaccattcattcataaacatctgtcaaatattttatctcttcaaaacctccaacttatcgggcacctcatatgtcaggcgcactattcggtacttcacaacatgacctaattttatattttataattaagtttatactgctaggagagcacctccccggccaagagtcttatctcaattacctctacttcaggctccttttacctagatacaacactaccagtgctcttggcttcaaccactcattttctccagagtccagtagcatcatcaatttattccttctggtaacttcaacttctatttacactgagtccacttaacaaaaaactgtatccaattctccaaattaaaacaaacccccttcctagagcctgtatcttgctccaggtatatcctttatgtgctttactctccagttctttgagacagagtctcattgtcgcccaggctggagtacaatggctcaatcttggctcactgcaacccccacctcctgggttcaaacaattcttgtgcctcagcctcccgaacagctgagattaca

SEQ ID NO: 162398 - DNA, 199 bp, Homo sapiens
gaagaggttgctgactgtaagttgaaaggaaagtttgacggtgcaaagggtcctgctaaagttgcctggaaaaaagtggaagaggaagatgaagaaagaagaggaggaggacaatggatgagaaaaactttctatgccaggagtgatggctcactcctgtaatcccagcactttgggaggccaaggcgggtggaggtca

SEQ ID NO: 162399 - DNA, 469 bp, Homo sapiens
tcttcatagctgactctagaggatacaccgacagcacactgaatcagtgtaagccacaaacgatacaatgacatctttaaaagaccaaaaagaaaaaactgtcaaactggcaaaatatatcattcaaaaacaaggctgaaaggctgaaataaaaacattcagataaatgaaagctcagaaaatttttcaacagtagacctgtcatttggacctacaggaagaaatgaaaacaccaaaaatggtaaataaatagttaaatgctaaaaactagcttttttctacttgatttccttaaaagacaaaagactcatatatatctatatgtagagagagagagctgtttttttgtttgcttgttttagtttttgtttttgagacagagttttgctcttgttacccaggctagagtccaatggcatgattttggccatcgcaacctccacctcccgggttcaagcgactctcctgc

SEQ ID NO: 162400 - DNA, 241 bp, Homo sapiens
caccgtcccctgaatgatgccaaatttcacacccttgttttttctcacattctgcctttcccaattgtgcctgtacttcatgagtcatgaaatgcccatccctccatgacatccttcattcacaaagtctataacagcctctcctccaaactcatttgaaactactaagttagcattataaatgttagtgcacaccattctctaatgatttcatatacattaatgttattttctaaagtag

SEQ ID NO: 162401 - DNA, 611 bp, Homo sapiens
cttaagttaaacataaagaattcataaaggtgacaaactccttaatgaatcatccactgaccttaggaacatagagatgtgaaacacatagctcatgcccactctcttttatataaatattatccctgttgctaacattgtggtgggtgggtcatagagtcagtaaatgttgtttaatggtgagttggtgtcctttattctctttcttgtagtcaatctggtatttagttgattgctgaaagtaattatcatttgcattcaacaaataacattgttgatactggtattctctaattagagcattacgattttctaaatagtccattagagttgcttatattgttcacaatcaaggttattcaatataagcaaacgctactgatttactaattattcaaaaatggacaaaaatgtatacttctttgatataaaaatagaattactagatactacgatgctgataaggtgctgtggttaaattgttaattgcttaaaatatttaagtaaaaagtaattaaaatctgtagttttgaattcaaatatattcagtttcaatgtttaccttattataacagtgcatcttaaatgtttcttcagaaaagtaaaaggaa

SEQ ID NO: 162402 - DNA, 242 bp, Homo sapiens
tctctctattctccccgcccatcaaggagtctgagatcgttcactttttcctaaggatgtcctcaaagatgaggttttgaagattatgcccatgcaaaaagagacctatgctggccagtggaccaggttcaagggatttgtcacagtcagggacaagagtcacatcagtctgtgtgttaggtattccaaggaagtagtccctgccatctgcaggccaccattcactggccaacctctccatt

SEQ ID NO: 162403 - DNA, 456 bp, Homo sapiens
aataaataacggcctccctaatattttgcataaaaattatttcagtttataaaaccaactaccaaaaaactgaggttcagggccgggcacggtggctcatgcctgtaatcccagcactttggaaggccaaggctggcggatcacttgaggtcaggagttcgagaccagccttgccaacatggtaaaacctcgtctttaccaaaaaatacaaaaacttaagctgggcatggtggcgcaatgcctgtagtcccacctactcgagaggctcaggcaggagaatcacttgaactcaggaggtggaggttgcagtgagccgagaccgcaccactgcactccagcctgggtgacagagagagaccttgtatcaaaaaaacaaacaaacaggccgggcgtggtggctcatgcctgtaatcccagcactctgggaggctgaggtgggcggatcacctgatgttg

SEQ ID NO: 162404 - DNA, 628 bp, Homo sapiens
atttgaggttgtctggaaaaaaacagcgagttgaagtgacaacaaaatactcccctcaagagtggaaaatcctggccgggcatggtggctcacgtctgtaatcccagcactttgggagtgccaaggtgagtggatcacttgaggtcagaagtttgagaccagcctggccaacatatagtgaaaccccgtctctactaaaaaatacaaaaattagctggacatggtggtgcatgcctgtagtccccactactagggaagctgaggcaggaggattgcttgagcccagaagctcgaggctgcagtgagctgtgattgcaccactgcactgcagcctgggtgacatagcaagaccctgtctcaaaaaaacaaaaaggctcaatgatattttattgttgctgtataggtttatttcaacattgctctgttgttggatttttccatttgcttttatgtcagatgctttagtgaaatctttatacatgtatctttgtttcttaaattattccactgagataaatttctagaagtagaattgagtcaaagaatatgaacattattgtggctctcactgcatgttgctatactggttttcagaaaccctttaccaacttttaccagcagtaatgaa

SEQ ID NO: 162405 - DNA, 281 bp, Homo sapiens
cgcctcggcctcccaaggtgctgggattataggcatgagccactgtgcctggccaacatttatttgttaactatatttttattttgttagtcttctgccacatttatttgatccttaggtggttgttgtgtttgtgtaaccaacctctagttctctgtggcagaatgtgggcataaagaaagaagtaaagttatgaaattttcttcttaataacatttgtttaaaagaaaatacaaaaagccacttaaatcctaattcatatgtctgacacagccaaatca

SEQ ID NO: 162406 - DNA, 315 bp, Homo sapiens
ccctcacggattacctcaagcaatgatatgggtttgatgaacaagggtcagaagtttcctttggctgtagtgttcagtgatcatggcgttctagggagtgcaaagaagaaaataagcagccaatcctctaagacctttactctaattagggagtttcattaaacccctgaaaagcttaataaaaaaaaaaaccaccaaacaaatgaaaaccataagtacttttacaagataagataagtgctgttgcaagacaggaattaatggcccctgatgtgggcttgggtacctacaagagtctttgtggaggttggaggg

SEQ ID NO: 162407 - DNA, 429 bp, Homo sapiens
ggcatgatcttagcctcaaactcctaggctcaaggaatcctcctgccttggcctcccaaagtgctgggaattataggtgtcagctactgagcttggcctcacaattcatcttgagtcagatctgttagaaccttaatctttatcctgctctccaggaattcttgagaacgtggagaacaaagtatgttaactgactccttctgcatggccacttctgggttcagtggtattccccggggctcaaatgaagattattttattaggtgttttctgttaactggccatttttgaatgaacagaggggtcagaggattaaagcagaactcacagggttcacaaacaatttactagaaatcataggtatcaaattgagaacatattcttttttttttttttttttttggaggtaacccgggaggggggtcccga

SEQ ID NO: 162408 - DNA, 477 bp, Homo sapiens
atacttacaagagtctccaaagcaggtgtagaactttaaacgagatgtgttttccaactgggctgtccgttaatggcctaaactgagggcaatgtgatttatcatcagaaagatacataggtcaattttttccattcagccttggccaatagtactgaatatttagggttcaatataaaatgaatttgtaacagcactattttcaaaagaatgagtcttcacgacaacaaaaagtagatctaatcagagttgcaaaggcaagggaaatttatcaggtagaacagatgcattcaaagcaatggaacttgtgacattttatttccaatgtgcatggtaatcaccgctaaaatgtttacacctaattaaatatggggaatgctcttacttatatagcatcatagaaaaattaaggagagatcaaatatacacaaggagctaggtatattttgaattattttgacagtagagttgaagaaa

SEQ ID NO: 162409 - DNA, 251 bp, Homo sapiens
aacaaaaacaaagtactcactagtcaggctgactttagaaaaagctttactttacccacactaatttagacatagaaatagagctgtttggccaggcacagtgagtcacgcctgtaatcccagcgctttggaaggctgagatgggaaaattgctgaagccaggagttcaataacagcatgggcaacagagtgagacccctgggctacaaaaatcaatttttttttgttttaaattagctgaatatggtggt

SEQ ID NO: 162410 - DNA, 495 bp, Homo sapiens
tgttttttgagcaagtttctgctatctctgctcttatgtatgcttgattcctctttcccccacacctaacccactcatctcaaaaatgtaatatgtcttttctgaaatgtaagtctcatcatttagaatccatcagtggcttactagcactttgaagataaaaatccaaaatccttttagcaaggtgtgtaggcctaccctattgagaaagattttaaatctttatgtttgaaagatacttttgctgggtataaaattctaggtttaaagatgtggttgtgctgttacctcctgggttgttgcattgtttctgacaagaagtctacagtcactctaatctttgctcctctgtatgttaagtgtcttttttctttctttttttttttaaaaactctggctacttttaagatttttctttttaccattgaatttgtgcaattcaattatagggtacattggtttagctttcttcatgtgttctgtgcttggggtttg

SEQ ID NO: 162411 - DNA, 370 bp, Homo sapiens
cccaaagtgctggggttacaggtttgagccattgctcccagcctgaatttttaattaaatttaaatttaaatagccacacatgtctagtggctaccatattggacagcgcagttctagaccgatgtgattcaggatcattccctcagcatcgtggggcaaagagaaaactgccccaagctggcctgtagaaggctcaggcgaaggtttcccaatgccgggatggggggtgcgctcagcagcatcaccccttatgattctcaatcgctaatagctccactcaggttcatttctcggtcaggggcatttctttgtcacagaaggaatcacccagctctgggagatacagcagcctccactcaggtagtcctt

SEQ ID NO: 162412 - DNA, 158 bp, Homo sapiens
aagtacagccaacaaaaatgtctgaagtctattttgggagctaatattctaggtttatcttttctacacctaccttgattctagcttctcaaagacaacgtagttaactagtccgtgggtgaatacttcactgagcccctcaagtggctaattatttg

SEQ ID NO: 162413 - DNA, 194 bp, Homo sapiens
tctgcccatcttgcccgtggacccacggtgccatggccagcccacgtccttggggcattttgcaagcagctggtctccccgccagagcctctactgtgcagggcctctggtttagggggggatgccaggcgttggggcctgtgagtcagctttttgcaaatgttggacgcctgtcactctgtctgcccatgcat

SEQ ID NO: 162414 - DNA, 451 bp, Homo sapiens
cctaatggagccgaacactagtcgctgggttccacggttctcttccgtgacccacagcttctcatagagctataacactcatgcatggcccaaggttccattccttggaatccgtgaggccaagaaccccaggtcagagaacaaaaggcttgccaccatcttgagagcagcccaccaccatcttggaagcagcccgccaccatcttagaagctctaagaacgaagacccgccggtaacactacagtgcaatttaccgagaaggagcccaaagacacaagactctagggtggcacaaaatgccacaggtttccagaactctggttttctgacaacttaggctacatccctcaaagagcaggctattgtaaaagagaacctgaagttgtcatatcacatgcttgctaccactattagacatttgtatttttaaaattaaaattgggctatttt

SEQ ID NO: 162415 - DNA, 616 bp, Homo sapiens
ctaagcccctcactcagagcagccccaccattccccagggataggcaggtcctcgctgtggcccagatgtcaacatgggcagctctgccccaaggatgtggcatgtgtttaaatgtataaaagatgaagaggagatggtaacagaagtcctcctaagaagaaaactatttagaaacatgtgctcactaaatcattgcagttagaagatgaggcccgaggaagctggggtggtataatttgttcattgctctgggaaaagagggagaaataaaagcaaggaggaagccaaagaagtagtggaatgggaatgcccccatgatctgaccctctccctaaccctttttgagacagagtctcactgtctcccaggctggagtgcagtggcgccatcttggcttagtgcaacctttggctcctgggttcaagcgattctcctgcctcagcctcctgagtagctgggattacaggtgcccaccaccatgtctggctaatttttatatttttagtagagacgaggttttgccatgctggcctcaaactcctgatctcaagtgatccacccgccttggcctcccaagtgctgggattacaggtatgagccaccatgcccggcctc

SEQ ID NO: 162416 - DNA, 297 bp, Homo sapiens
tattcatcacataccaataattttctgcttcctaaaatatgaaagataatgactcatccatccagcacttatcaatattgtttatgatagaaaaaagataaatgcatcattcccttttgtatccagtgcactggataatatatactttaaacatgcaaattttaaataagaaatgcatttatacaacacaactaataggaactcaaaggttttataaatattaactcttcacatttttataagctagttttacaagattcttattttaaacagtggacctaggatacatgtaaataa

SEQ ID NO: 162417 - DNA, 417 bp, Homo sapiens
tgtctgcaccagctctgagacttccagtgtgtatttgcaaacccagactgacttttatggcctccaatgttggggaatgatcattgcagggtgtcttcttgaccactcgaatttttgggacctcagagaaaatgctgccaccagccaattcccacaagacacttcagggaagagaacctcacagtctcagacaacaggctgcaactcctggggaacctgaacaggctggttgctgggcaggcctggtagaattaacccaacttcccatttcattcctacttgacattccagagagatgggctggagaaatctgccttgtctgtctttaaaagaagacatttctcccacggcttcctcctcttcgaattccctcatctatccatctactctcactccccttccgctctcaaagctgtt

SEQ ID NO: 162418 - DNA, 234 bp, Homo sapiens
gttcagtgttgagccagaacatataaattcccatctgaaaacctaacttcaggaaaatcacttgaacttttttgtgtctcaccaagtatgaggcctgtctctgcagcctggggatgttataaaggtggattagcccatgtttttaaagcacttacagctcccatggggaaaccttttgcgacttccaggcataattacctgtgtattccagctggaataaggcaaacagagtgc

SEQ ID NO: 162419 - DNA, 105 bp, Homo sapiens
tgggattcaaatgctctctgccaagttatagtttctgggtcaatattcagtcctagaattctgctcaattctttatcagtgtgatagagtcagattctcaattct

SEQ ID NO: 162420 - DNA, 511 bp, Homo sapiens
tccatgactttcccattatttcacactagggagcattggtggttcaatggcagaattctcatcacccattatttcagactgattaactccatcttctcttccaggtctcctctgccatgcaagtgggatttggctccttctagccccatttttcccttccctctcacttccgaggttgctggttattaacacagatattttaacacacacacacagttccactcgggttaagaaatgctgtcgttacactagaaatttctggggtgattctaaaaaagagaactttctttaaacgtaatcttttagctagtatccactttagactcagaaaatgtaagttatctacagcctgacaaagactagtacaacctattcctgtctcaaaatgtttctaaaattagagtgaacattgtgttaactgccacagttaaaatcaaaatgatggatttctcttctgaaatcaatcctaaaatgcttcctctcctggcagtcagaaaactcattcaccatt

SEQ ID NO: 162421 - DNA, 177 bp, Homo sapiens
tgtctccctgccaggtgcttctgtggcctatggttgccctgctgctccctggacgagggggtgggtgtggaccagccctcgtggcccctctgcagccagcaccatcctcagtaaagactacaggtatttcctgagcacctgcagggtgccaggcactgtgctctgtgctgatgaata

SEQ ID NO: 162422 - DNA, 302 bp, Homo sapiens
aaacacaagcaagatttattaaatacaaatcgactgtaatgagaggtttatagtaaaaaagaaaaaagaaaaaaacaaatgttgtaatgttatattacttgtatgtgtacatgattaaattgaaagccaaaacttttaattaagatactgaggtttatttaggcacctctcagcatgttggatgtagttcaagaattttctgaaaaaggaagcttgtttattaagtgaaaatgatgtgtcttttgaagcaggcatagaaagtcaggctacccttttggaataaatgtctaaaattttatcac

SEQ ID NO: 162423 - DNA, 322 bp, Homo sapiens
ccagatctggataagagaccttccttcacaggtgcactctcacacccacactcacttagactgggactatgtcgacatgcccattcacctagtgtgcacatctttggggtgctggaggaaaccagagtacctgcagaaaaccagcagacctgggaagaatgtgcaaacatcacatagacaatggccctggctgggaattttttttttctcatcagccttgtaataaaaagatgttattccaggtcctgctgtacacatattaaataggcaaagatgttcaagtttgacagcaccctccattggcagggctaagcagaaacac

SEQ ID NO: 162424 - DNA, 619 bp, Homo sapiens
ccaagcgtgacagacacaaatcgagcacacggtgttgtgaaagtggtgcccgtagactctcttgatgcagacttgccgcaagccttcagtatgtaaaaaacccaagaacacaatatccgtgaagcacagtgaagtgaggtgcgctgttgaagttgatggtgttcactgtacatttcataaccacagttagaattctatactttggagtttggactgggcaaaaatgtagtgataacctatcaattatggctttagcagagacatattctataggaagcaacagtagccagccctggctagtgtaggcaaaagtagggtgtgtagaaggggcctggagtatctcacagggtctaaggaacagtgggtacatgagcagcaggaagggatgggaccaggccagccctggtcagggactccccgtcagagcactggactttacagttctcgaacctcagtcctcggcctctgtgcccttcactttacatcttgagcaggagaatcacagtggccaagagaaatccagtcagctgttgtgtcccagtcagctgtagtcagaggcctagggtcacggatcaggagcctgactgccaggggcccagtgtgtccacccagcaggtga

SEQ ID NO: 162425 - DNA, 150 bp, Homo sapiens
gcgtgagccacggtgcctggcctaaaattgctaatttttgacataaggcaatttttttcttttttcttttctttttttttttttgagatggagtttcgctctgtcacccaggttggagtgcagtggcgtgatctcagctcactgcaagct

SEQ ID NO: 162426 - DNA, 246 bp, Homo sapiens
tcattatcacattctgaagataaacagccacaggatctatgaactctcatcaggcagttaattattcttgaatttttctgcactcttgaaacatattctatttatttaaccgtcccctgggagccctggtcgcctttgtccctgccacacggccagtggtgtaaaacctctgcatctgtcagatttctccatgtggagcgtaattgcctgatttccatttgaaagtacagccctgacattaaaatg

SEQ ID NO: 162427 - DNA, 281 bp, Homo sapiens
cactatggtcaccgagaaaaggtatggaaggagaggcaggcatggccctgcttgtgacggctctgttcagtagaccaatatttttgtctaacttttgttagataaaaaaagttatgtttgtttggagaaaaaaagaaaagtgatgggaaagctgtggactggcttttggaagctgggttttctccccagctcttgaactgtgtggaggcctcttcctgtgttccggcctgtggctcttctgggcaaacgcttgccctgaccttcatttagtagatatgagg

SEQ ID NO: 162428 - DNA, 376 bp, Homo sapiens
aatattgagaaaacacttcccagtaggtattaactaatccttagctgtagcagttagaaaagcacactcctaaaagattcatttcttacaggtacttctgctttttaaatttattccgaacacccaacagaaacaaaaacaaaataatgttgtttttagttccttaagctaacaaaggtttttctcaggttacattttattatgctgtttgtgatcacgggcataaaattacctttcaaaacaagaaaattcaagaacaatccagggaaaaatacaagtttaatgctatagtaaatttagaatccaatctatcgtctctagtgaaagagataccagtgtccttggcatgattacttgagaagctagcagaggttaa

SEQ ID NO: 162429 - DNA, 412 bp, Homo sapiens
ctaaatctctctaatttgtttcccagttcataaagtggaactaactttacttgctgctccttcttgtccaaataatttgaatatgaaagcactatatcagcataaaagctgacatttatgaggaactaatcccgtaccagcgacttttcaggtgacaccttctctaatcgttccttgaccccatcaggagcacacgatccctgtttcacaggcagactgcctccctgctcttagcatcctccagttacacatctctttccgccctgccttccccgaggtgctggctttcacttgtcagtgacggtcattctgaggctgagatgtaagagatacgaagtacctgtccttaccccacccctaatgcaagcaatgccatcctgttggcacgtgccacggttatctctggggccat

SEQ ID NO: 162430 - DNA, 502 bp, Homo sapiens
tcgcttatggggtctttgctcttttgggtctttgctcattcacttgtgagaggaatgttagttgctttagaaaatacatggtaattatttaaagtgtcctaaagaaatgtggtagctgtttcattctgttgaaaatgggccgagcgtcagttccattttctgtgcatggcagtgttcgggcggaggcaggtgcatcccggggaggagcacagttcatggtcctacgtctcctacgagagccgacaggaaatctgcaagagtaccttcagcccctcgcagatactgtcctggcccttctaaagcatccccttcccagggtccagcacggaagcactcctataactgtgcagtgagaccttcatctgggattggatatagttataattggagaggagattcagtctagatgagacgattaaacaacaagagaatgtagtttaatattgtcaaatacccatagttcataatgacctgagttggcagttaagactcctatgtaatg

SEQ ID NO: 162431 - DNA, 204 bp, Homo sapiens
ttgacgtggcttgatctcagctcaatgcagcctcaacctcccaggctggtctcaaacgatcccccgcctcagcctcccaaggtgttggaattacaggtgtgagccaccgcgcctggccaaataaggctatcttttaaaaacagtaagttcttggcatctggtgggtagaagccaggaacactgctaaataaccatacagtacac

SEQ ID NO: 162432 - DNA, 541 bp, Homo sapiens
aacagttcccctttctggcaattcataccaggaattgtctttttaaatattttgatctttttgtaatgttcattctattggagtgagataagatctgagtgtggttttgatctgcatttttctcatgagtagtaatgttaaccacgtttttgtagacattcggtcagtttcctgtcttctttggaaaaatatctaatccggttatttgcccagtttttgtctggcaattgttctgttgttttgttatttttttgccagctggtagtatgactggcttgtaccttttcaaaaataatcccttatcccaaacttgtaatttttagtgtgcctttttattttgtttattgtttcctttgttggtcacaaatgcttcagcttgacgtggtcccacatgtgcataatttcttggtggctgtgctgttggttactaatcaagaaaaaacaaaatcactaccaaagcagtcccttgtcaataatttttttcccttgtatttttgtttactttttgtgaaccctgagcatacatccaagttgctctaaa

SEQ ID NO: 162433 - DNA, 242 bp, Homo sapiens
tgctgggattataggcgtgagccaccgcgcccagccgactatccaaattttgatcttcaaaactgtcctcattccctcctctctctttccatccttcagatacgatagaaccttctatgtgtttaaatggcagccttccatcatcacatcagtgactccttagcttgttacatattctttcatgaggccatattttgtgtacctgactttgtgtatatcattgacaatggaccctggaaaag

SEQ ID NO: 162434 - DNA, 506 bp, Homo sapiens
ctattttttttcctatgactttagaattagattcttagaggattggttatattaagttcatcaaaatcaaaggaagcagggtcattttccaaagcactcaattgtatacgtatttagttctgcttttttttttcttgtcatttatatcatttaggaaatctgctatctttctgtatagaaaaagcagacatttcattttagtgataaaaattaccaaagagcaatctgacagcaaacttcacaaattcaggctcatgcagaaatagacactagacttcctttgtctcaccatgaaacactaaagatctttcacattttagatttctttgactattccctgaaacattttcattataaatattcataattaagcaaactaagtctttcatctgttttccttattttcctaccccaatctgactaatcagatactggaatgtgtgaaagtcaatgctgttcataaaggtaataaattacccccactcaaatccagatggattagagcc

SEQ ID NO: 162435 - DNA, 488 bp, Homo sapiens
tggatatgtaaccataaataatacttacaattatactttgcttttcatgtgccacacagagtttctatgaacaaggattaaattttcttgctaagactgagaaatcaactagctagagtctagaagggagatgtgcaacccaaggatggatttagattaatgattcttcgatggcctcttactattctcggggtgcagcacaagttccttcataggactttaagactctttgggatctagtccctgcgtatctctccagttctccttaccattctcctgtatctgcctctggctgcagctgtgccacagccagactctggaaggagcctcttgctgtcaattatccagcaagtgtttactgggtacccacttctgccaggcactgggttagaggttggagacatagcagtaaagacttgctctagtggaagacaagcatttaatactataattaactgcagtactgaagatgaacaagggtgatggag

SEQ ID NO: 162436 - DNA, 516 bp, Homo sapiens
tgccctggtttctagaggatccctctctgctcccagattctaggacactacgggtgtgggaccgacacgcactgggcgcagagggctgggttcggccactctgctgtgaccgtgctgtgaccttcagttactctcctccctgggctcagtttccccttcttgaaaatgcgggtcacgctgatggcccttccagccctgcgatcctcagcctctcccagcttggtttccccgacctcaggtgatccgcccaccttggactccccaaggagctaataatggcttggattctacctttaaaaggcattttttgtcaataatttctttttgaatgtcatttattagataaccacatagtttaatactctgcacaaatgtgttttttaagtatgattttgttatgatgagttttcattatgatcatagacttacagcctcaccatttactgtctgttctccagtatcttagaggaatttagagtttacatatagattcatagcatttttttgatctgagag

SEQ ID NO: 162437 - DNA, 254 bp, Homo sapiens
ttttttttctgccggcaatactatttgagatgagaaattttcattgcaatttacttgagggagagggtagtttatttttagttcatctagcactgaatgtgtagtaggtcttttgtgtatagctctgttgggatcttctactagatgtcttacctggggtgggggccatgtgctatgctcttgatccctggatttgtgaagacttgaagccaaagctgaagttctaactagtttgggaaatattcataagagga

SEQ ID NO: 162438 - DNA, 230 bp, Homo sapiens
aactaatacacaacttatgaaattattttttaaagcattctcccaatgtaataattatttcaaggaccctgaaacaatcaggtaaaaggttactgacaaacaagatcccatacggtttcaaagtttcatcctacaaattacttaatacaaagagaaagtcattcctttagaatctggcattcaatacctctaagcaagtgatcaaacttttcttttttttttttttttct

SEQ ID NO: 162439 - DNA, 639 bp, Homo sapiens
cagttttttttttcctaccccagtggtgcctggaaccccagcaagacagaattgttcactcctccgaaaagggggctgaagccagggagctacatggtctcactcagcaggtcccactcccaaagagcccagcaagctaagaaccactggcttgaaattctcactgtcggcagagcagtctgaagtccacctgggatgattgagcatggtgggggaggggtgtctgccattactgagacttgagtaggtggctttgccatgaccttgctaaggactgggtggaactaaacacagtgaggcaaagcgactgtggccagactgcctcattagattcctcttgactgggcaggacatctctgaaagaaaggcagcaacctcagtcaggggcttataaataacactctcatctcactggtacagagcacctgggggaaggggtggctgtgggtgcagcttcagcggacttaaatgttcctgcctgccagctctgaaaagagcagcagatcctgacaaggggagttctccaaccacagtgctcaagctctgctaagggacagactgcattctcaagtgggtccctgaccaccgtacctcctgactgggagaaacctcccaatgggttgacagacacctcataca

SEQ ID NO: 162440 - DNA, 339 bp, Homo sapiens
agaggacagggtacaataatagcccagactgcagggcaggagtcccatactctgaacctcagctccagggttctcttccagcctcttcacagagtcccagactgagcccactgtaggatctcaagaaacacttcttgacatgattccaaaatccattccacaaattccactcttgtctttcctctgcctgtccagcatctatcttgtttatctgtatcctatcttatcccctctccttccatactttctctctttgatcatcttggatccagctggtcatataagcagagataagtttgttcatttatttattcattcttttatctattcattttacaa

SEQ ID NO: 162441 - DNA, 581 bp, Homo sapiens
gttcttaattggaaaaccttgccaactcccaacctcaggggatccgcccacctcgagcggccaaagtgctgggattacaggcgtgagccaccacccccagccaggacttgtttttataatcaaatttatgatgatcccagggacttagctgacagcagagtaaaaaggaaatagaatctaatgggcaacactgactaggctgtggctctatggttagacatgaacatcacaaattgatgtcttatctggaactcatctacatgctgaagtgatacattataaaacagttgcagaatccaggcttgctgggactagtcagtgaaatcaattaccggagcacattatttcagatgcttattccttcacagaggatgtactttttgcataagaatgtgacaatactcacaatttctggaggtatagcctcagccaaggtaaaaattatcttctctcttataaaagggggctctatgtatctaggggtcttactacttacagacaaatgcattctacacttggagcttctagccggcttcatatttgcctgagccttaactgtcccttctccttgaaaatttaaa

SEQ ID NO: 162442 - DNA, 333 bp, Homo sapiens
ctctgtgtcacattttggtaatgtgaccaacgtttcagactattatatctgttatgattcgtgatcagtgattttgggtgtcattatcatagttttggggaaccacaaaccatgtccatctaagaaggtgaattcagtctataaatgtttgtgttctgactgctccagctactgactatttcccatctcttttcctctcctcagacctctctattccttgagacacaactgtcttaaaattaggccggttaataaccctataatagcctttaaagtgttcagatgaaaggaagggtctcgcgtctctcacaccaagtcagaagctaaaaatgg

SEQ ID NO: 162443 - DNA, 218 bp, Homo sapiens
gaattaagttgctggagacaattaaaaactggtaaatttaagatgtgctgtcaatgacatattcacattggaaccctctggaagattaagggcttttttcttccacttagttagacaataataacaagacctttggtctctgattatccaatctaagaataagtcaatctttggttatactagagtaatcaaagaacacaacacgttgatttggaaga

SEQ ID NO: 162444 - DNA, 212 bp, Homo sapiens
cccccatcccaggtgtctctgaggatcccagacctggcaggttcgcctgggaggagaccccccagccacgccttcccttggctgtgtagtcagcctggggtcctgccgccccaagtgtgcccacgtggctggcttgcacatgagcagagagaacatggtgtccccgggggccgtgcaggtctcagtctcgcgggtgcacctaaccctgatgc

SEQ ID NO: 162445 - DNA, 1071 bp, Homo sapiens
ctgatcttgaactcctgatctcaagtgatctgcctgccttggcctcctgacgtgctgggattaacaggtgttacgccactgtgcctggcccctttggttagaacaagtatatttgggagaagtgagacatgcccttccaatgaaatatcaagactggacatgttgaccttagaacctatatgggctttaatagatagaacataggcaaagctttcaaaagtatagttgagacaaggacttagattcaagtaaaaattcaatcattagaacattagctttacttggattatcaaaatgaactgatttacatagatgagtaagcatcacctcaagagtagtgaagtcagagtgcttgttttggaaattttacattaaagtgtatatgtcatcaaattttgaacagtttaatgcataatagtattttccccagcctgaacattcttagagactggattaagacaatgatatttcagtgaaaaccatctgttttatgaattacttcataaaagtaatttttattttgggctattttgtgacagtgaaaagtattacagggaaggtaacaaaggctaaatgagctttttggtggtggattagaaccagaggaatcaatataaactcgtagtgtttgatacttagtacagaaatgtaggtgtatgtatttgcatgagtttgtatgtgtccatgtatttcctacctctgtttgctaggaaggtagttaaaagaaaacttgcctcactctgtcccttttggacagaagttaccatttttgttcttactgattaataattaaatggtatttagagatgaagactgtgtcctaccactggcagaggaatcacaagcccttaggagacattgcatcccttccgactttgtttaggcattagaatttggtgggcctaagcaagttaaatgcagattgagtacttggagttggtagaccatgtggggattagaagggatttagtggtaactctgtcaaatctttacctctacaatagaatgaatcactcaaaactcacaggagtgtcagttttgagtcgccatttgaacggttgtttgattagt

SEQ ID NO: 162446 - DNA, 402 bp, Homo sapiens
  misc_feature (14)..(14): n is a, c, g, or t
  misc_feature (18)..(18): n is a, c, g, or t
  misc_feature (21)..(21): n is a, c, g, or t
aggatcccccggangcanacngcaacaccggcctgttctttcccatctctgtaaatgacatttccatcctttcagctggggaagcaaaaactcttggagtcatccttgatcctatatataatcagaaaatccttttgaatcttccttagaaattatttagaaattaaccatttttatctccacagctactatccttttatgagccactcatctcacctgtggattattgcaataacataatattgttattggattatagcctcttaatattcctaacttcatccttactaggcttcagtctgttctccatacagagcctgggtggagaacatcatcttgtaaaatacaaatagatcatgtcagcaccctgctcagaatccttcctgtcgcagtgtgcttccg

SEQ ID NO: 162447 - DNA, 773 bp, Homo sapiens
ggaggatcgcttgaggccaggagtttgagaccagcctgagcaatatagcaagaccccatctcctcaaaaattttaaaaagctaggtgtggggacatgcctatagtcctagctactcgggaggctgaagagggaggattgcttgagcccaggagattgaggctgcagtaagctatgatgataccactgtactccaagtccaaagggagggcccagaacaaatctgtcttcaaccccattgccaattgtcagttatatcagaacatgcccgtggtccctgatctttttcaggaaattaaaaagctggtccttatagcaaacaggaactcagagctcttggcgaggcagtatgatgtcttagtgtatgggcagcatgcctgttttcttgctgattttgcaagtgctccagaaatgtagactggtttttttctttcttattttagtatttcatatcctgatttttaaatgttgggccaaaaaaatgacacatctggctggacatggtggctcatgcctgtaatcccagaactttgggaggctaaggcgggcagatcacttgaggtcaagagttcaagaccagcttggccaacatggtgaaacctcgtctctactaaaaatacaaaaattagcttggcatggcagtgcacgcctgtaattccagctactcgggaggctgaagcaggagaatcacttgaaccctgaaggcagaagttgtggtgagccgagattgtgctactgcactccagcctgggcgacagagcaagactctgtctcc

SEQ ID NO: 162448 - DNA, 275 bp, Homo sapiens
tttcactatcttggccaggctgctctcaaactcctgacctccggtgatctgcccgcatcggcctcccagagtcccgggattacaggcttgagccactgcacccagcgtcaatgtatgctcttgtagagaggtcctttgtatctgaaatttattttaaataactcacaactatttatttcttatattgttttaggaatacgataaatttttggtcacttcaatttgaattgaaaaataaagtctcagttttggggacttgattttgacataaggta

SEQ ID NO: 162449 - DNA, 139 bp, Homo sapiens
atatactgtaagtgaccactttctctgaaagtcctagcgcctccctgggtgttattttcttatgaccaccgtcactataatgctagactaatgttatgatgatcacggtttccaaagcaatcccccacaactccaagaa

SEQ ID NO: 162450 - DNA, 263 bp, Homo sapiens
gcaagaagcagctatatgccaaaagtattaagaaggatcatctcttcagaataagtgagaagtatatcactggtaattttttagatttttgctgaatgttttagtaaaatttgggaaggtagtttttttttgagttggcaattatatgctgtccctcttgttttctcttccaaaataatcattcttctctctctctctctctctaaaatgggagccacagagccactgtcagaattgtatacatataaacctgagaacattgc

SEQ ID NO: 162451 - DNA, 888 bp, Homo sapiens
tagtaataactactggtatggaattttatatcatacaaggatccatgtcataaatttaagaaaagactcattatatttaaatgagtcgacttaccgtctttatcatgcccactttggcactgccagggacaatgaaacccatgtgactgggtctgtgcccggtgaaaactgggcaaatacaactaggttgacagcgtgctataataactggagaaactaagatacacaataagtgatctcttttcaatttaacatccatggtcctccaatcaatatttgatctaccttttaattagatctctagcatttcctctctcttaggtggcgaccttaccctgttctataggtcgtgatctctgtgcctgttattatatgttcccctaacctgaaatgacgacttctccaccaatccacattcactaagtcaaacccaccttctcttgtaaagaaaccttatctgacccattgctgctcacctgacttgcgggtctctttatgctctttctacatggatatcaaaatgatttcatctgtagagcttcctctgataatagctctatgttcagagggattctgaggctatggtgagggtcaccgaaaaaaggtacttgccccatatataggaggtgaagaggtatttgccctctctatcttggcactttttttttttttgagacggagtttcgctcttgttgcccaggctggagtgcaatggcacgatctcggctcactgcagcctctgcctcctgggttcaagcgattctcctgcctcagcctcagtagtagctggaattagaggcatgcgccaccacacctggctgattttgtatttttagtagatagggtttctccatgttggtcaagctgatcttgaactcccaacctcaa

SEQ ID NO: 162452 - DNA, 665 bp, Homo sapiens
agaaatgaaggggcaattgagacatactcagacgaagggaaactcagagaatttgtcactggcagacctaccctaaagaaatggctacagaaagttatcaaaatggaagagaaatgataaaaagaagaaatactggaacactgggaataaggaaaattgaaaagagcaaaaatacgcagactcaaattattgaaccttcaaaggatggagggaaagttcccttcacccctatgcccttctcctcttgagagatatcatgtttgatggtggaagaaaaaattacaacactgtctgatgtggttctcaatgttctcaaagaggagatataaagaagaataagtagaaatcgttgaactgaaaaatgtaataatgaaattaaaaactcaatggataggctcgacagcaggatggagaagtcaggtcagtgaacctgcagactgaaaaacaggaattacccaatctgaacaaccgaaagaaactagactgaaaaaataaaaaatatttaagacaattatattataaatgaggagggtaaagggatgtagagagagataataatttttacattggacttgaattagtaaaatgttgacacaaataggctgttaaagattatggatgtacagtgtaatacctaaaacgacactaaaaatctaaacagacac

SEQ ID NO: 162453 - DNA, 379 bp, Homo sapiens
agcaatttcaaagaaaaatattacatcttttgaatattccacaccctataaaatcttgtagtgataacagcattcacttaggtacaatgctctaggttaaaaaaaaatcaagcatgctttactatccaaatctgttcactacctgagttcaaagagtaagaaatagagtagcaagtttattaagcggtatcatgttatccaaatctatttggttcacaacttcagttggtaagtaaatgacagatttgacagcaatagatttatttaaaaatttatctgaaactaatggctcccaagttcaggtgataaaagttcaggtgaatatttattttatttctcaagtggatcaattataattttaagtctgggtaaaaaacat

SEQ ID NO: 162454 - DNA, 380 bp, Homo sapiens
cccagcacttcattatccatgacctcagttatcttcacagctcagcatgttagcaagcaggtagcaatatcccccttcacagttgtctgagggacccaggcttacgaggattaagccacatgccgggtccatatggctcctatggacagggctggccaggagctgtgaaccagagtgtttatgagcctctgtatctttatatatttatctcttcattgcatctcttttcccccaaattaacatttcctttgtagatgacctgaagtgtaaaacaagcctaaagccaacaactattttaaatattggcagaaaagacacatgccctcaagaactgcccccagaactctaataacacaaggcctgtgaaagaaacctggggc

SEQ ID NO: 162455 - DNA, 296 bp, Homo sapiens
ccgagatggcgccactgcactccagtctgggcaacagaacgagaccatctcaaaaaaaaagttctacttttattcttttgtttgtggctctccagtttttctagcaccatgtattgacaagactataatttctgaattgtatattcatgatccccttgccaaaattcgttgaccttgtatgcatggatttgtttctgggctctctattctgttcattggtttttgtatgtgtgtttatgcacatgccatactcttttgcttactacaacctttacataaagtttaaaattaagaag

SEQ ID NO: 162456 - DNA, 359 bp, Homo sapiens
aaatattacagtatgatttgtacaagttcagaaactgaaaaccaatatgatttgccattgaattaggtaagggcttagtattttaaggtaataaataatgtgatacttgatttgaaatgagaaactgggttttgatctgtcacaattcgtgggtaacctggataaggtttgtttcatgagagtattaatgtgttcttatacctgaatttctttgaacttctgaaatggataatttcgaaagtagcatgtcatttagtttatagagaaatctaggccagccagcttttcaaatgaagaaattcctctaggattattaaggaaaagtagctgctgtcattgtaacaaaggatgtattttca

SEQ ID NO: 162457 - DNA, 408 bp, Homo sapiens
gctgcccctcgtttgtgttgagtttacactatctgctgactcagcggggaaatatttgcctgagttactttctggcccttttgcctgaaagttttccagattctctgggcagaaagctctacttttaaaagacattttgaggctgggaacagcggctcacacctgtaatcccagcactttgggtggccaaggcaggtggatcatgaggtgtcaggtgtttaagaccagcctggccaagatggtgaaaccctgtctctactaaaaatacaaaaattagccaggtgtggtggcaggcacctgtaatcccagctacttgggaggccgaggcagagaactgcttaaaacctgggaggcggaggttgcagtgagccgacatagcgccactgcactccagcctgggcgacagag

SEQ ID NO: 162458 - DNA, 120 bp, Homo sapiens
agatcagtgaggagggaattccaaaaagggaccagagctgggagagtgggaatatgtatgatacatatggaaaatgatgagtcaaaagcagtttagggcaaagagttcattttgcagagc

SEQ ID NO: 162459 - DNA, 105 bp, Homo sapiens
aaccagggaggaattgatacataggaagtgaagagttacatcaggggatgacttctcttctgcctatctatgcctgtctttaaaacctcagtttctatcccacta

SEQ ID NO: 162460 - DNA, 417 bp, Homo sapiens
tgtagatcctaaccagaacaactgcatagtttcacctcaagatgggctaaggcggggtgtggatagctcacgcctgtaatcccagctgctcgggaggctgaggcagaagaatgtttcaacccaggaggtggaggtggcagtgagcgaagatcatgccacactgtactctggcctaggtgacagagcaagactgtctcaagcgtaagctgaatatgggggtggggtgggggtgggcacagcacaagtggacatgcctttcaggcccaggatggcgcatgcaaaggcccagaggcagaaacatgtttggtatgttgaagagcagaacaaagacaagcatggcaggagggcaggagctaaagcagtggtgtggaaggaggccaagaggcaaggattgtttgtggccagggttgggtgttt

SEQ ID NO: 162461 - DNA, 210 bp, Homo sapiens
ctgtgctctagttccttgtgagtggttcatttcaccaattacagatagcagagctctgctgaccccaagccagcccgggttcaccttggctgcaaggaatgatgacggccttgtccagacctggctagaaagatgcagcccggcctgtttgctatggatctaaactgcctgctggttcctttccaaggcaggccaggaaacagtggtgaa

SEQ ID NO: 162462 - DNA, 321 bp, Homo sapiens
gagctcggtacccgactacatacttccgatggatgaatatttagtaataaatatatttaaggaagaatattaaccaaccaaaaattaatttaaattgaaaatgcttcccagttataatcagtaacaaggaagcagatgattcccccacaaaaatacagaactgtaggcaataaacagatctttgtggaagaaaaagagtaagctatttaagggaaaaaataggtgctcccatacttaattattagttataaactcgctgttgaaataccaagagtatttaaagaaacaagaggccgggcaaacctgcggaagtatgtagtc

SEQ ID NO: 162463 - DNA, 578 bp, Homo sapiens
caccatcatgtggccattatggattcagcatgtgattctgatcagcagtttcgggtactcactggtagcttcatgctggtcccctaaggcatgccctctgatggttgcttttaaggttttctttcatttctccttttacagaggacattcaaatgcactttaaaaccaggaggcaccaaacaattgaatatgactaaccactcccacatttaactatttcagcacagtcatagaagtgatgaccaaggcagtcctatccctgatgatgctatggtccagcagggagacaaagaatagaccccaacaaactggcatttcctgtactggaaaagcacattctttgggggtaattagagatttaggcaattcctgggttttatgtgtttttgacctaaaatcaagcattttaaaggtccacaggagaggccttcactctgcagtggctaatggtgatttactttctttcttcacctccaatgcctaatccccaccccactttatgttttcctagcacttgtcaccatcgggcctaccagcgaggcagagcaatgtggtggttaaagcaaaaacttcagagc

SEQ ID NO: 162464 - DNA, 290 bp, Homo sapiens
tttcaagcaaattcacaaaagagggctatctttattaaatatcagtgtgtatgaggaggtttctaggacaagtgaagataatttacacagaagacaaataatagagggaaagagccagagcacatgcttcaagaggagaatacagtatttcctatcgggaaaataaagaggaacaacttaactggaacgagaagatttctactagaagataaaggaaaatgatggggggaaaaggggatgtaggattatactggcccacaggccactagtttacagcctctgactagatg

SEQ ID NO: 162465 - DNA, 843 bp, Homo sapiens
gtttctactgatcttcatttcactagtctttatctttcccatgttaaatctgttactcttatccagaattataccttttatccttaaaaattcagtttttttcttttttttgagacggagtctcattctgtcacccaggctgaagtgcagtggcatgatcttggctcgctgcaacctccgcttcccaggttcaagcgattatcctgcctcagcctcccaagtagctgtgattacaggcatgcatcaccatgtctggctagtttttgtatttttagtagagacagagcttcaccatgtttgccaggctggtctcaaacccctgacttcaggtgatccacctgcctcagcctcctagagtgctgggattacaggaatgagcgaccacacctggtttgtttcttaaaaaacatcttatatttctctgcttaacgtgctcaatgttgaacatgtgaaatataataacttttcataatctcttctgattctgtctctatatcatctttgggtctgtttttatgtattctatttttcttgtcattatgggtcagatttcccagttctttgcaatcctaataaattctgtttagatgaaagacattgtgaatttcactttgggttgtggatatttttgtattcatgttggtatttttgagatttgttctggagtgcagatgagttagctggaaactaattcttttgaggcttgctttttagctttgttaggtggggcgtatcctttctgtgtttatttttgtaagggtatacagatatacatgttttcttatttccctctttatttattcttatttaatctgtaacaacctttttccttatattcgtaac

SEQ ID NO: 162466 - DNA, 228 bp, Homo sapiens
ttattagtgttggacaaaaaggaattttaaaaattagtaccatttttagaggtcttaattatgaaaaactgtgactgtgaggttccaaactgtgtcacataaagaaatattagcctaaggaagagagtactagagggggcatgatacctttgcttagatgttagcaaatgccctagtctgtgctctcactattagagcttcttgtaagtgtatagaatgttagagtta

SEQ ID NO: 162467 - DNA, 345 bp, Homo sapiens
tctggactgatggaatcatggatggacccctcaccaggccaccgagactcaactgtgccacgtcagtgtcacgggggaggctgaacttcgccatccagccctgaacacaggatctcagtgttgtctcaaatcagcccttttgcaggcatgcacagggtgtctaagagtctggtgttaagttgaaaaggtctaatgtagtgttttaaagagaaaaggattctccagccccatagtggtgagaagtgacacagagtcacattacataaaatgacgaggcctgaggtgattgtgacagtgagggtgactcattaatcccaacactgggatcctctgagctctccctag

SEQ ID NO: 162468 - DNA, 586 bp, Homo sapiens
tcttttttattatactttaagttgtagggtacatgtgcacaatgtgaagatttgttacatatgtatacatgtgccatgctggtgtgctacacccattaactcatcatttacattaggtatatctcctaatgctatccctccccactccctccaccgcacaacaggccctggtgtgtgatgttccccaccctgtgtccaagtgttttcattgttcaattcccacctatgagtgagaacatgcggtgtttggttttctgtccttgcgatagtttgctcagaatgatggtttccagcttcatccatgtccctacaaaggacatgaactcatccttttttatggctgcataatccataaatggatttcttaatccagtctattattgatggacatttgggttggttccaagtctttgctattgtgaatagtgccgcaataaacatacgtgcctgcctgcacagtttctaagaaccaaaaggttgacctggtggaagatagaggttgcaggccctccacacccctgctactcatacctccatgcttcaacttttccatctataaattggggttgttataaggattctgggt

SEQ ID NO: 162469 - DNA, 528 bp, Homo sapiens
cctggagttagtgtcagactcacaagtaaagggttcaatccttcacaagattattctcacttcagatgccagttctaaatggtgtctcctgggccacccatgcttctgataaactggctactaatccaggaggtcaccatgatgccattcggggatcaatagaacaactcacaaaactcaggaaagcactatacctatggttagttttattataaaagatacacccagggcaaagtctgggagggaccacagagcttccatgccctctccatggagtaggcctatcactcacctggtatatcaatgtgtttactgaccaggagcctccactgggctttggtttttattggggtttcattagataggcatgattaattaaatcatgggccatgtgactgaactcaatctccagtccccctcccttccctggaggtcaggcaagtcaaaaatcgcaattctctaatcatgtgaccagccaccatccggaagctatctagggtctcaccatgagtcacctcattagcgtaa

SEQ ID NO: 162470 - DNA, 292 bp, Homo sapiens
ccaatggcataaacacacaggaggatgggggaagacaataaaattggctctgatcattaagagtttgaagtcggaatgtcctctgagaagtatgggtctaggcttctgtagcgtgtggagcccaatgtatatttggaattcatccacagaagactgatgtttgaaatcatagaggaattgagatagcaaagaaaacaagtgcaatctagaaaatggtagacgacacaggcttgggtagatgacacaggcttgggaaagccttacattgaagggaatttcctaggcacacttc

SEQ ID NO: 162471 - DNA, 551 bp, Homo sapiens
catacttgcattccttttgctatagaagctttttgagaaaataagtatacacatttataaatgcagagaagatgggtgtctcccctaaagctgtcagccaacttgacagatttttaataaacattcttgagtatcaatgagagcacaccatgtcctcatgctgtcaaaatgtttccattaatttcaaattctccctaactctccacacctcctaaaaaaggaacattctcttccctaattttccaacttgtattttccaaagcaaaaataatgaactattccagccttttctggtatgatttccttcctgttaggcaaaaaaattaaacaaagcatgttaattctctacttcttttatttatcttttttcaccacatgggaccacacgctgtttttttggaaacccaggacagtatgtcccctgtcaggtcatttaaaagccctcaattaactcccccacactgatggaggaggaaagactcaggaactgaggtttcttcccttttctactccaaggttaattaccaactaacctgcacaacttaaaaaaa

SEQ ID NO: 162472 - DNA, 911 bp, Homo sapiens
cgggtgtggtggcacgtgcctataatcccacctactcaggaggctgaggcaggagaatcccttgaacccaggaggcggaggttgcgtgagccgagatgggggcattgcactccagcctgggcaacaagagcaaaactctgtctcagaaaaaaaaaaaaaaattaagaaaaaaattattacaggtatatctatgaatgagttcgatgaaattgtttcgttccctacccgtacccttgcacataattatttcctttgtagctgaatactgcctattgattgctagaatgacacaggatttcagcatcaattccattctgtttttttcctctagatataaatgctgagggacttgattcccataaattgataggaatggatggaattttgtaatgacaatgtcattagattatacttcagaattatataccagaaattacatagtgatattaccaaaaaatcattttgaatcctctgtcttacgacaatttgtgattaggttactctttaattctggtgaaaggaaagagttagaaaccatgtggctcataaaagggtctattgctcagttattagcgttcaccttcgccattccactttgccacctgaagctttcacatcatgggccaccttattaggatcctgggagggtgaaactcatgcctttatcttgggagaagggagtttatccctgggagaagggagtttgagaagggaaagtggggaaggaaaattaaagaggttttaggaaagagcacatatgggagttgaagacacggaagtcagttctcctgtatgcacatatttgtgtccgtgtgctccttggagagtcttggggttaacccagggaaatgcataccaggctttaaaacaactcttccaatctgcttagttttttaatatttaaaaaccaa

SEQ ID NO: 162473 - DNA, 522 bp, Homo sapiens
atgttaaaatggaactcataactcagctcctttagtggtacttccaatagaatcaactgctgacccttggttagagacaccacttatcaccatttcatttctcttttacttatgatacagttaataggacattttctttagctattaaactctattagtgctcatattttaaaagaaacattccatcaatgccttttttttttttgagatggagtctcactctgtcacccaggctggagtgcagtggcacgatctccgctcactgcaagctccacctcccaggtgcacaccatcctcctgcctcagcctcccgagttgctgggactacaggcacccgccaccatgcccggctaattttttgtgtttttagtagagatggggtttcaccatgttagccaggatggtcttgatctcctgacctcaagtgagccaccgcgtccggccctggttggtgcttggacggaacatatttaatggtatgtggtctgaatgggtaaggaagtcatttaaggctggtggttt

SEQ ID NO: 162474 - DNA, 347 bp, Homo sapiens
cggaattctctaacgagcgcgtttctcttcaccccctgggcccgcgtggacccccgtccacccccacacgccctggggggggggccgggcccacacgccctggaagcccctagaggtgactctccctgggacccctgtaccagggaggaaggataccgccacccgtcaccaccccccgccagaagctccttcgtgactcctctgcgcgtgccttcccacacctcctccgtccgggactgcgaggagtgggcggtcgactcgagttcgcagcccaggcctcccacacgcccctccctgccgtcagcacccacccgcgcggcagcggcggcggcggctggcgggcggcc

SEQ ID NO: 162475 - DNA, 933 bp, Homo sapiens
  misc_feature (897)..(897): n is a, c, g, or t
ctacctccacgggcgcgccctggcaggaggggcgcagtctgcttgcagcggtcgccagcgctccagcggcggctgtcggctttccaattccgccagctcggctgaggctgggctagcctgggtgccagtggctgctagcggcaggcgtcccctgagcaacaggagcccagagaaaaagaagcagccctgagagagcgccggggaaggagaggcccgcgccctctcctggagccagattctgcaggtgcactgggtggggatgatcggcgggctaggttgcaagcctcttatgtgaggagctgaagaggaattaaaatatacaggatgaaaagatggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacaactgcccttcatctatggggacattcctcccggcatggtgtcagagcccctggaggacttggacccctactatgcagacaaaaagactttcatagtattgaacaaagggaaaacaatcttccgtttcaatgccacacctgctttatatatgctttctcctttcagtcctctaagaagaatatctattaagattttagtacactccttattcagcatgctcatcatgtgcactattctgacaaactgcatatttatgaccatgaataacccgccggactggaccaaaaatgtcgagtacacttttactggaatatatacttttgaatcacttgtaaaaatccttgcaagaggcttctgtgtaggagaattcacttttcttcgtgacccgtggnactggctggattttgtcgtcattgtttttgcgtatt

SEQ ID NO: 162476 - DNA, 563 bp, Homo sapiens
ctcccgaaatgccgggattacaggtatgagccactgcgcctggcttaaatattctttcatgatgtctcttacgtcacagtcactaatggaacaagaaatacatagagaacacatagatggagagggaaatacccagaactggaagagagttgagaagagggatgtggggtcggtcacgtgtgggaaagaaggatgagggcaggttcagcatgtgcaagagttttaatggatatagaaaggccactgttttctgtttgccttattcctgatttatagagcctggggaagcctctcttttttccaagattcattcactcacttcaacaccaaaagcgtattgttgagtgtctgctgtgttagagggcgaaatgatcctgtacttttgagcttatgatctggtaagaaaggtgagatagaggaatcaaggcatgtataaacactccattcaaatggttgtccaagtccctgctttttaggggtcttagctcttggaaactcctgtgtcccataccttgcagaagcatttctactcttttcctttgcagaagttcatcatatgctac

SEQ ID NO: 162477 - DNA, 287 bp, Homo sapiens
gcacttagggtgataatgatgtgtcagtgtaggttcatcaattgtaaccactccggtgagggatgttgataatggggtgactgattttgatttgctgtgtgtgtgtgtgtgtgtgtgtgtgtgtgtgtgtgtgagagagagagagacagggtctcactctgtcacccaggctagcatgcagtagcacaattacagctcaccacagcttcaacctcccatcgcagcctcctgagtagctgggacaacaaacgcgcaccaccatgcctagctaatttttgtgttttctg

SEQ ID NO: 162478 - DNA, 203 bp, Homo sapiens
acatgtaaaacaaatattgtcacagaaacaatagtcttatttcttgttgaaaattatgacggaattctcacgaaatagaaggatgatagcttatctgtattttgtacttttttagtggggcatgaaagagctggtgtaaatggatcatagctttaaaatagaactgagggtatgaataatatttaaggaaacttgaagtcagt

SEQ ID NO: 162479 - DNA, 1149 bp, Homo sapiens
ctgctcttaattctaatatttggtcattaaaaataacgtcttatgaccatttccacacaaaacttttggtgtgcatttatacttatctttgagtgaaaacacaggattataaactacatgtttaaccacagcagataatgccaaacagcattctgatgtggttgtggcaatttacatacccaccccagcgtatgtccctatagacatatctctccaatactcgtattgtctgtctttttcattttagtcatttcggtgaatgcctactagtagctcattgtgattttagctttgatttccctgatgaataacaaagaaaaaacattttcctatgtttactgctcatttggatttccccttgtatgacgtgcttgtattcatgataaaaactcttggctgggcacagtgtctcacatctgtaattccaatgctttgggaggcctagctgggaagatcacttgaggccatgagtttgagactaaccaggacaacatattgagaccctgactctacaaaaataaagaaaaaaattagctgagcatggtggtatgcacctgtagtcccagctacttgggaggctgaggcaagacgacctcttgagcccaggagatcaagtctgcagtgagctatgattgcgccactgcactccaccctgggctgcagagcgagactctgtcttaaaaacaaaaaacaaacaaacaagcaaaactctcggaaaacattattgccttgttcttagtctcagaggaaaagcactcagtctttttcattcaataagatattagctgtattttgtagatgtcctttatcagaaaatcattttctactccaaaaaaaaaaaagaaaaaaaaaaaaaaaaactgtgtgtgggggggcctggggccctggaaaaggtttttgaaacccattggggtgggggggggggggcccaggtgggttctcggaaccctggggccaaaacggtggtcccataagagaaaaccgggggcaaagagacaaagcggcgggagtttcctccccatattataaaaaagcgcgcggggggacaccccagaggttttcgggaccaaactcccagaggggggcccgagagggccaagacgggggcctcataccaagggagccccaggggaggccggaattcaagtg

SEQ ID NO: 162480 - DNA, 729 bp, Homo sapiens
gcattttcacggattacctcaaccactttttttcattcctccagaatttccaaagtgctctgactagagtggagagtttgcattgaggagaaatagtaataaaatagtttggggtggtttgcgggaagaagtagagatttaacatgggggtggtcagaaactgacatgagttaaatttaaaattttggacgttttcctatggatgagtagaaaaccactgaaaacggtttaggatgagttatcctagaaaaggaaaattctgactaaaagagaaaacacaaggtagcagggtttttggcaattgtgagtaattcattaaagatggaactttgaatttgagggtgaagaaatgagactggaagagaaggcaggatgcagattataaaggaagctaaagtgtttcagctttttccattgagcagtgcgaaatcattgacagatttgatatgataaataattggacaattttgcatatttgaaaatgaatttggctcccacttccctaccttgctcccctgttaaaatagaaacggggattgatttatgtcccattcctgaatgcatgtaaaatttatacaaaaatactttctatgaaaatgatttgtaatctgtagacttaatacctgggagatgtcttgagatataaaatcgcatcctttgggctgtgggttttttgttttctccaaataaatctgatcttttcttaaaaaaaaaggaaggaaggaagat

SEQ ID NO: 162481 - DNA, 310 bp, Homo sapiens
cgttctgcaccggcgccttctgctccaggcgcacttctgcacccaggcgcacttctgccccagcaaggaaagagatcacagccaacttggaagccccagcaaagagagagatcacagacgatctagaagccccagcaaggagagacagtgcagacaatctagaagctccagcaaagagagagatcacagacgatctagaagccccagcaaggagagacagcgcagagttcaataacaagtagaaaagacaggtgaggatggatccctgacaggtgaaggagatagaaagaagcagaagtgcgcctgggtg

SEQ ID NO: 162482 - DNA, 469 bp, Homo sapiens
tcccaacaaggcgagagatcgcagccgatctagaagtccctacaaggcgagagatcgcagccgatctagaagtcccaacaaggcgagagattgcagccgatctagaagtccctacaaggcgagagatcgcagccgatctagaagtcccaacaaggcaagagatcatagccgatctagaagtcccaacaaggcgagagatcgcagccgatctagaagccccagcaaggaaagagatcacagccaacttggaagccccagcaaagagagagatcacagacgatctagaagccccagcaaggagagacagtgcagacaatctagaagctccagcaaagagagagatcacagacgatctagaagccccagcaaggagagacagcgcagagttcaataacaagtagaaaagacaggtgaggatggatccctgacaggtgaaggagatagaaagaagcagaagtgcgcctgggtg

SEQ ID NO: 162483 - DNA, 677 bp, Homo sapiens
catgaacaggacaaactcagtgtgccttgggtaaggagggtggcgacactgattttaactgtcaaattgatctagagttgtcagatgggataatttaaccctcaaatgaaggtgatttatcctatgtattgtaatcaaatagtcatctaagtcactccccatgagctctggtaaatcacttttagtacatattgaaagtgaccgtattgtattttattgcagaattgcgtcttatagtaataactaatgcatgccattggcttttgctctagcaccgaattacactcacttggaggcacatggatccaggtgggcactgttgcttccatttgcttgtccacagtcagaactgagaggcaggtaggaaaactgtactgctgcagtctttgtagattagctcaattcagagacacctgtggtcttgtgaaatgccaaactttactccagtggcatttgggtcaatgtgaactaggatgggcctagcaattctattaggtgaatgacaagtgctttgtaatgaaacagaaggactttatttaaacagatataaggactggacagaaatcaggcttaaattgtaccttatctgggctcctgctgtaaccttgtaactggtcttaccacttgtggtctcaagactattttgtcctgcagcccccagagcatctcctgtgaaa

SEQ ID NO: 162484 - DNA, 440 bp, Homo sapiens
acccccaacacacacaccagtgcagcccaacaatgtacttctctctgcagaaccccagcttggagaaggcagatccacagggaaactagggtgactttatttcccccaagaatcatgttttggagggactatggagttaatccagggaagtattttcaaacctcttaaaatagaaccaacatgatttgtaaatccacactgatttaagctcatcttattatctgaaaagctttgctgcatcccacatctctgatgagctctcttttatgctgcaccttgcagtctgcccaggctaatcaacccaggaagccatgatgctatctctggcacatgaactttcagcctaagaggtttatcctacctggattactttccttctgccataattttatcagcaaaaaattatcttaaaactccatccaaagtttcatctaataagc

SEQ ID NO: 162485 - DNA, 723 bp, Homo sapiens
atgcaaagttgtatgtataccatgatcccaatttcttttaaaaagtatacagatgaaaaagttaccaataatttattgttgtcagacattgttacagtacttggtgtgtgttaattaatgctcatatcaattttgtgaggtaggtactattgttatctattttacgtatgaggaaagtgaggtatggaaaagtaacttgcccaaggttacatagtaagtgttggaatcactgacaagaaggaaatgtaccaaaatgttattagtgatcatctggatcatcattatgagtcagtttaattccttacatctataatagagaatgtatttctgctgtttatgtaattggaaataacagtttaaaaagaaattatagcatttttgaaatttaggaaaacagtaatatgagaaaacttgtaggttgaattttaaagaatagctgctccttcctgtatctaaagtagaaattgtgcttgactaagagggaaaaaaaggcacaaatccactattttctattaatacactctccctaaatgataacctctcagtatcatgttaacaattttctgttttttttgataaggaaagtaagatattctttagttcatggttcagcacaataaaagcacaactcaggaaactgtcaaaccaggttttgtttggatacttaaatgctttacgtcacagcaaaacatctccagggaatgtgcgctttcctctctgtaa

SEQ ID NO: 162486 - DNA, 469 bp, Homo sapiens
tttctattgtgttagtgtgtatgcatacagggtcacaatagttgtacaaagtattttcttcctaggaatctgtcaatggaaagccaagggcttgctgttagtaacactgtgaggtattcccttcctgtgtattttctgtttattatcacctaatgtctgctgccactgcatatccatagccaaagaagatcacatatagcatctgtccagtatgaatactgtggctgatcacagtagctatggtaccagaatttgatccaattatcaaatccaacaattcctaccatgtcagccactaatcagagcttccaatcagaacaagaaagcttgttttcccaaactgagataacagaattctaaccaaaagcaaattattgatgcattaactagctagcaattcatataggacttttaaaaataataaaaaggtttttttgattttttttttttttttgagacggagtctcgc

SEQ ID NO: 162487 - DNA, 722 bp, Homo sapiens
acatatgtggaggaattggagagtttacaagatagtgaagaactgccaggccatggtctggagaagatggaaacttgatgtttggggccattgtgtccctggggtgttggccaatttatgaaagaagcagttaagagcctgagtggcacttttgaggggctagaagggaagaccctggtaaacatcccaaactttggattgggacccaaaaaagctccatcccaggagtacaggtgacctggaaacggatcagcgtaatcgaggactgaagtccagttctagctacgcccagtccttgagactggattaaggtgatctcagattgcaaggacctcaaatgcctggcagaagcaagtgaatatccttctggaggaacagagcctcatcctaggcctctaattatttttaaggacaatttttcaaatgcaggctttcctccctttgcacagttcccttatgcataaatttcagtcagtggccagctgcagtggctcatgcatgtaatcccagcgctttgggaggccaaggcgggtgaattgcttgagtctgggagttggagaccggcctgggcaacatagaaccccatctctatttttaaaaataaaatattaattatcactgcttagttaaattatagtggtctcccaacaatacagatcagatcccagctcccatggtatatacactgtgagtgctgtataaagtacaagctctgccgccag

SEQ ID NO: 162488 - DNA, 501 bp, Homo sapiens
ctccaccccatgacaggaaagttggccccaggcgggggcaaaggggcagtccaggaagtacagggattcatgctgccttccaaggggaagtgagggagccgcctgcctcttccctggaggggctgggggaagccgatctgaggcctggccatgcgaagccccatctgcccttcatctaggcttctggaaggtagggcgtccttcctccacgtggaggacgggatttaggaaaaggggctgtctcctctcagctcgggctgtgcatcaggtactaggagcactcaaagagagcccccaaactcaggtttctccatttctctcccgtcccccggggcgggcacggagggactccgccgccgccggcagtatgcggggtccaggccgccccatgcctgctctaccaggaggggaggccaggatccgccgggcagacggctccgcggttcaggtttccacccttgttatttaaagcctgagcctggctcctggcaggcgggcagg

SEQ ID NO: 162489 - DNA, 170 bp, Homo sapiens
attttggatgtgttgtgtttgagatgcctttgagatatgtaaatggcagtcaatgaggcagtcaatgagtcagccctctgtattcagaggttctgcatttgtggattcaaccaacagcagatttaaaatattcaggaaaaacaaatagatggttgtatctgtaactaaca

SEQ ID NO: 162490 - DNA, 625 bp, Homo sapiens
atgttttctgtaaaatcatattgggaattgttttggtgctatacttataaaaagccctggttcatttgctagaacatcatgcttccttattttttctacttcagtagtttatagtttatcttggtatattatcactacttcaactaaggttatttttatctttgtttagtgtatacagatctgacctgatacttattctaacactagctttttaaaataacactagtttttacttatgtctatcaaaacttctgcttttttatttacctatacttcatatacagaatggcttctagttttacttctcttaaattgtcttattaatttcaaatagaggcaagcattggccttctttattatgtctttgagtgtagctatgcctgggaatttacatgttaaaatacaatttcattatgttattttcatttctttctcttttctattatagtgagagttatttttattttttaaaaattatgtctctaggtagttatatattttctattttattaaggctagtaaatggggtattaaaaataattgcttaaagaggtcacggccggctagaaaaaaattttaaaaatacatatggagcataaagagctgaatagcaaggaatcttagc

SEQ ID NO: 162491 - DNA, 450 bp, Homo sapiens
ggggactcaggaagtgacggtgtcagaggatgacattcccagcccccaccacctccacccgaccaaatgctgccaggagacaggatctcagacacatcgattcctttaaggaatatttattaaatacttgctgtatgccagatctccaacagtgaacaaaacagatttggtccacactgctgcagagcttatattctgagacagacaccagacttcgtgcagaaagatccccctcttcctagttgcccagcccatatgtcctagaaggaaccgtgagatgggcagccagagacataagttctagtcctagcattgcccctgactctccatgtcaccttggaccgagttttccacctgagaaatccaagcatgtggcccctcacacattttctcaggtctcttccctactcccagtctctgggtctagtggttcatgatttcccggcatga

SEQ ID NO: 162492 - DNA, 577 bp, Homo sapiens
ctcttctcttgtctgccaccatgtgagatgtgtctttcaccttctgccatgattgtgaggcctccccagccacatggaactgtaagtccatcaaacctttttcttttgtgaactgcccagtctcagatatgtctttatgagcagggtgaaaacagactaattacagactctatcccatcctggtccccagccatccagtacctctctccaaaggctactgctgagaacctaaaacactgaaaatctgaaacatttgttaacaactgtttacaagaaaatccacaccactgatctatcacttcagattatgaactgttaaaattacattttcaagagctttttaagaacagcattacatcctttactaaccatccagtcttggacatacctgcactgttattcaagtattcacatcaggaaatgatctgacatgataaactgtaagaatagctatccccaacagctggtatcatgaatgaaaagagactttttgattaattgggactagttacttcaaaaattgcccccaaccaataatctcaattcagtgtttctcactgagggcattgccggcttt

SEQ ID NO: 162493 - DNA, 393 bp, Homo sapiens
agcacttttctgttttttctttcccacaaaccctctttgatacacagtttgtcccaggctacccctcaagtgcctgaatccagacctactggaattcagatatccatgagtccaagacgatggcccttgacttggctgtggaaggtcattgaaggcccggttagttcttcctggggagcacccccctgcaggtgtccgtacaccccaagcatgaaagaagctctttatactgacagcagctagaaataagaggcttaattcctccaccagaaagtaggggaataaattttgctcttctcccctttcttaaagcttttaattattttattttttgagacacggtttcattcttttcactcaggctggagtgcagtggcacattcatagcttact

SEQ ID NO: 162494 - DNA, 478 bp, Homo sapiens
ttttttttttgagaaggagtctctctctctgtcacccaggctggagtgctgtggcgccatcttcactcactgtaacctctgcctcctgagttcaagcaattctcctgcctcagccttccaagtagctgggattataggcgcctgccaccaggcccagctgatttttctatttttagtagagacggggtttcgccaggctgttctcgaactcctgaactcaagtgatccacctgcctcggcttcccaaagtgctgggattacaggtgtgagccaccacacccagctggtctggtccactttcttggccggatcattcatgacctttctcttgccaggttcctggatgcctatgctgagcacaagttacagttctgggcagtgacagctgaaaatgagccttctgctgggctgttgagtggataccccttccagtgcctgggcttcacccctgaacatcagcgagacttcattgcccgtg

SEQ ID NO: 162495 - DNA, 355 bp, Homo sapiens
gggcccagcaatcaagatctatagctatagggaagtattgagttgattatgagttatataggtcaaaatgagtagcttgcttgattgaagcaggtaattcgtgccatacttttctctttgggaagacctgtaccaacaataacctctgctaaacactttcgcttttttaaatttgcaggtacttttttggggctgtctttggctgcctgtctgttgagagtttgttttctttacagtccatctgatttacagtccctccgggttgatttgtctcatttgggaatgagaaattttattttaatgcattaagtaatagtgttgagtggccaacaaatgtgaagtttgaaaagctcaa

SEQ ID NO: 162496 - DNA, 133 bp, Homo sapiens
aaccaagcctcatggagacttggaatatcattgaggacacaacagcagctgattttgtcattcctcagaaataaacatccagtgtttccttgtccggtgggtctttgttggacaaggacttagctttcttcaa

SEQ ID NO: 162497 - DNA, 350 bp, Homo sapiens
ctgtatttctctttagataaaaatcaaagtaaaactaatactgatagctttttaaaagatctacagtcataataattttgaattcattcacacagctttcttgaatcttaaaaaatattttctttaacttcatggcagaacttaggagtctcaccaaacacacaaacactggcaacttgcttcactagttaacacctcatttgtatttatggagccattccaggtgatcactgtagcactctcatattcctaattaacaaaatccttctaattacaacttaaaatttggtggcctcaagttctcactttattatctcagtagttttaaacatgaaaatgctgcatagctt

SEQ ID NO: 162498 - DNA, 281 bp, Homo sapiens
agaatgagccggacctcataggtcgcaggtgattgtattgctcagccaagtttttgaatcactggtctagactgtgaaggtacagaataaggagggtgagatactgttcactgtcaggacaccaaattgtttccttacagaaacatagctatagagagatggcaaagcctaatgtgtgtggaattgtgtgtgcatgcatgcacattcatacacagctgatatgagtaaatcatacagttttgttgcattttctcacctcttgctatcctgcgaacctatga

SEQ ID NO: 162499 - DNA, 265 bp, Homo sapiens
gaacccaggtccgtgccgcctgatggccaagcgctggcagctagcctaacaaacgtacagtgctgtagggctgtggctctgcgagacttcccaaagggctgtgcagttcacagtgccaccaacagagggccccctgcgccacacccaccactcaacaggtgcaccttcactagggagctttcggtgatacagggactggcctctctcacagactaccagcaagatgaccatttttcaggtttactttctacttgagttccattca

SEQ ID NO: 162500 - DNA, 293 bp, Homo sapiens
aatccaatagagctgaatgtcaaggaaaactttttttttctcctaaatttaataaataagtcaattatatatttagtcttcccaggagtaggagcgaatagtgaaatatttgttgctaagaaggtttaaaattaggtgtagggtaggaataaacatttcctgggttggattagactaaaaaaacctacgatttttccctgtcatgtccatttacataattctgatactaccctagatgttgccagagtacgtgagtgttatttactattacagatgcataggttttttttatg

SEQ ID NO: 162501 - DNA, 250 bp, Homo sapiens
taagaggcagcctggcttccaacccccaaatctctcctccaaccctagtctggtggagcacgttcctgcgccaacacttattccagaagtagatgaaggtcaccttgccctaaaaaatactgacatcaaaatgggaggtttaaaacaaaacaaaacaaaacaaaaggcctatgaatagttgcttatcaaatatcaaaagcatgaacacaaatctgaagacatattaatttaaggatttaaaggatattga

SEQ ID NO: 162502 - DNA, 342 bp, Homo sapiens
tggcgttatactctacggcattactttggcagataattttcatctcatgaaacctgtcataaaattcaaactccagattaaatggtagccaaagtaaatgccgtagagtatagacgcaaaactttactttatttatttatttttttgagacggagttgcactccatcctgggtgacagagcaagactccatctcagaaaaaaaagaaaagaaaagaaaagaaaaaagaaaaataagaccattataagcagaccaccttgtatagaaaaaaattcaaacatttgttaagtggcatcctataagtggtgtcgccatttggcaagataaatttcatctcatgaaa

SEQ ID NO: 162503 - DNA, 597 bp, Homo sapiens
accaagacaaataatgctaaattcttaattacagttcttgcctccagagaaataaagaaaataattagctgatgacaagaataacactctctgtaaagttactgagcacagtaacaaataaataaacaaataaaacacccttcttaggaataattatcataaaatttgctagtcagaaacaatacatgaaggatacactgtagtttgcatcttcttttccctaagaatttttagagtcatttagaattttagaatgtagtcaagaaagacaaagaatttgttgcaatgcacttgtccatctcaaattgtcctcctcacattgactccccagcaatgtttaggagaataaagccacaataggatggagtggagaaatctctttccccttttttatgagctgccctcacagtaggatgttatatttttgcatgcatatgttcattgttcacaatagcactattcacaatagcaaagacatggaatcagcccaaatgcccatcaatgatagactgaataaagaaaatatggtaaatatacaccatggaatactatgcagccataaaagggaatgagatcatgtcctttgcagggacatgg

SEQ ID NO: 162504 - DNA, 139 bp, Homo sapiens
gagctgttggggaagggtgtgggcaaatgctggctttgacgctcggggtctaggaacagagagaaatggacattgagaggacctcgttcaacgggtgaggtccatggtagaagcatgacaggggcactgaggattggag

SEQ ID NO: 162505 - DNA, 439 bp, Homo sapiens
taacaagtaactacttactgtgtcttctaaaagccactgtgctagtggctaggtaggttataaaaacccaccagatattgcagatagtaccacaatataatttgctttaatctctatgaccttcagaatctattacatcctagtcttccctaggagactggggtttcttggaattattttaaaaaagtgatccaaaactggatctgattttgccatggggattgcttaactaattggtttattagcttgagtctcatgcatcatggtggatattactggttgtcaagttgtggttggtgaatcgtagacttttagaactctcagagaaattcagagttgacccacattacattttacagatgagaaaatgtgaaacaaatgactaaatggtttcactagagccagacagttactgtcagaattgaagcttaaactacag

SEQ ID NO: 162506 - DNA, 478 bp, Homo sapiens
ccaaccaagaagatcagtattcctaatgctgtattttatattttagagacaacactctgcttatctaaggagaaaataataaacgtatttacagcacaattttattttaggagtagctgtttttctgaaattagtcatcttttgtgctggctttatgaaggccagactgcggttgtagttaataatcgggaataaaaataacgcttcttctccactgacctgaggagtattcacacgaagccaattttttacactcattcctctcttcgataaagttacacagcataatgagaaagaagaatgacaaaggacagagctatacctatcttaaaaacatttggtagaaagtactacatttgctgttctgtcatgagtaaggtatgatggcactgtatgcaaactagtatcaactcttattttcaacgtgtttaacatgtagtacctcattgtgacttcacaaaaactataggagatagaa

SEQ ID NO: 162507 - DNA, 521 bp, Homo sapiens
taaaaaacttatttattatgtttggtgaggttgtagggcaacaggcactcacatacattattggtggccacataaactggcaaagtctccatgaaggaccactttgcaacgtccattaatattacaaatgcatttaccattgtcctactattccgcatctaggaatttatcctgtacctctatttgcatatgtacaaaatggttcatgtttgaggatattcactgtagctttgtttgtatttgcaaagcctgaaaacaaattaaaaatttattaggggattaaataacgtctggtgtatcattaaaatggaatatcatacagttgttaaaaagaacaaggaaatggtgtacgaaattgctatggaattatctctaaagatgtggcgtgaattgaaaaaatcaagatgcagacagtgtgtacaaacagatatatttgaatatgtatgtttgaattcatcatgctaacatatttatagaatggatttccggaaggctgcataataaatttagggttgatgtgg

SEQ ID NO: 162508 - DNA, 449 bp, Homo sapiens
gatggctattatcaaaaagacaagtgatacaagagttgctgagggtatggagaaaaagaagtccttgtatgctgttggttggaatataaagtggtacagccataatggaggttccttaaaaaactgaaaatacaactaccataagatccaacaatctcacttctgggtatgtattagtccattttcatgctgctgataaagacatacctgagactgggcaatttacaaaagaaagaggtttaatgggcttacagttccatgtggctggggatgccccacaatcatggtggaagataaaaagcacatctcacatggcggcagacaaaagaacagagcatgtgctgagaaactcccctttttaaaaccatcagatcttgtgagacttattcactatcacaagaacagtatgggagaaactgcccccgtgattcaataatctccgaccaggt

SEQ ID NO: 162509 - DNA, 578 bp, Homo sapiens
agtacgatgctcaatgacggagacaaatgaacgccgtatagcaaagtggatattatggaagagaggcgcggagctcgctacggattaggtttacaacggcggagctggggtataaaacatgaaaagatggtggggaaaactgaacggcatgatcaccattatttaggtccgtaaccattgtttcattctccagctcaatcgtgtatgaccagcaactgtcaatggagggtcacttaagaaaaatgcaaggttctgacgattatccaactcacacttaccaaagtgattgatgggggtttctgaaaccactacaagtagcagtacctgctcgtggatgccaacaacagcctgcctggcattgtcatgtgcatacatgtgccatttggatacgacatgccagtagcaagaaaaaataggtaaaaatcatacctctctgagcaatcaacattagcaagtaggaggtcactggagtggagtagaatgtgggtcactcgagggaaggtggccggctgcatccacagtcatttacccatccaataaacatttcctaatacctgttaggagccagaaactgagac

SEQ ID NO: 162510 - DNA, 260 bp, Homo sapiens
tcaagctggaattactttaaataaattcttggcttcatgttttttggagcagacagatagtatgaatttgagctgcaaatccatgtaagggctagcttacagttagaaattctcaggagagagttttctctctttctacctactgagacagtcaaattccccttctatagagttgaattttttcttttcttgttcacttttacaagaaagggcagccttttgcagttcccaaatttatgcacgggatctcctatcagacc

SEQ ID NO: 162511 - DNA, 221 bp, Homo sapiens
cagctatcagagcttcagtaaagtggatattagaatccatatcccattatgaagttaggagcactaactgagataatacatgtagagtgcctggcacttaataggtaatccaggaaatttactttccttgcccctaatctaaaacagtggctacagccagcccacatctggagacatgggtccataactgggctactggggctacaggaaaacccccaagc

SEQ ID NO: 162512 - DNA, 442 bp, Homo sapiens
aggctttctgctttggggacccaaacagttccatctatggtggaggtgtaggctcattcctacatcaacgtcaacaagccattgaacacaacaacatttaggagtagtcgagcccaccttctccaatgtggcctgcacagcccaggctgcagggtgggagaggttgattctggagaaaagtcattcctgctcccctggtacactctcctcccccactgcttcatacagagaccaatgtgatgatgccatcatgatgttgaagcacacactgaaccctgtaatcaattaaagggttttcccatccacccatccacacacacatccacccatccactcacccatccatccatccatcacttatccatgcatccatccacccacccagccatgcattcatccagccatcccacaatccacccacccacccacacatccaaacatc

SEQ ID NO: 162513 - DNA, 781 bp, Homo sapiens
acacgctcttcttaggtgatctgggagctcctccctgccttccttatttattatctccaactatgatttttccccgacttgtatatctaacttcttgacaacttcatttgacttgttaatagacttatcaaacttaatatgttcaaaagagaactttcgatattcctttctaaactgttttcccgtagggagttaaccttggttcctccctctcctacacacttcacatccaattccccagcaagtcctgcaagcactacctcccaaatatatgctgaatggaattctctccatttccactgtgactgagggccttttcttttttcttaagacggagtctcactccgttgcccaggctggagtgaagtggcgcgatcttggctcactgcaacctccacctcccgggttcaagcgattctcctgagtagcagagattacaggcgcgtgccactacgcccagctgatttttgtatttttagtagagatggggtttcaccatgttggccaggatgatctcgatctcctgacctcgtgatccgcccgcctaggcctcccaaagtactgggtttataggcgtgagccaccgcgcccggccggccctttcaacactatcttcacctctcctttgtcttacagtgcaacagtctcctaacaggtctaactacttccacccttctctatccagcaggcagagcggatttttaaaaatgtaaatcaggtcaggtcacttcccttcttaaaacccttaaggtacacattagccaaacccctgccttgggct

SEQ ID NO: 162514 - DNA, 618 bp, Homo sapiens
agttacacatatgtcttacggattatatatgtcacatcagttatagacaattctggagatgataatctattaaagtagttcaaagagagtcccacaggaacctcttttgaaatcactgatttcaacttactaaagatatgggtgtacaacataagtggaaacattttctactattcatatgcagatgaatttcattctagctcagaaacatttggaaaactgacatcacacgtgacttcaagctattaaatgttagtgatagcaccttagaaaaacacaatggctttcaacatgtgacagtttgtgtctcaagtcaaaaatggacagtgatgtgtaagaaaatcaaattacataataacaattcctattactcttgtggaataggctgtttcttcccaccaagtcagtgatgtttctgagatcataatgttcactgtaaatttaaagggatttctttttccatagcactcagcaagaaacgtgtgctaaagactgaggttccttggaaacatgctgaaaattctgttctcaagggtgtcagaaccatacgtactgcaaataatttatgaagtcctagttcattgcaataagcagatgcgtagacaatctgctcagaca

SEQ ID NO: 162515 - DNA, 333 bp, Homo sapiens
ccttttcaatgtacatcaggattttttattcagaataattcattttaatcagaataattttaatcagaataattcatttattcataattctttattctccagaaaaaagcgggtatttaatttcaaagctaagatttaatttccgaaaatagttttctagttccaatgctaaaatctagtttctaaaagagtaaagaaagtaataaaaattagcaacttttcttttgaagacttttagataaataataggaattaaatttaggttcagacccagcatggttgctcatacctgtaaccctagcactttggaaggacaaggtgggaggatcacct

SEQ ID NO: 162516 - DNA, 626 bp, Homo sapiens
tatcatcatcatcaccaccaccaccacaactgccaccattataatattaccactgggattacaacattgtcaccattccaacattgccaccattacctccactcaggtatcaccaggatcaccaccacctccatcacatctccatcaccatcaccaaccctcctaccatgtgtgctaggtattgcgttagccactgtggctataaaggcaaaaataaaaggcaaaacatttactagttatgacccatactctatgctaattgctttatgtatgcttaatccttataacaatgctctaagaagtgtatttttatcagatagctagatgacagccaaaccctggttccaacccatatctgtctgattataacattcttgttcttaatcactatactttactcacataatttagtgagagacgaaagtgtttatataactattataatataatgtgataaatgaaaaaaaaaggcactatggaaggacataggagggccacctggccagactgggagaagaggaagtggttaaggaaatcttctaggaggaggtaccatgagatgaatcatagaaaatgaaatgaagttagccaaggcttcatagctagcaaatggcagagcaaagact

SEQ ID NO: 162517 - DNA, 429 bp, Homo sapiens
tgccctctgggactcaagaacttctaccctaggtccaatgtccagatggtagagagctttggggtacagacttctatgctggagaggtttccaagagatggctgtttacggtaggatgttgatggaattcatgaaaataggcttacgcagtcagaagcataaaatagattttatttagcagttcatcagcttgatgtataacttttctatatgtagacgtatggtatgtatacatccagttgtaccattgtcctgagccttgccaatgtcgggttctcagccacactggcataccaggtcatcttaatttggagaggcaaacctgcagccttctcttggcctgggagtgtgaagcacacgtgcttatctccaggccaaagccctgatgcccccagatgtgttgattcattgttgaggaagcaggaggag

SEQ ID NO: 162518 - DNA, 245 bp, Homo sapiens
taggttggagaattttcatgagggaaagaatcaagcttttatagctctgttagatatggatgcccaagtaaactcttctactgaactcctggaaggagaaagcatccgaaattaggtaacagggtttggccaggtttacagcaggagaaagaaagaagccaatatgaccttgtgaacaaaactttttaggccaattctgcgtactgatgctgctaccttcacatctgaatatcactgggaactga

SEQ ID NO: 162519 - DNA, 335 bp, Homo sapiens
aatgcttaaaatatcaatttaaatgcaaatgaatcttatcattccaaattagactcatcccattgtgttgaaattaatatagaaaataacaccgaacaccaaattacaagtaattaatattgacactgtgaaaagtatacactctcattttgatatttggggaagaaagtcttgtctgtgcgtgtgccattgtgtcctataagcaacaactagaacacaataccctcagtgctagtaatcatgcaggattaacacagcaaaaatctgagagggaggacaaatggcaatgatacatcttagaatccagtaatctattctttgggtctgaggaaaag

SEQ ID NO: 162520 - DNA, 454 bp, Homo sapiens
tgcccacgactcacgaggatccctctctgctcccagatttctaacagaacgcgactgcagtggtagaatcttggctcactgcaaactccgccagaagcaattctcctgcctcagcctcctgagtagctgggattacaggcatctgccaccacgcctggctaatttttgtgtttttattagagatggggtttcatcatgttggccagtctggtcttgaactcctgatctcaggtgattcacttgcctcaaccccccaaagtgctggaattacaggtgtgagccatcacgcctggctgtttttcattttgtaaaagatggttaaaaattcatgacggggctcctgaaataaggcatcaagcagtaagctctaagcatagatgtttgagaaacagcagcagtcaggcgtgcattcatgatgggggaagcacctctgagcaaaggtacgggtggtcag

SEQ ID NO: 162521 - DNA, 318 bp, Homo sapiens
ctcagtgtccagggagcatgtttgaaactgtactgtgcatctcaaaggcctttggcagtaaactcatgttcctacgagtatgacggtgaatgataatcaacaggtcacagccatgtgacctggagagcagtgattaaagagtacgtttgtattagagataggggacccgttgtctgagcagctctcctcagccccgctctggccctctctcttcctctgagggaatggaactaactgtacatagaaaatatctgcccagaagatgaaaaaaattttatacgtagataaaacttataaatttcattgattaatctcctg

SEQ ID NO: 162522 - DNA, 350 bp, Homo sapiens
caaaagtgaagctttgtggtaagaaactattcagtttttttatttgatatgcactttcatgtgtcttggtgcatagtgctgatgggaaaagaatgaaatatatgatgaaatactgtgcttgaagagcagcaagcattgaacccagtcatagctcgtgaacttgtgaatggacctgtttctttttaagtatgtgaaaatttctgggaaatattctgatgaattttacataggtcatctcttactattgaacttaaaatatttccctttttctcccaagaagaacattttcagttttacttcttttgtcctgtgctgccttcagtgaatgaagaaaattactgctttattca

SEQ ID NO: 162523 - DNA, 196 bp, Homo sapiens
gtgaggaaaacagagaggaaaatggaagcctttggagaaggtgatagattgaaaaatgaggatataacataaaaggaacccgatgctttggcccttgccattgattggacatcagggtataatccgctggcagtgttgctgtcaatgtggtatctctgctcgggacctgtggtgacccagctcccatgatttggct

SEQ ID NO: 162524 - DNA, 327 bp, Homo sapiens
tttcatcaatccttaatgttgctgtcccggaactagtttgcagctatcctacccttaatggctcaactccaccatcctctttcaccttctaaaggaagctgtcctttcccaaagttcaaaaacaaaggagagaaacagaaaaacaggtacaaattccagagtaagcttaagacagtattacattcaagtttactccttgcttgactttatgattagggtttaaagacatactatcctctattcaagcgcttcagttaaatgcaagatagggaaataggataagagaaccctcacctcttaggttagtttcgaaggaccttcttcagg

SEQ ID NO: 162525 - DNA, 419 bp, Homo sapiens
actttgatatttctgatgttctgggatattataggaatgataccacttgaattcagctttctaagaagtctggtatttcaatagtcttaatatgagtaagaaaattatgatcttggtactggatctaaggcagaggtatcgaagctgttttaatgttgcttgagataggacagaacttcagagtaaaataaatgtgtatagacaatctgttcaatctgttcaaattaagttgttgagctgtatatttgaatcttaagactactaattttgttgtatctgtcttttcccaaatatatgtgtacttcttttaataagccaaaacctatgcaacttttactaattcttccctaactacttcttttggaaaatgattaaatcttatgtctcacgttttgacatatctattgcatttaaaagat

SEQ ID NO: 162526 - DNA, 271 bp, Homo sapiens
ctgggtttggtggtttgttttttttttgtctttttcctccttgttttctctttgaggactaacttggcagacgcagccaggtgtgaacagcgcttatgtggctgccgcggtgcttcctggaagaatcattataaattcgttcaagatctgatttcttgttggtttctgtgcttgtgagcatttagaataaaagtctgtatcagttaatcctttgattatgtaaatcattttattttgttttcctctcattttcaaactgaggtttgaaaac

SEQ ID NO: 162527 - DNA, 1061 bp, Homo sapiens
ccccgtaactcgatcagacatctgatcatattcttttccagtgaaatttcttttttagacttaagatagctaaagttggtttctattgcttgcagtcaaagaatcctacgtgatctgagtttacactccttagcctctttatgcccctttccttcctattttgagaaggggcagttgcaaagagactcccccattttcaaatgctggcatattaccttgacctcttctcaccaagaccatatccatatgtcccatcccccagttctttcctacccagcttgttttcctgtaaagctgatccaaataattccagattcaagattggcttcgacttcaatgcttcttctgcttctacctcacttcttgctttcttatcatagcatctgcaacagacttcatgtgatcttctcttgatctcccatttccatgctccgtctccctcctagaccctttctgatcgggctgcaggtcagttcctccactggaatcaccctcttgatccacatctctcctaacttgtggtcagagggcagcccctgggaaccaattctctctaacaagcataaagaaatctttctgattccctttgaaagtcatcaagaaaattacttatgggggacaagagcaaaccctttatggctggtttcctttgggggaagggcagaacagttcttgactttcagaatatatgtctaaggacttaacatgttcaaggaactttagagatacaaagatacttgaaagattcttcttttccttgccaggtggtggaagagagatgtgaagagaactaccatttactgcctaccgtggcggggcctttacatgacagtgtggagctactgccacttattacctgtgtattatactatgtgtctggcactatgctaagcaccttatacgcattctcctacttactcttacaactgccctgggcttgggtattattgccatttccattttgcagatgagaaaaataggctgagaaaagttaaatgaacttccttaagacatccaactaggatggagagtatgactcataaccagagtttgcttgagca

SEQ ID NO: 162528 - DNA, 380 bp, Homo sapiens
gtgagaaggagtcactgtgatgcttagctgtcctaaatgatggtttgctcaatgccaggactgggtttctggtgatgaatgaatattccagattttgaggagctctaagtggtccaggagtccaagtaagcagtctggctggaataaggcagcatcacggaaattctgtaaggactgacacagagagctcatgctgactgtgatgagaaattgcagcacctctatctcgcaggtaatggagtagtttgttattggtagtctactccaggccaggcagtgtgttatgggctgaggatgcagaaacaggcaggacacagtgctgtcctagcagtgcactggcgggtctctccatgcaggccacaacacagggtcagtgttca

SEQ ID NO: 162529 - DNA, 594 bp, Homo sapiens
gtgaaatgtgcatgtgagagatctaggttgtgagctccttatgagaatctaactaatgcctgatgatctcaggtggaacagtttcatcctgaaaccatcctccatctggaaaaactgtcttccacgaaacaagtccctggtgccaaaaaccagtcactgtgcattaggatgtatgggtgacacagtacttagtatctagaagtagggctgactcagcagaacctgaaatatgttccactggctgagtaatcaagtggtagatggcaagaaaacatgccttacaagctttcagctcttcaaaagaaggcctttctcagtcagtggcctgagatctaagttgaatgaaagtggtaataggggtagagggggttacaggtctcataggtggtaaagcccaaacacaggaaataagatggctgctcctagcctttcccaagaagaatcccgtgataagagttacaggttagctggacatggtggctcctgcctcagcctcctgagttgctaagagcacaggtgtgtaccaccatgtttgactcatttttgtcttttttgtggggaccgggttttgccctgttgctcctactggtctcc

SEQ ID NO: 162530 - DNA, 225 bp, Homo sapiens
tgccccctccctggagcacttagggatggatgggggaaactttcactataacaaaaggcgagtaaactctttctgaaaattagtttaaggcccctagtggtttaatctttactgccgcgtaaattaactcaaatattaagccagcaataaaccggcgctccagtatcaaccatccttttctctgttaatacgaactaggaactcaggttgctgttttctttcccc

SEQ ID NO: 162531 - DNA, 351 bp, Homo sapiens
ctagaatatccccagcccacagcatgggacctggccccttattcactgaatagatggatccttttctttatcctgcggcttctctgcagttcagtctcccagtctctgtctcccagtctttgtcacgtgtacaaaacctggctcttctgtttccctggctgtctctggtgtctctgcctccatgtctccatgtttctggaattttccgtgactattttctcctcttggggtgtgtgtgttttacgctctgcctctcgaagtctctattacattctgtaagtcaggccgggcacagtggctcgcggctgtaatcccagcactttgggaggcaagacgggcagatcacctgag

SEQ ID NO: 162532 - DNA, 540 bp, Homo sapiens
tgcccaggcgtgttggcagagggactttcaggcttcagaagaccaaacctctgtcaataccaggattattatccacaccgttagtttcttaatgtgaaggatatcttaaaattgatgtataacacattacagacagcgagaaaatatttccaaattatatctgataaaggacttgtatctagaatatatataaaagactcataactcaatggtaagaaaacaacccaatttttaaaatgggcaacacatctgaatagacatttcaccagtgaagatataggattggctaataaacacatgaaaagatgttcagtcggctgggtgcggtggctcacacctggaatcccagcactttgggaggccaaggtgggaggatcgcttgagaccagcctaggcaacatagtgagaccccatctctacaaaaaataaaaaattagctgagtgtggtggtggtgcatgcctgtgcaccatgtcccagctacttgggaggctgaggtgagaggactgcttaaactcggaaggttaaggctacagtgagct

SEQ ID NO: 162533 - DNA, 275 bp, Homo sapiens
ttagtaccctgtgcatagtgggtaggtaattataatttgtgaatataaaataatcctatactaagcttcacatatgaggaggacaatgctgattatcactgcacacattgtgagcggggcttgtaacagctgaagaacatgcacttgttcagttccctttttgagtaattattttagtcgcaaaagacaagaatgaattctttggccttagagtgtcatggggctaattggcctagtatgcatttaattcatggtcggtcttcattaatgtgggg

SEQ ID NO: 162534 - DNA, 326 bp, Homo sapiens
gtaccctaaagggtcttattacttaccctttaaatgcgataatgtgaaactttattgccattgagtgtatgggtaccaaaccagtactgtgtaaggagggggcagggggcatcaagaaaatactgactcatggaaaagggcctcataagactgctgtgagagaaaaggattttaacagttagcttcatttttctatatgtgagaaacagactgaacttaagttccacaatttcctcaggaaaggctgacctgaaggggtggttatgctgcaatataagtacttaacctgttgcatcatcaaaagtgtacctcctgtgttagagtat

SEQ ID NO: 162535 - DNA, 827 bp, Homo sapiens
gaagagtttttcaaaagtggaattactgcaaaaagtggaaaaatagcctttggatggaagttactgatgagacaatttccatcggtgtgaaagccatctttccaacagagatctgcaacatgagaatgtactgtctcctagggtggcaatagcctcttgtattagtctgctcaggctaccagatttatcgtttaaactgcccataaacagaccaggcagtttaaacaacagaaatgtatttcctcgcagtcctggaggcagaaagtctgcgatcaaggtggaagcagggttggcttcttctcaggtgtctgtccttggctggtaaatgaccgccgcctccctgggtcctcacatggtctttcctctgtgtgtgtctgtcccaatctcttcttataaggatgcaagtcttatggatcagagcacaccccaatgaccgtgtttaacttgaatcacctctttaaagtttctctctccaaatacaatcaccttctgaggcactgttagggcttcgacacaggaattcttttcctaggggattcagttcagtccaaaacgcctaccagtggagacttgcaacatggcggcctgctggtccctcgccaggaatatcacaggcgactgttccctgttgcatggaatagaaggctattccagagtactgtctctatttatgagatctgggatactgggagaagggcaaaataaagtccaagtagaaaaaaaacctatgaaagttttagagagtaaccataatttcagcccgatgtgaaacgatcctagatttcagctgaaatagtgatgtgggaagtgagggggccgggattcaa

SEQ ID NO: 162536 - DNA, 363 bp, Homo sapiens
tttaaccttcagggccacttcacctctgacctctctccattggaaaagtcaaataacacatctactgtcacacaaacaatgcgtggtagggctaggattagaatcctgacagtcagccacaagccagtgcctgacatgtggttaataattgaatttgataggaacccagtagccgcttgtagttggctttctcaagacctcaaatttctagatattctttattccctttatttatactggagatttgccaattttctcctgaattcatctatatctcacaatacaatactaaacataaaaactaaaacttaatatatactattattctggcatttctcatcactccaagttatagcctcagta

SEQ ID NO: 162537 - DNA, 406 bp, Homo sapiens
taagcatacccagagaagtcctgggctctttatctgtcattggagtatggtgctttcctgcctgggtgtgtgttcggctgatgacaccataccatttcagcctcctccccgtctgctgctatcatgggtaggatgtaaagaaccaggattcattacatttggactataaacttttgcatacagtacttcaatgcaaatgtcctaacagccatatgagattctcattatttcttgtacacatttcactcaggaggcaatgtgatttcaagaacgtaattgacttgtgctggttcacacagctaagtgttgagcagattcagtatatccccaagcccatggtgaatgcggtttcttggttaggacccagggaccaattttttaatttcagctgtactactaaatatta

SEQ ID NO: 162538 - DNA, 490 bp, Homo sapiens
cagggagggcggctgctgccccctggcgtccgccagagcccgcggcgcgtcccgacagctccgcgcagtccgggcccgcccgggaaaggcctccacgccagtcaaccccggccccctcctgcgtccgggcccgcggcaacgcccggggacagtccctgcgcggcagcggccacagcaccctagccctgggggagggaggagcgggcgtcaggggccccgtgaggtcggcgagggacccccgcgccggggagcttaattgaggggctccgcggggaccacaaagcagcccgcggtggaacggggccgggatccggggactgggttgcagccccggggtggatgagaggccccgggaggtgcagggcccggcagggagggcgtggagggactcatggtgacgggagcagcctccgctgggagggagccccgccgggcggggtcggagttggcagcgcacgccggaccgggggcggggccctccgagctccgc

SEQ ID NO: 162539 - DNA, 615 bp, Homo sapiens
gttctcatatttttatttatagcaaaatgcagaacatagtttcaatttctaaatataaactgttttttagaatttcatcctgtgagatacagtgccatagtgttgggagaagtatgttccaaattcagaagtacttctgtagcatcaaattgatttcagtgactcagcatttcaacaagtatttaccgagcacctattatgtgcgcaggccctttcctgggtgctggatatctaatgttgaataagttagacattctccaagtattactgaaaagttgaaattctgtttttaagaccttctatgattaattcttcacatgatgttcagttttgtgtggcctggggtataactgaaagtttcataagatcactacgtcctatttccatatagatcaaataaaagactcttgtccatcataaatctgagccactgtttaattggacatcccattttttgctttaatcaaaactagttctttagctatgatttatcgtttatcttagttctttctcctcccttccattaccaagaaaattgactctctttttatcagctttttttttttttaagacagaaatgtttttatgacttcatgtgcttgtatatatatgaga

SEQ ID NO: 162540 - DNA, 232 bp, Homo sapiens
ctagtttctagaaccatcacaattaaatataaaatcatttaacaaagttaaaatagaccttaggcatcatgtgacttaagattggaaaaaggttttattttaaggctaatcccaattcactggtagtggctgcttggaatagtgtgattaaaaggacccaggcaaggtccaggttcagttggaaagagggctgcgtttggtgtgtgttgtctgccaggagtgagaaagcagg

SEQ ID NO: 162541 - DNA, 262 bp, Homo sapiens
aggctaagactatcagctcttgaaattacggatccccaccttgtccagcaccttgcacagcatagatgcccagtattatcaatattatcaaatattatcaaatgacacctcactgatttggacacattgtgggaagggtctgtgtgacataccaccagctaaagcatttccaagtctatgcaggaactcccgaaataatgaagctagcagaatgcctgcaactccataaatatcatctcttttctcaagaaggagaaccaag

SEQ ID NO: 162542 - DNA, 141 bp, Homo sapiens
tggcagctttaggagcccctgctgtgtcagggacgggggctggacctccccatggactgcccccactgtcctaacaggccacagcaggggagattctgtgcgctgctgactttctgcatgacatcttttggaaggatggtg

SEQ ID NO: 162543 - DNA, 398 bp, Homo sapiens
cggaagcacactgcaacagcagatgaagaagagggaaaatcagaccactctgtactgggaagcagagacaggcgcttcttgttttggcctccccatgatacgcattttaaaacatgttgttgctaagactttggaattcatgttgctttttgtcaactataggtacaaaggagtatgtcactttttatagctgttccaaaagctggcagatattaagctaagggccagatatggcctaagataatagaaataaggaagtaagctagaattattacaacttcccaagatatttaaagatgtctgaataactattctaattacaatgtctcatatatttatgagattattcttgggtcatttcagaccatgctgggacatacatggtgcggtatgctcag

SEQ ID NO: 162544 - DNA, 214 bp, Homo sapiens
acatagaattcttttatttttagtaatttgccacagtgaacgcacccaattcatagagggaaaaacaaatcctcttaggaaaataactcctctaccctactcagcggtgggtgtcctccctctccttagcccttccatctggaatggttgaggccgcctctcccaagaagcgctcgaagcacacccgccagcgtatcgctcagcgctccccctc

SEQ ID NO: 162545 - DNA, 499 bp, Homo sapiens
gcattcttcacggaaatgtgcctgtgaggagcattaactcctgttatacagggagaatagctagctggtagaggtctcagggagaaatcttgcctattgctattgaggaggccaggtcatcttgatttaccattttatgtcccacctcccttcccacctctagcctctcttctcctgtggtaggaggactaatggccccctcaaagctgtccaggtcctaatccccagaacccatgaatgtgttaccttacaaggtaaaaggaattttgcagatgttattaagttaaggatattgaaatagggccattatcctagattatccagggggcccaatgtcatcacaaagtacttgtaagaggaatgcaggaaggtcatacggggagaaggcagtgtgacaagagaagcagagataggagtaatgtagaatgagcggtctacaggtgcagagggatctacaggtgcagagggatctacaggtgcagcgggatctacaggtgca

SEQ ID NO: 162546 - DNA, 653 bp, Homo sapiens
aagtagtttgtgtgacccaagatccttccagttatccatctgccttttcagacttctcagaaccaagactcagaagaaggatattattgtatgtgtagaggtttgattggagacggcattagtcttctctcacgctgctaataaagacatacttgagactgggtaatttacaaaggaaagaggtttaatggactcacagttccacatggctggggaggcctcacaatcatggcagaaggcaaagaaaaggcaaagtcatgtcttacatggtggcaggcaagagtgtgtgtgtaggggaactgccttttataaaaccatcagaactcataagacttattcattatcatgagaacagcatgggaaagattcgcccccatgattcaattacctcccacctggtccctcccatggcacgtgggaattatgggagctacaaattcaagatgagatttgggtggggacacagccaaaccatatcagagacaaacactacttaacaagggtaaggttgttgtcccagttgcgcctgagctgctgtggaaggctgttgattcctgaccaatgtctgtggttgtgagggtggcaggtaacactgtgtgagtgaagcctgggctgtcagggaagggtgtagatagtcgactatgaatgggctt

SEQ ID NO: 162547 - DNA, 347 bp, Homo sapiens
ccagtgggttttatatttataaaagttttgttttattctttagcatttttttctttgagatttaagaactccctttagcatttcttgtaagatgggcctgagggtggtgaatcctctcatcttttttctgtttaggaaagtctttatctctcctttcaattggaggggtaatttgctgaagaatatattcttggatggcaggtttttttttcttttgagcacttaaaaaatgtcaatccattccctcctggcctgtgtaatttgcattgagaagcctgttgccagaggaattggaatgccttcatatgttatttgtttctttcctcttgctggttttaggatccatt

SEQ ID NO: 162548 - DNA, 263 bp, Homo sapiens
aaccctcttctttctttctgctcctcctggacgtacccacagtatgttacttgtggacactcgaatcttctctttccttccaagacctcactgagtcactggccctctttactcagggacattgtgaatatgcaggacccaaagaatcctgcagataggcactgtgggaccaattacttctgaaatattgacaactatagctactattggagtttactgagcaacaggatgaagaaacagcagcatctgaagcattcatttac

SEQ ID NO: 162549 - DNA, 328 bp, Homo sapiens
acagagtctccagtagtgtttgctgtgttgtatgtgctctgtaattggtagccttcattttggttgaagtcgcctgtgtttgtaccatcaaggccatttatacaggaaggatttgggatgggcttgttgggggtggtgctaaaccgaacctgaaaatgcagaacttagaaacttggatcctgcgtgagcaagtgccttcctacggtacaaatatctccttgtagaaagagtagtagaatcgcacagtttccagtgtattcatccacctccctcctatgtggtgtaataaacatgttcaggagttagattcttgtgaacacttacagag

SEQ ID NO: 162550 - DNA, 130 bp, Homo sapiens
actagttcaaccattgtggaagtaatcttttaatgatattttcttattatattgctacaggcaacatcagtagaagcctatctagttacactaaactaaagatcacattcaccattcttacagccaagtg

SEQ ID NO: 162551 - DNA, 317 bp, Homo sapiens
acctgccttttggggatcttctggcatgatgcaaacatttgtatcaaaaaacaacctttgctgtggagaaaggaggtggcagaacctgtgccccaaagcagacgactgtgccgtgagggtgctgtgtccacgggcacctctgcccattcaggaaactattgaatggttacacagcagggcacagagggacttttattttctttccagacaatgaaaaacagcatcataaagaagaaaatgcttctacactaccctcactctggccaggcacagtggctcaggcctgtactcccagtacttttaggaggccgaggcag

SEQ ID NO: 162552 - DNA, 285 bp, Homo sapiens
catccctttgccaatattatctactcagagacaagtccaaatgccaacacctgggagaagtctttgccaatgattcctcccctcacccccatgggagttaatccttcctcatgttccctgactagcctccttcccaggtaatctgtccagcacatcctccacttacatgtgttacggtgaaccttcacatgcctatctaatttactgggagttcttgaaaaacaggaactgtgtttcatatgtctatacactattttcagaacctggtacacagtgggcactcaa

SEQ ID NO: 162553 - DNA, 449 bp, Homo sapiens
aaaatatacccttctccagcaattcatcagttaatatacatcttcacttgaaatactattctttttgtataaatggctattcatattttaaagggatatgaaccataattggaaaatattttccagatttcagggaaacaagaagaaaaacttatatttttcagcttcattctttgccagcttttcattctgagatatatttttagttttctcaaagacaagaagaaaacattttctatgatttttgcaaaaaaaactgggtgactcacatgttatatacttcccattcgctctttgagtgaatgctgagaaggtcagggacaggagacaaaatattattccccagagccaaagacatgtgaagaacttccaagaaattgcatgatcctgtttgttatctctcatgggttgcaaaaagtaaaccctaaaagattttccccaccttcaaa

SEQ ID NO: 162554 - DNA, 173 bp, Homo sapiens
ctagaatctcaccacatggaagtttctataatcagagggttttctctgggttgtgcagactgtggagccaaaaggcagactcatacagaagacttctcaaaggggaaaaaagaactgaaaggactataattagaaaaatgtgattgtaaattaatttccctttaggatgtaag

SEQ ID NO: 162555 - DNA, 371 bp, Homo sapiens
tagggaaaccaccactcctgcatccaatcttatgcccaaaaagcctgaagggaatctgaggctcaggctggagctggtcatgccccctctgccagcacctcctcaggaagggggtgactggcatccctgggtgaaggctatgctgtaacaagggtgggggtttgggggtggtgctattcacctgcaggaggtgtaggcccgaggaaggagattgcaggtgggatggaggctgtggccaggtagtggctcaggggtgaccctgggcctcaaacctctctgtccccccctgtccttccttgtgctatcctggcttctgagagggcagctccctgcaggaaacaccatcataggaataggtgcagccggcaggg

SEQ ID NO: 162556 - DNA, 650 bp, Homo sapiens
aagataaaaaatctagaaagaaaataacgatactgaaaatacaatcttctttttaatttcaaaagacatgtgaagtagactcagtcttggggaaggacatcaaagcctcataagagctgcatctctaacttagtgacatgtgagtgaagcaggctgggagatttccccagggcttctcagaatcgtcagcgggtgaacatccctgtgattttcctgtgcccaaagcagatttctcagagcagttctcagaacaggtctagaaatgactgctccatggcacacactttgggaaatgctgctcaggtaaaggccagaaaggcccagacactgtgttagatcgaatgcagtggtttaccagcaggaagaactgtggcagcctcttgggaatgtcccttgagtttcatattagtcctctggaaatgacaagacagtcgttctgtctgtcctgagattcagatgatctactctacagcaataggattgtttgtgcaggccattcgagttcagtagctcttctccagaaaaccataaaatttcttcttttgaaagttcttgacaggcagaatttagttgtcaagttagagcatggaatcacgaccctgcatattttaaaataaaacttctcttgttctgcatatactttagtgcta

SEQ ID NO: 162557 - DNA, 489 bp, Homo sapiens
gctccatgttatcttcaacagacagttcttccctgacttccccatataaaatactcccagtcactcgctatagctctcatcctgctttatttttcatcattgcacttatcaccagtgatgttataattttattaatttgtttaccagctatcttccttgactagaatttaagcttcatgatagcaggctttgtctgttttgctcattgctgtatcatctggtatatgtaaggagttcaataaaatctgttgaatgaataaatgaaaaaaaaaatttcagtcccccagatgaagaaaaagtccttggaaagactgggaccacttaagaatgagtttttatataaattagtatgaaaatgaaatgtttattttataacatatagatctcaatatattttcattctaccagtaactgactactctatgggattatctaaggaggatggttctatccacctatcacaaacaacttggtaaacctctaaaaaat

SEQ ID NO: 162558 - DNA, 456 bp, Homo sapiens
cccagagaagcgccttcatctggatgaacagtcctgggggtcagcgctgccactggcttgggggacagagggggcatgactgctggcccttccgggcctcgtcagcgtcagcagccacgggcagaaacatggacagcggatctgaggagggtgccatccaggcttaactttaattcttggtcaagttcaacatggtttgtgttccctattcgcttgtctccagctggcttgtttcttatggattcatggaactccaagtgttcagggggagtcgcctttttgtcattttcctcgctttgaatttcgtgaggatgtttgcagaagtttttacttttctgtgcacttaaatctgccagtctcttgagatttcatgtattgatgtgctgagaacagcctttcctacctaagatggcatgagttctggaagcttccctctggctcttcccactcatgtct

SEQ ID NO: 162559 - DNA, 234 bp, Homo sapiens
tgctgggattacaggcatgagccaccgcgcccagccaaccctggtggtttttaagagcatttgaaatctggcataatatctactttaacaagtactgcaagatgacttactggataagtcatatgaatatttccaagtttgcccagcatcaagataacatctgtacttccagttttgcaattcaatttgctttggaaataaaaacatgttgctaagctcagatgattgcaatgc

SEQ ID NO: 162560 - DNA, 476 bp, Homo sapiens
ggagctcggtacctgtgggtagcaacaagtgcttatgcatttctgaagagacaggaagcccagtatgtgtcacatatttggggatgatccccttcacttggatttctgccttcctctttgcagacaccttttttcccctacattactttgaagattcaggagctcatctttgattagctcccctggattaggagctcccttttctgattgcttctgtcagttctctgtgctgtttctagacctgtttccatattcttcctcaggttcttcttttcaaaggcttcatgctctttgatccctgagtagcctgttcccatgctcacccctgatgattcaatgttgagcgttgcttcagaatgtttctttggccatctcttgctgctgcttctcccaaccttcatgctgatcctgctgcctattactgcagaactaggccgatagctttcctacagctttctgtctccattttgttcttc

SEQ ID NO: 162561 - DNA, 130 bp, Homo sapiens
ggaaccctgagatgatatatttttcacagtaaacttcaatccttggctacttgagattatgatcttgatttgccttctgatcatgtcgctcaagcttgacgatttctgctaacttgtatttcttttctag

SEQ ID NO: 162562 - DNA, 256 bp, Homo sapiens
tcctttttctatccagtatctagtgttatccaggttgctgctggtgttataaaaagcactgaaagaacaatcctttaaaacttagctcaagccaacttccttgccaaacatttttttaatttctttttttcttattgtgaatcaggtagcctcttgagccacagtaagctaagagagactcccttgtcaaagatttttcagattaagtcagtaaacagtaatttctctttgctctgatcccacagaattcactgag

SEQ ID NO: 162563 - DNA, 318 bp, Homo sapiens
agactcatcaccaagaacagtgctttctacagggtagaaaatgattatcaaaggaatggatttggtactctttatactttcattttgggatcaaattcttatatagattggaatttaattgccttttacagctatgaaaggcgacaattttattaaattgctctttggaattccttgttttgcatttatagtcaactggttcctttttggttttcatgttttatttctaagtgattaacaagttacaggctgttatttaaaagcccttcttcagtgacgcagctgtggaaagtactaataaaaatggaattggctggg

SEQ ID NO: 162564 - DNA, 481 bp, Homo sapiens
gaaggttatatccacatcgtacagcggatgctacactggacacggatgggtagaatcatccattcagtgaagcatgacttgtgttgaacaagacaagctggctgaagcatttgaaggcgcttttgaggtactgaggtaacattcaactgatcttcactcctccccagatgacaaaaattacctggctttcgtcagccactgtcctcatgtcagaggaaattccatctgctaagaagtgttgcccacagaggaacctgtgtatagctggagaaccatcatagcaggaagaagctctgaccgttttaataccttcacgaatccccacataatgctaagatggtgtcttgtatccaggagtagataaaaccaaagatgtctttctgtttgtattgaaaaataaagaaaaactttagggaaaaagaaaagtcagccagaaccccatggcttactcagaaaattgtcagggccctgaggaattatg

SEQ ID NO: 162565 - DNA, 346 bp, Homo sapiens
tatttttcagataatgaggattgctgaaaacctaagtcagcctgaacaaccagtacattttcttgaatttattgtacataagtcccccacgtaagaggctgctggaaaataccaaagagacatgagaaatgtcatttctggccatggggagatcaaacacacagcatatcaaagatcacttacaaagcatcctgtgataaataaatccacagcagcataacacaaactaaagacatgagtatatgatgcatttttacccgaggctaccctgggctagagtttccatgcctggtctttgttttgataaagcaacactttacacatgtaggctggaaattatggtggg

SEQ ID NO: 162566 - DNA, 463 bp, Homo sapiens
ctggggggttgctgcttccaagcacccagatcatgtctttgacagcctgtgctgcacagctatatacctttctttgggtacctcggagttggcattaatgggagtgatggctgtggaccattatgtggctgtgtgtaaccctttgaggtacaacatcattatgaacagcagcacatgtgtctggatggtcattgtatcatgggtgtttgggttcctttttcaaatctggccagtttatgccacttttcagcttactttctgcaaatcaaatgtgttagatcatttttactgtgactgaggacaattgctcaaggtatcctgtgaggacactcttttcacagagtttattctttttctaatggctgttttcattatcattggttcttttgatccctacgattgtctcctacacctacatcatctccaccatcctcaagatcccgttagcctctggctggaggaa

SEQ ID NO: 162567 - DNA, 416 bp, Homo sapiens
atagtgaagatgtactgctgtacaagccaaatgaaagcaaattgcttctgaaattctgtttgtagagatagagaaacctttgccagaatgatagctgcatatcaggtactgaactaagcagatcacatatgaataccagctcttccttgtagtcattaagattaaaacacagtcatcctctaaaaatatttgttttctgtattagccagacagttgtattaagtaggtacctgctaggaattgcaatccttgcatctttcagttctttgacaattctttcaggaatgcaaattacttttgtttggagggagagctcctgggatctccatcagacttcctgataaaaactaccctgcaactccacctgtcatggcatcagtatgggaattttgtctgttggaaaactaagactgccc

SEQ ID NO: 162568 - DNA, 692 bp, Homo sapiens
agacaatccttattagatggtcattttacttccacttttggtacgacattctttcttcccatgatgtgtcaatggctctatgtatcctatcattggtgacacaatcccttctataacactggatacttacaatcagtaattaacttaatgtgtagctcaatcactaatgttaaaagtttatcttttaaaaatgactaaattcataaaataatgtctaggtgttttttgacaatctggtcctaagtgatctttttctttttcacagggaaatgggggaaaatcagacaatggtcacagagttcctcctactgggatttctcctgggcccaaggattcagatgctcctctttgggctcttctccctgttctatatcttcaccctgctggggaacggggccatcctggggctcatctcactggactccagactccacacccccatgtacttcttcctctcacacctggctgtcgtcgacatcgcctacacccgcaacacggtgccccagatgctggcgaacctcctgcatccagccaagcccatctcctttgctggttgcatgacgcagacctttctctgtttgagttttggacacagcgaatgtctcctgctggtgctgatgtcctacgatcgttacgtggccatctgccaccctctccgatactccgtcatcatgacctggagagtctgcatc

SEQ ID NO: 162569 - DNA, 579 bp, Homo sapiens
taatcccaacacgatgggaggccaagggtgggaggatcactagaacgccaggagttcgagaccagcctgggcaacatagtgagatcccccaccatctcaaaaaaagtaaaataaataaataaataaaaataggtaagaaccaaaatatggtatttttcttggcataatacaaaatcagctttatttatctttcttaccttaatgtcttctctctatctaatcatataccacacccctctcactttcaagtacaaagctctaccctacttacctacgatttattactcaactcaggaaactcccctaactcattcccctctacccttgtcaccacctacttaaaagattgagaatatgcacccaagggggaaaaaagccctctataacaaaggatttctccttggggaaagaaacatattcagatttctattagggcatcttagtcaagttggccaagagaaaaattaaaagttcagcaattttgaaccactcaacagagacagctctgaaagcactactcaggggagttaaacatggcaagatgatactgaagtccaacctaaccagctacatcacata

SEQ ID NO: 162570 - DNA, 441 bp, Homo sapiens
cttctaggcctgttgtgtgcttttcagtggatgttaaacgtggagtgctgtggggttggaattccggctggaagtaagggccagggcactcaagatgcaaagaccagtgaggccaactttggcctgagtttgctcacaggtgagccaggtagtcctgggctcagaccctcccatcctagggaaatgcaggctgtgctcaaggctgtccattgtgggaagggactcccaagggactggctgtgtccgatgggtcagggaaggtaacatttgaggtcagtcctgaaggatgagaaagacacttctaagctcaggaagagggaaggaccttccaggagcatcctgggcacagatgagcagtttgatggatgggcagggtgggaggatgagagaggatagacaagaatgggggcagatatgtctatagcattgagaaccaaataa

SEQ ID NO: 162571 - DNA, 295 bp, Homo sapiens
caggatttgttttgagggttaattaaagtaatgaaagccaaggcctgagtgtggcacctggcatacagtaagtgcgtaatacaggatagctctttaactggtagtgttgctgagtcacaagcttttgcccttgacttcaacccagtctgtcttttcacctgctagttggatgaagatgtgtaaggcgtgctgataagatttgctgatgacacagagctttaagggggagcaaatctgttggatggtagaactgaaattcaaaagttgtttgcccctggattgagctgaaatccaa

SEQ ID NO: 162572 - DNA, 132 bp, Homo sapiens
taaactacagcataccagctgaaccttgggatacgcttaattgcccagggtggcttaatcttcagccctgccagttgcagaaggattatttgtctttggtgaactcagtggagaattgaaagtaaatttgtt

SEQ ID NO: 162573 - DNA, 497 bp, Homo sapiens
ttcggccccaggtacgcatcaggcctcagctgaataaccagtccccaggtggacattaacccacaggtcaaccacagtccccaggttgatacctggtccccaggtggctactcaatctgcagggtaacattaggcccctgtaggatcccaggccccaagtggattcctaggcccctggtgaacatcaggtgcaggtgtccaagtaggccctgggtggacataactgtgtacaggtaaggagttgacctgtggggaggatgagcagtcagcagcccactggggtcctgagtaggtcttctggaaggaggaggctgaggggatggaactttaaagaagcaacctcacttccttggcaacagaccctaacagaacttagaattctggtaaccaggccaggcacggtggctcacacctgtaatcccagcactttgggaggctgaggcaggaggatcatgaaatcaggagatcgagaccagcctgaacaacatggtaaaacc

SEQ ID NO: 162574 - DNA, 183 bp, Homo sapiens
acaacttcttcaccatgtgatgttgcccaaagagcagccagaccctcctaaaattaagttatgttacatcattcatctgttaaaatccctcaaatggctccccaccttgcttagtaaaagcccaaagtccttgccatggcctacaaggccccacataatcagtgcacacacacccgtcaccct

SEQ ID NO: 162575 - DNA, 581 bp, Homo sapiens
  misc_feature (196)..(196): n is a, c, g, or t
atagccatcataaaagtaaaatgtaaaattactttgacattcggagactctaccattgtattacagaaaagaagttgttaataatctttagatcaaattagaactatttactgggagcccaggcatggtggcctacgcctgtaatcccagcactttgggaggcagaggtgggcagatcacttgaggtcaggagttncaagactagcttggtcaacatggtgaaacttcgtctctactaaaagtacaaaaattagatgggcgtggtggcttgcagctaattccactggaggctgatgcatgagaatcacttgaaccctggtggcgaaggttgaagtgagctgagatcacgctactctactccagcctgggtgacagtgatggaatgagactctatctccaaaggaaaaaaaaaaaagaactagttactgggaagtctgttgtttgaaatagaagttttgatgccttgtttgttcatttagttctggtagtattcatggccgggaggaggcgggagtcacagtaaggggtacctcattaaattagaaagctctctattctaatcattatcccttaaaaaaaaa

SEQ ID NO: 162576 - DNA, 344 bp, Homo sapiens
caagatatagtgaggagtttggtaaatctattcctactcatcaatagaatgtagcagtttgatgacttctaaaaaacctttcaggaaatttgaatgaatagacaaattgaaatataataattttttgttaccactgtgccctgatgctttcaaatatacaatggaatcaatcatcgttacaataaagttgccaagagtgtttaggatctagaaccaaataatctggttttgaaatattgttcataaccggtattaagtactgtgatgattgttgcatttgcgtatcagaaggaccatgggcttagtcttgaatccgctttctctcattgatatgagtatgataa

SEQ ID NO: 162577 - DNA, 1095 bp, Homo sapiens
agcgggggcacgagccccgcccgagctcaccgcccctgctcccctctccgaccctttgagccgtggccgttgccagatgtccacaatgggaaacgaggccagttacccggcggagatgtgctcccactttgacaatgatgaaattaaaaggctgggcaggaggtttaagaagttggacttggacaaatcagggtctctgagcgtggaggagttcatgtccctgccggagctgcgccacaacccgttggtgcggcgagtgatcgacgtcttcgacaccgacggtgatggagaagtggacttcaaggaattcatcctggggacctcccagttcagcgtcaagggcgacgaggagcagaagttgaggtttgcgttcagcatttacgacatggataaagatggctacatttccaacggggagctcttccaggtgctgaagatgatggtgggcaacaacctgacggactggcagctccagcagctggtcgacaaaaccatcatcatcctggacaaggatggcgatgggaagatatcctttgaggaattcagtgctgtggtcagagacctggagatccacaagaagctggtcctcatcgtatgagcctttttcttacaagcaccacccaacaacttctgctttcttccctatctctttcaagatttgctcaagacgtccaactgtctctctgacttatctggaagtatttctttttgtgaagccatatgtcctaacaggagcttcatcaccaactcagtgctattaattctccttctctgaatgactcagggtaccctatagggggaagagcaagtcaaatgagcatagtggggaaagaaaaggaaatggcttttataaacatcttttactttgttttgattcaaagaccaaactagaactttaaaagttcaaaaataagaaagtatacatttttgctgttatttctcatcattttgtatatgggaggaaatttataatttgcatgggtgttaggtgaactgttttcatttgcttgtgttcagatatcttgccagattgttaacttcctattgtagcaacagggacaaatatatttgtctttgctgggcaaaaagtaatca

SEQ ID NO: 162578 - DNA, 587 bp, Homo sapiens
acctcccactctggtgcacaagaagcttcaacacaataatatgggagaagaggttttgtaaactataaagcaccatgcacatgtgaatgctattatcattctagggtagtagttggccaagtttactaatgaacacacacttagggtttcaatgagtctttacctaagcacattcccactgccctgagtcacattaacctacttcagatgctaacttggcagtgatttttactaaaatactgaagctgaaaaacataaagagtggttttcctatattatctctcccttggcttaaactgtgaagcaccagaacttagtgatcagacaacatgacctggaatcagactcccaggaaagaatcccacctttacatcttactagcttggtgaccatggaaagtgatgtggcttgtgtgtgtctcagtttccctcatctgtctatccaaaccagaacatttcagagtgaaatggtttatcatctgaccaggacatctgagaatgaaagcaggtgatgtcaatgttaatgcgaggacaacaggcatacaccagaacggtccccaggcaagtagaggaaataaggtggctcta

SEQ ID NO: 162579 - DNA, 331 bp, Homo sapiens
gtgttgggtcagcacaaagggccactctgtgggacatggtggggacaggaggacaggccagattctgcatttgttctttgctggatgtggagagagggcaggatgggaaagccatggcctccaccaggccaagcactgctttgagatgctagaccactgtgctgagcccgtggacatttcccttgggcttcatgctggaaatctggccaaaaaaagaacgtttttctccccaaatgcccaagactttgtaaatgtcaactatttcagagcattttccgggttactaagagcggtggtgggggtttttgaggaaggctcattccatccacac

SEQ ID NO: 162580 - DNA, 176 bp, Homo sapiens
gggtaattaatgaagaaaagaggtttaactgacagttccgcaggctgtacaggaggcatggctggggaggcctcaggaaacacagtcgtggcggaagggcaaaggcaccttcttcacatggtggagtgggagagagtgaagcaggaagtgctatacacttttaaacaaccagatct

SEQ ID NO: 162581 - DNA, 302 bp, Homo sapiens
ctagatcatttgccgcaccttctacgtcagcacttgcttcttcactttgtacttagataatgaaaccagcttctttttttaaaccccgtgaaacaaattctacagctttttttcttttgcagctttcccacgtctcttagtcatcatagaatgacagagagttatgtccttgctctagattagatttggcctaagggaacattgtggctgctttgttcttcaatccaggctactgaagttttctccatgttagccataagtctgtttcactttgttattatttgtgtgttcactgaagtagg

SEQ ID NO: 162582 - DNA, 477 bp, Homo sapiens
agtggcctccaggctgtccccagtccctgggagctctctcccagagggtgaatctcattgacaccacaccaggataagggaactggctggtgttgagtgaaacctagaaccacccccaccatctatgtggagggcatacccagggcatcagtagctgcatttcccacctagcttctgccaggctcagcacaactatgtccagttaggtgtcccacgcctggtgattgcccatgcattgggccctgaccccttcccacagcactggccctgcctggggacacacatctctatcccttccatccaccatgaacacataaccagcctgctctcaaaccatgatccttgccccacacctccctgtagtcctgtaagcctcaggcgatgcaaaccaagaggggaaaggccctggagggttgtgggggcggctggctgtcataggcaccttagccagtactccagggaactactcccaccccc

SEQ ID NO: 162583 - DNA, 219 bp, Homo sapiens
ctgcttcagttcatttgttgttttcaagaaaactatgttgagcacctactgttgacagacactgtcctaaggaactcagaaacaaaaataactaaatatgccttctagaacactgcatattgaagtctagaagggaagagaaggtagacagccagaatacaatgtgttagattttctgatcaaaatatgtggaagttgttatgggcacacattatggag

SEQ ID NO: 162584 - DNA, 169 bp, Homo sapiens
gatttgcctatcatgtcctggatggcagactatatcctctaggactgcccaacatcttttaatgctttcttgcatcttcattatattcctttcttatagaccttttgtcttactctacaaatataatcaagcacccaaacctaaaatgtttcctcaatcctatctgttc

SEQ ID NO: 162585 - DNA, 325 bp, Homo sapiens
ctgaatggcagaaattgttattcccattttacaaaggaagaaactgaggctcaggggtttacataagttgcccaagatgatataactagtaaggacacagctaggagtaaaacccaggcctgcagaggtcctatagacataatctttgcattacacagagccctggccacagctacctcctagtcctaatgttctgcaagtcttgctttttaagctctgtttttgttttggttttggtttgttttttgggttttttttagacagagtcttgctctattgcccaggctggagtgcagtatataatttctgtgcccatttcagtcgg

SEQ ID NO: 162586 - DNA, 310 bp, Homo sapiens
catggcagggcgtgcgcctgctgcggtgtgggtgactgggtcctcaggagcagaagcggacgtgggtgtctcaggtctgaccgtgctgaggagacagtccacagggggagtgggggcttcagaggatgagacaggaggtgggaatattttgggactggccgggggcagccaggctgtggggacatctcacacctgtgtgcctggggccaggttatggagctgtccaaggtctttgggggaagaaacagcctatgagaatgctctaggcatgtcagggacaagaacagctgtgggggtaccctcagtttca

SEQ ID NO: 162587 - DNA, 190 bp, Homo sapiens
gggagaatcctgaatattggcctaggattatgccgtgtcaaatctaaagtttcttttgggtttctgtgatgtactagaataacatctatttaatttaaatttcatatttaaattttgtttatatatttaaatatgatctgacagccttactacatattagggttgtggtccttttttctttttttttttt

SEQ ID NO: 162588 - DNA, 119 bp, Homo sapiens
atcacacttgtcaaagtgggtctaatgatgtcagtcatctttttctaccttgcatttcttcattgcagcttacactgacaaatgataccattcctatgtccacagttttctttgattaa

SEQ ID NO: 162589 - DNA, 425 bp, Homo sapiens
agaaagaaagaaagaaaggaaggaaggaaggaaggaaggaaagaaggaaggaaggaaggagaaggggaagcagaagggagaaagaaaaaaagaaaagaaaagaaaagaaagctaaacaaaacacatctgtggggtcaaatgaggcccaaactctaccaggttaggactcgtgacttcaaggaaccatctacttttcatggtttgaacctgggaacattgatcttaaaagcaaaaacagtaaaatacagctggaccccaaacagtgtcaggtttggcgagcttattaaagtacagacctgagtatcttaaccagatgatgttcacaaaaccatggatgaatggtgcagggctcatgtttaagagttagcccagatggactgggcggagctggttaaagacccatctttcctggaaatgatttccct

SEQ ID NO: 162590 - DNA, 344 bp, Homo sapiens
agagagagagagagagagagagagagagaaaccaaaacagtggggagatggacaaaagaggaatttccatttttaacaactgcctcaagtaattctgatacagacaatatattcagaaaacactgatctacactctactcctacatatgcttagaaaaagggaattgtcatgtggcttacaatttcattgctaaataaaatgggggcaacttggtaaacagaggctttcttccttctatcaagagagtatatatgtgcatagccaattcagcctccccactcctgaagagtgtgcaatgcattctgccagacacacagatcttgaggtaaaaagaagaaaatat

SEQ ID NO: 162591 - DNA, 438 bp, Homo sapiens
aaaaaaaggtgaccacccctgaataaccatctctacaatcactaccggctttgacattatcacatctggctgagcacagcacactcaggaatataaagctgtcccaaaagcaaagagataagaccaatctcacttattaaaatctgtctggataaggtgcccttctcaatatagtggaaagcctactccatctttaacatcagcatctttgtcgtcattaaatcctctttaagtcatctggttttccgcagcacataatcttaacttctaagttgttttagatacaacacttactgaatccctgtaaaatactataactggatattttatctcaagtaacaatgagataaaattttttaacatcagaaaggtggtgttttccattaacccaataggtacattaattattttcacttacaacaatactttttaaaatga

SEQ ID NO: 162592 - DNA, 334 bp, Homo sapiens
tggttacatgggggtgggtgtctttgttgctaggaaatatgctttgaaatattaagggataacttgcaaatagtttaagaaaaatatatgaataagagagagagcagatatgattaggcaagtgtacaaaatattatgggttgggaaatatggataaaaggtatacgggagctctttatactattcttgttaagtatagtaagtttgaactagtttaaaataaaaggtcaaaggaaatctttgtgatctcaggatggcaataatttcttaaggtaggacataaaatcatgaaccataaaagaaaaaaagtgtaatgattccataaagtatattt

SEQ ID NO: 162593 - DNA, 597 bp, Homo sapiens
aaaccatagcaattccactcctagtctataaaagcgagagaatttaaaacagggagtcaaacagatacctgtataccaatgttcatagcagtactatttccaatagccaaaaggtaggaacaacccaagtgtacgtcaagagatagaatggataagcaaaatatagtacatctatacaatggactattattcagggcataacaaggaatggaattctggtatatgctataacatggttgaatcctgaaaacattatgctaagtaaaataagccagacataagagaataagtattttataattccacttatatgaggtatctagaataggcaaataaagatagaaactacaatagaggttatgaggtactaagagaaggggaaagaaggagttatttagtgaatgcggagtttctatttgggatgataaagtttgaaaaccagtagtgatggacgcacaacactgtgaatgtacttactggcaccgaattgttcacttaacaaatggttaacacgataaatgttgtatcttattttaccacaagttcaaaatatatattttcactaaagcccaggtaaagaaagtcctagatcaaatt

SEQ ID NO: 162594 - DNA, 136 bp, Homo sapiens
gcttattggaggagtaagaggcaacacatgcaaagcagttaaccaggagcctgggtagggacctggctgtgagttcagagcctgggatttgtgggatggccagtgtatgcacttccagtgactgctggcattacca

SEQ ID NO: 162595 - DNA, 241 bp, Homo sapiens
gtaacatgggaaagctacagagtatggctgaatattaaacctgcctaaccttaccagcactctggtcatggtacatttgctgggcccagtcctgaccacagtgaactgtgcaggcttcataacatgcatggtggtctggaagccatgtgataagaagaagaaaaccacccagcaatgacatggtcacatgggctctcctggagtttgctaagcacctgggtgacctgggaaagaactttgt

SEQ ID NO: 162596 - DNA, 353 bp, Homo sapiens
tgcaacgtgcggccccaccatgttcacacctcactacagacaggaagcacatgttattcagataatcgctacccattttcctttcatcctcgtttttccagcgagcaaaacatcttgtacagtcagtttcttttttcatttcaaaagtacactttgaataggctcaggacggcctgatttaagcaagcagaaggaaaaatccttacaaaatctgtgtgggccaatcagcaatgtgacagaacgttcggcagatggcgctgtttccacacgagcgtaacggcggccacaagcgttctgccgccagggggcgccgcgttccgccggggaagcgtggctcccgggcgcgcggccgc

SEQ ID NO: 162597 - DNA, 307 bp, Homo sapiens
  misc_feature (228)..(228): n is a, c, g, or t
aggaagtgctgttacagaagctaggactaggaggcatgatcagtagtgttagatattttgaggaagtcaagctgtagactcaaacaacaaaatttttttttaactgttggggtaacagctcacaaataatttggtggatgtccccaaaacagtgaattaaaggggagaggtgagagttttgttttaatttataatgggcaatacttagaaaagaaaataattattgantttggagtggcttcaaggacaatacatttaaatatttgtcccagaaattgaccaaactttaaacaaaaaaccagaagtc

SEQ ID NO: 162598 - DNA, 414 bp, Homo sapiens
ttattaaacgcagttgaaaaaaatgaaacattaagaagattttaagacaaacatctgggtaaattagagatcatcttctctagggcttgtttttttagtttaattctaaacttcttgtatttacttaaaatgttattttataaatttgcccttcttttatttgatccccagtcacataatatatttatgcctgatatcctcgctaatttcacattagtggattttgctgttactatttgaaccctagctgctgccttcctcctacttctgtgttagctattactgctcctcctcctgactgctgtcatttgttgagcatctgttgcactaagtgctttctatattcagtaatcttttttaacaaccctcaaccctgaaagacagttaatctgttaggtgcactgttactttact

SEQ ID NO: 162599 - DNA, 270 bp, Homo sapiens
tctctctcccacagtcttcacctcctcttcgtcctcttcgagccgtcagacctggcccatcctcaaggagcagggctcatccagcttcagccagggccagtgctcctagaactgagctgcctctaccacagcctcctgcccaccagctggcctcacctcctgaaggcctgggtcaggaccctgctctcccagcgcagttcccagctgtctccctgctcctctactggtgatgggctaataaagctgactttctggttgatgcaaacctgt

SEQ ID NO: 162600 - DNA, 187 bp, Homo sapiens
tccagaaaatgctctcaaaacgagttatactttcaactagcatggcatgttgggacacaaaggggagaagagtagctctgagaatacactgagaagatttaaatataatcaggactttacagacccttgctgctgggagaaaggcttcctgtaaatctcagggaaaaaacatctgtgcaacacgctt

SEQ ID NO: 162601 - DNA, 156 bp, Homo sapiens
tgtgatctcaggatcttcggaatacacgcgctcattgatccataacttgacacgaacagtgacctagggataacagcgcaatcctattctagagtccatatcaacaatagggtttacaatctcgatgttggatcaggacatcctaatggtgtcacc

SEQ ID NO: 162602 - DNA, 226 bp, Homo sapiens
gctctggagaaaagaaaggggttgggaaggtgggtgcacgtgtgtgcacatgtgttttgaatagagtggtctaggcaggcctcacggaaaagctggtgcaggcagatggttgaaggtggtggagagggagctgtgtaggtatttgagggaagggtgctctggatgatgggagctctgtgtgtggagaccctggggagggagctgtgtaggtatttgagggatgatg

SEQ ID NO: 162603 - DNA, 350 bp, Homo sapiens
ctgtttctaccactccagaattgtgctggcctgctccttgaaagaggaagcacaaacctccactcctcctggcttccctgtaatcctgcccgagttgtctgtcctcctgtagcccacacccttctgtccctcaggcccctgcttagaggtggggtgtgggagggcacccactgtcactttatcctgtcacattctagccgcccatccgcaggtcctgtctcctctgagggcttcttcattgtcgtcacttaggatctgaactctgtccttggccttccaggcctggactcttgatatttagagctaagctttggcatttcaaataaaaaataaaaaaagaaagaaaaccc

SEQ ID NO: 162604 - DNA, 267 bp, Homo sapiens
taaaaaaaatcagagaaagaaaatcttttctttaaaatagagaccctctgggaatgttttctttggcctcaggaagcttctaccacaattcccgcccgtaacccttcctcccctcaccagtgcacacacatacgctctcttggaagcctctctcctggatatttacactgagttactgttccacactggaaatacacctctctggacttgatttgctcactctcatcttatccttttggttttcagcgctatgattaaccttgaatg

SEQ ID NO: 162605 - DNA, 473 bp, Homo sapiens
acagagtgcaaatacagaaggagcaccctatagggactttgaaggcagtgcttataaatgaaaaggcacaggcagaagaaaacaagagtttttatgggaagacagtggataagtggaactgagtttctctaacgtgaaagatggggtgataatcctaatgataaataaaaagaaaattctgaatttatgagaggttttctttatgaagaatgaatgaggacagattcaaagatatgactatcataatgttagactgtttgacctgcattctgatatagtttcttgatagacagaaaaatgttgtagttataattcagcacacagagatctacacaaactattatgggtatattgtggaaaatagggtatttagttcttccaggaaaaccttgacagaaaaactgatatttgaactgtcctggagatgaatatgagttttccagaacccatagactaatttaatggacaaacaa

SEQ ID NO: 162606 - DNA, 553 bp, Homo sapiens
ttatcatgaggtgttagggttcgtctgtgacctttaaagagctacagtcgggcaggcatgacacaggagctgaaggaaactcctggggtcacctccatctgaaagtctgttttggtctctgttgtgccctttcctggagaacagaagagtcttctgtctatgtcacaatcacaactaagcccaaattctcccggtgtctcctttgtcctctgtgtcttgagaacatcatgtacaaagctgctttgctgtgattgaaggaaatctcaatgtacttacattaacagctaggtaatttataggtgtacaatgtaactattaaagctcagattgacttgaacttgcatgcctattttttggattcacttgtacttccaatctgttttttctttacagcctgacccagttgattttgaattcaatccttagagaaatgtattatttgccttctttagatatactgtttttgaagttagaactgttctgcagcaccccaggtaacatggttttcttttcctctccacagccccctacccccgcttctctggcccctaag

SEQ ID NO: 162607 - DNA, 218 bp, Homo sapiens
cttttttttttcttttgagacagagtctcgatctatcacccaggctggaacgctgtctaaaaagaaaagcagggaatttgacacaaagaaaataaactagaaatagatctttgaggccaatggattttagaaaagaaaaatatcagctcttccttttctttaacctgttccttgaggacaatgccatagaatgttgtgagcatctgcaagcataaccg

SEQ ID NO: 162608 - DNA, 504 bp, Homo sapiens
tccttggaagaaaaagtgtcaaacttggtactgtgtgaaggtactgcacagacctcccaactggttcttaagagagccaaactgaggctaagttctgagaactaagtaagaactgacagcccttgtaggttagaaagtagtggggcaacatgttacaagtagtgcttctggaaggttagatgcggttagaataaaatcattgccattttggggagctgggaaaatggatgtcttcagtctagtctaaaaagggatgacttgaataagcttatataagaaagaaaagaaaaacctttttactcactggaccatttcataatcttgacttttttcaaacataaatctgtgtcatttttcttatttaaaacagctgagtagtttactctcctacttagagctgtgattcttatcatgggctcttgtgatctaaccccagcctgcctccctggcctctgtccttgcttaataacctctagccatatgaacctggaataccagtctaat

SEQ ID NO: 162609 - DNA, 256 bp, Homo sapiens
ccagcaaccctgcctcccaccttaaccgatctccaatcctacattttagtgtctagaagggcttccaggtacaattcaaattgtatcgcagacaatgttcaataatagtaaaagaatcacagtcttgttttaagaagcaaaacaaaacagtgcagagctcatgatccagccatgagtcgtggttaatgttaactacttaaccaaggtctggtaaccattagccaattattaggttgaatttctgtgcccatttcaa

SEQ ID NO: 162610 - DNA, 399 bp, Homo sapiens
tcaaaaaaaaaaaaaaaaaatctcataggcttatatgaggaatggcaaatattggccattatttattatcaatttaaaaatatttctaaggcctttggtggtggcagcctcttttcttgattctctcaacagaatagtgtacatttgtggtagattcatgcttattttcttatatttccttaccaaaacttgaagtcaggatattaccctttcttattaaaacctcttttactaagactggcaattgaaatcccattggatgccatattgggcactgtggaccaatctccacctcctgtatgccctctctttctgatgtggccacggtgaggtcactgtctcctgacctgcccttaccccactcatgtctgccttagtggatcttcttcctctcctcat

SEQ ID NO: 162611 - DNA, 412 bp, Homo sapiens
tctcactctgagttcatatgagatctggttatttaaaagtatgtggcatccccccctcaattctctctgtctctctcttgcacttgctttcaccagttgatgtgcctgtttttgcttcatcttctgtcatgagtaaaagctctctgtggtctctctagaagccaatgctggcactatgtttcctgtgcagtctgcagagccatgagccatttaacctttttataaattacctaccctcaggtatttatttatagcattcaagaacagcatactacagaaaattgttaacagaagtggggcattgctataaagatacccgaaaatgtggaagtgattttggaactgcatcctgagttcatatgagatctggttatttaaaagtatgtggcatcccccaactcaggatgcttct

SEQ ID NO: 162612 - DNA, 383 bp, Homo sapiens
cagtgacactgggttaggcaaacacttcttagacatgacaacaaaaacatggttcgtaaaataataaaataaaaaccaagattctgataaatctgatctcatcagaattaaaagcactggtcagagagtgaacaaataagcgaaagtctgggaggaaatacttgcaaaccacatatctgataaaggacatgaatccaaagtacacaagtaacttctgaaacataatgagaagaaaaaatctaattttaaatgagcaaaagatttgaacagatatataaccaaagaagatataccgatgggaagaatgcacatgaaaagatgttctacatatttaatcacaaggaaaatggaaactgaaacctttagaagatactactatctac

SEQ ID NO: 162613 - DNA, 343 bp, Homo sapiens
agacaggccgctgggagagacaggccactgggagggccctaggagggcagcttctcaggcctggtggcagggggctggattccccatacatgtttaaatagctttcactgcccgtgtgtcagtcaggtgcagggaccttgccacctcttcctagtggtctttgtaagaatgtagaagcatttctttgataagttgataagttttaggtgacaggcgaagccttcttaaagaattgtctcaatgttttgaaaacctcttatttaggatcatgatatgagacaccttttccttgaacaaaaacttttaaaagtctgtttagagtgaagaagctgttgtacattca

SEQ ID NO: 162614 - DNA, 520 bp, Homo sapiens
ttaggagaccattgttttagaaaactttgatttgtacatgttagttttcatgaaattgcaacacagagataggtcctaaaagtggaatgtatttaaaacttgttgaattagacacacacacacagacacacacaaagaatcagcagagaaaacaaaatacaagtcctgttctgtagttcttgccctttgaatatatttgggaagagttgcttcctatttcaggaccctgccaaaaaagaagaaagcttgcctttggtggggctatgccccttggagtaaatacagctctgtgttccctagcagctgccggaggatttggctgatgaagtacctgctcagcttagctaatcagattaaaggaagacatgtatgtcttttgtttaagcacctagtcccttatgtatcagtaaacaggtttttaaaaatcttttatgtcatttataggataaaacatatgcttgtctgaaaatatcaccttttgtggatttatctgatcaccaaataataaatattaagaaga

SEQ ID NO: 162615 - DNA, 403 bp, Homo sapiens
gttgggtgatggtttaagttttcatatttcataattaataatatttttaaaaaagcatttttatgtttacactgttatatctcaggtcttatcaacctcagcttaaaaagttgaagtatcggctgggcgtggtggctcacgtttttaatcccagcactttgggaggccgaggtgggtgaatcaccagaggtcaggagttccagaccagcctggccaacatggcaaaaccccatctctactaaaaatatgaaaatcagctgggcctggtggtgggcgcctgtaattccagctactcaggaggctgaggcaggtgaatcacttgaacctgggagcctgaggttgcagtgagccaagatcacgccattgcactccagcctaggcaacgagagcaaaactccatctc

SEQ ID NO: 162616 - DNA, 397 bp, Homo sapiens
tcatgatccacccgcttcggcctcccagagtgctgggattacaggcgtgagctgctgcgcctggccattaatttttgtatttttaatagggtttcgtcatgttggccaggctggtcttgaactcccaacctcaggtgatccaaggtcttaaacttctgacctcaggtgatccgcctgccttggcctcccaaagtgcctggattacaggcatgaaccacctcgcctggcccctttgtattaactctaagcccacccttagaggggaatgaacaaagagaaactacaacctatacctcttcccatatccctccgaattaatgacaccctcttcctttctgcatgcatcttttatggccttctatgatgcttgccagttatggatttgtatgtctctgct

SEQ ID NO: 162617 - DNA, 183 bp, Homo sapiens
tagagatggggtttcgccgtgttggccaggctggtcttgaactcctgacctcaagtgatccacccgccttgtcctcccaaagtgctgggattacaggcgtgagccactgcacccaggccagttctttaatttactctctagtgtaggcgctctcttaaaactggattatatatagaagtgttg

SEQ ID NO: 162618 - DNA, 501 bp, Homo sapiens
ttctaggtaagcatatactaaacaccagagacacaaatgagaatcaggaacaggcatggccctggccctcacggtgaccacagtcttgaaggggaaggatgacacgcacagaaacaggaagccgtagctgagctagtgtctaccacagagaggcacctggtgtcatgaaagcagataacagggggttgctgtgactgagtcagtgtggccagacgtccctgaggatgtagtgactccactgtcagatgagaccgtgaccaggtgaagaggcagggagagggaaaatctttccaggcagaaagagcaggatgtgcaaaggccctgcggcaggaaaagagcaaaggaagtgcaagagcctgaaaatggccagagagaacaagtgaacatgtggataatcacagcaccgacctcatacaggactgctcaggatacccaggacagagtcctagatgcttgaagtcatgataagtatccagaatgacacagaattccagccaggca

SEQ ID NO: 162619 - DNA, 179 bp, Homo sapiens
tttctaagaagactggtgggtaggggggtgatggctgaatctttaccatcacctattcttagggcatgagggagggagtgttaaaatatagtaagtatggaagagacaccaactaaatcatgtacctacagatgagatatttaatgcaatgcagggtctctgaaaaccccagaaaagtg

SEQ ID NO: 162620 - DNA, 362 bp, Homo sapiens
tgccggaattacagatgtgagccaccgtgcctggcctgttatttcttttcttccctgtaggttcctgactgcctcacccattatctttttttatctttcttttgacagggtctcactctgtcacctaggctggagtgcagttgtgcaatcacagctcactgcagccttgacctcctggactcaagcaatcctcctgcctcagcctcctgagtagctgagactacaggcatgcactactacacctggcaaattttccttttgtttttctgagacggagtctcagtctgttgcccaggctggagtgcagtgacaccatcttagctcactgcagcctccacctcctgggttcaagcaattctcct

SEQ ID NO: 162621 - DNA, 284 bp, Homo sapiens
ccaaagtatatgtgtctcttatccaagggttctgaagccagattcatcagcttgacattagttagccatccgccaaggcagagagccttgcattgggaagaggcagaaggtggacgccagagacatagaagatgcaacctctgctcaaaaagagctttaggcttatttgaaaataagtacacactttcaacatacaatattaaaaaaagtgaatagtttaaaacctggtttattggttttcaactagccacttttgaagaaacggtatacgtaatggcactcag

SEQ ID NO: 162622 - DNA, 179 bp, Homo sapiens
caagaatgcaaagcgctatacctcattcctagagggcctgatttattaaagccaggatggaggctgggcacggtggctcactcctgtaatcccagcactttgggaggctgaggctggaggattgcttgagctcaggagtttgagaccagcctgagcaacatggcgaaacaccatctctc

SEQ ID NO: 162623 - DNA, 296 bp, Homo sapiens
cctggacggggccgctggctccagggtttcagctggggagggggctgtgcgtgtgcagggagagcctacccatgtaatgggcatcccgggtcttaccagggagacagtcgtggtcctgatggttttccagtgtgcccatgagaagagtgaggctcagagaagtgcagcacgaagtcagggtcacacagctcaagcggtggagattcggactctgtcccctgtcagccacacctcgctgctgctcctgggtcccactttccaaccctggcatgttggggtcttggtgacattttgtg

SEQ ID NO: 162624 - DNA, 223 bp, Homo sapiens
tgctaggattacaggtatgagccagtgtgcccagcctgtggcaaagtgcagctggacaggaaaatggctcaggtttaacttccagcctcaatgaaaactaacatgaactctcatccatgcaccaaattaggaacactcttaccttgactcttagaatgtgtatttttaggaaaaggcccaaaaagtagtttaggacaaagaacccagaatatgggctcctaga

SEQ ID NO: 162625 - DNA, 322 bp, Homo sapiens
gctacaattttacttggccagagggactatgaacaaaaaagggtcatttcatccagcttccattttaaggcaggaggacttcttaaaagatttaactccattcagagtaaccagcaggttatctgatcctcaactcccttaacgtgggggtggaggacctgattccctagtcagaaaaggccttttctgaatatcagtatcactagggaaaggatgagggggagccaggagtggtttaatggatcccgcaaagcctgatgggtaacgacagcatgttaatttgaagaaataaactgctgcaacagcagcctaagaagacaaa

SEQ ID NO: 162626 - DNA, 148 bp, Homo sapiens
ggaacacacagagaggggcagagcacagaaccaatctctattaccaacaactagccagggtaagaactaccaaccacattgttatattgaatcatgcttcatttccatttgttaccgtaaaattcagggaagcaccttcaattctttt

SEQ ID NO: 162627 - DNA, 367 bp, Homo sapiens
caagaggtgttcggtcgatctagaggacccgtcaccgcgtggtttatacttttattacataagtttatatctataagcaataaatataattgttttgcaaatttttaaagtttattatagagatggatcatgctgaatatactgcctcttgcttttttcattatcagtactgttttggagatttatttatgttggcacatgtggctctagttatttcaactgctatatagtattcctttgtataaatataccacattatctctccattctcctgtggtggacatttagttggtttccaattttttgttcaaacaaggttgcaatgatcattcttctacatgtctcttgtacacatgtagggatattt

SEQ ID NO: 162628 - DNA, 279 bp, Homo sapiens
gctctacatacatcttaaagaatgggttcttaaactcaaatttacagcccctctttcccagaagcccctaaaaacatacccttgaaaaataccaaatgttgtattcaggacagtgtctaggccataatcagatatttagaaagtccctaagtgaagaggcattaagaaacaacatgaggtatagttctattagatgacatcctggtggctttattcatttagtgctatactaaggatttctcatgtttttacattgtgttcataatatgaattacaaca

SEQ ID NO: 162629 - DNA, 226 bp, Homo sapiens
gaaatgaatattttatagtttctaaggtaattttacatgtaatgctcatgatttcatgagttaggacaaaatctttgatctttttgaataagaaaagtgaggccccaggggttggcatgggggacaagtgacttgtctcaaatttcacagtttggtagagggcaggagctcaactccagatctgttctcttgccaaaaaaggaatacaatcttatggaaagacatc

SEQ ID NO: 162630 - DNA, 346 bp, Homo sapiens
acccattcgcgaatgcactagaaataaattttatcttcatgaaatactggcaggtatccctaaaatgatttgcagtgcaggatggctccatcgggccgggcgcgcctggctggatcctctaatttataattcctccagatagagctgcttatagtttaccaattcactgttattaaagtctgcttgtgaagttttcattttggagagtttggcttccagttctttaattctgagtttcatctgactttttagtgaagtaatattgtcttctcttaactgctctaactcttcttgagacgctgctcatgtctaaaatgagcatttaaaagagacattttaatagtaa

SEQ ID NO: 162631 - DNA, 561 bp, Homo sapiens
cacccacctggcacctacagccctccttccaacatcctgggcagggaggcgctctcagggggctctcgatgccccacactgaccatggccccaggatggccacttccttcagccagctgtggctccctcgggaacaggagtggaggagctggaggcgggggtcctgcccacctgcacgttgctccctaaccactcccgcagcagacgcccaaggcccacagggacccccagccccctgcattgctgcagcaaccacaggtccttccagggccttcgccccggcccagaaagagggggcatccgccatgcaccccaggggctctgggagctgcagctgtgggcagactcccaggccctggcaggaaacccgctggctcagcacgtggttaaatcagctccccgggcactgcctcgtgacttcgcagcgcctgctcacggtccctggagacggaagctccgcagggctcatttgttctccattagtcacctgtcccacccagaccacaggtgctggacagagacccagccggtgcaccaagcagggctggccaaagtgcccag

SEQ ID NO: 162632 - DNA, 195 bp, Homo sapiens
tgatcagctcgtccattactacagggtatctgggctccatggccagaaatcttcccagtgccactggttccgctgcagctgccacccctgccccttcacagagccctttcttacccagagccagatgagagaggtgatatggcagaggcttttctcccagcttccagcaacatcctctgaacacagcacaggcgc

SEQ ID NO: 162633 - DNA, 330 bp, Homo sapiens
tgaggactttggctggactgacaggccgagcttgttctgtcacattaccacgaatagtactgtaatggcacgctctcacttggatctgggccccgtctcagtggggaggggaggaaactgcctttgcccagatcaccataaaggagacagacagaggagttcatgagtgaaaggaggacttcctttatctcatggaaaattcaaacatactcaaaaacaaatagtctaatgaaaccccaggcatggcagttatcactgattaccagtcttgtttcagcagccctcccccggcctccgggagcaaatgcagagaatattttagagtgtacc

SEQ ID NO: 162634 - DNA, 597 bp, Homo sapiens
taacttactgagttaggtgctatttttttttcaccttaacacagagattggaaagtgtcattaaacaaatcagtccatccctctctagtttaaagttgtgcttcctcctagaacctcacagttctgccattttaacaagttaggtccaaattgctggaagaaaatcctttacgcttttctgtaaaaagctactctcttcaaatcagctcaaaattcagaaggtagaaggctttgttcttgcaggatctccaggtattccatttatcttagcacaatgctgtatacaataattatcattgttattatccttaataatactatagtttatatagcatttgaattttacaatttgcaagcaaagttatcacaagttagctatgaatggaagtttaacatacgtttccattatttcactaactatactgtcccttgaacataaaagaaattattcttctctagtttcatctcagtagcattgtgttatgccaatagcagtgaggaataatccccaaacaccattctcttgccttgttaaacatacattttttctttattttcttattctctgtttgaatatggagaaaaatcacctatcac

SEQ ID NO: 162635 - DNA, 132 bp, Homo sapiens
agaatgacaatgaggccccgccaggcgggtctcatccaggcaggcctaacaagattagattttcataaatttcagacagcgccaattcctaattcctcggtgtgcggccaggaggccagacagggccccatg

SEQ ID NO: 162636 - DNA, 387 bp, Homo sapiens
ctccactcccctgtaggtactcatccaaggcgtttaatatatgctcttgaacaggtacatgtctttataaaacatgtaaaattgctttctgtgtgtgtgttattgatttatagaaacgatattgcacaaaggagcttgtcctgatctttccattttcacctatgttctcaatatctatccatgttggttgtacatctagcttattatttctaacagctgcacagttaactccatcaagataggctaagttatgcagcggtaatagcacaaaaatcttagcagcttaaaattatgcaggtttactgcttggctccactacatatccatcccgttaataagagttttgctttggagacgtaggctgatggagcctccaccattcaacac

SEQ ID NO: 162637 - DNA, 531 bp, Homo sapiens
aatagaagtacgtcttcacaggattgttatgaagattaaattaattaatcattgtaaagtggttatataagtacttgttaaaaaaaaaaagaataattgattaaagtaaggtcctaaggaaaaaagaggaaatggggtcaagagcacaggcaactcagccttaaacaggaagaacaataccctgcccaccaagtcttaagatagcctgagtacaaatatggctaattttaaaggtagagatagaaagttgagacaaggtgacattctcagaagatggatttttttttttttttttttttttttttttttaaacagagttttcgcttttgttgcccaggctggagtgcaatggtgtgatcttggctcaccacaacctctgcctcccgggttcaagcaattttcctgcctcagcctcccaagtagctgggattacaggaatgcgccaccacacccggctaattttgtatttttagtagagatagggtttctccatgttggtcaggctggtcgccaactccagacctcaggtga

SEQ ID NO: 162638 - DNA, 281 bp, Homo sapiens
atgcttaggtagagaagtggaaggatcttattccctaaagacaccgtcctcaattttcatactgtagagacaatgagctctaaaagatgtgaaagtcaagtgttctcagagaaaggggtgcttatttctacatacaaagggcttaggtaaagttatctgtggaagatagcatttgagcttttgaagaaaaagaaggatttagacatgtaaaacaaagggggaggaggttttgctactagcaatgaggtggacaaaatatttgaaaatctcttttaccaata

SEQ ID NO: 162639 - DNA, 369 bp, Homo sapiens
atttaccaacttcatcatgttggtactgggcatctgggcaactagagtctctgaaatagagggggaagggggtcgggggcagggacgagaaaaatatttgaagaaataatgggcaaaaaattctcaaacacagtaaaagctataaactcacagatccaagaagcgcaaatcacacaataagaaacatgaagagaattacactcagacacattataaagaaattgttcaaagccagtgataaagagaaaactgtaaaagcaaccagaggggggaaaaagacgttatgtacatggcacagagacaaagatgacatcagatttctcactggaaacactgcaagcataaaagataatggaacaaaatatttaa

SEQ ID NO: 162640 - DNA, 508 bp, Homo sapiens
gtggctgaatttttaaagtacctctagagttatgattggacaatctgtttctgttttactataattactatttaatttgtactctactaatccagaattttgcataaacatccctcctatgattcctgcttaatagaatattgaaaatcatttcctcattgaaaatgttttgagctattaagaataaaatactctgttttcagagcagtttttacattttccaaactaagggagctgaaacagtaaagattcttttagcttgcctttcgttttcaggactagcaggttcctgtaatataaaggtctttggggtttttagtgcaagcctattgagaactgtaatttatttcacctcatttcacttataaatgatactattttacatgttccatgtaaaaggaaaaaataatatttccttaaaaattattctatacattcctataatttagccttgtgtgtgatgatgacctttttctataaaagaaaaatgtatgtaaatgctggtata

SEQ ID NO: 162641 - DNA, 482 bp, Homo sapiens
ctgtagcttaaacaatttcatgactcaacaactaagggttagggatacaaagatgaataaaatttgatttctgccctcaaagcactgagaagccaatggaagattttagagtaactgggtgttgcaattacggaagtatgaaaagagtaagtgctcccacattccttgctatttcctggaacatagttctgccttagggctctcgtattttttttctggggcacttttccccccattatctgtttgggtcactttgtcacctccttcaggtctttgttcaaatatcctcagtgaggctgtctctggccaccctgtttaaaattgcaaagtctcttgtccaaccccactgcctctatctcagtttcacacctcctgctccccatcctgcttcatttttttcatttttttccatggtacttaccacaatcaaaaatatattttctttttttgtttgttttgttttttctgagacagagtcttgc

SEQ ID NO: 162642 - DNA, 497 bp, Homo sapiens
cgtgacaagaaaactgctagaaagtagagcaaaaagaggccgggcgtggggctcatgctgtaatcccaacactttgggaggctgaggcgggtggatcacgaggtcaggagatcgagaccatcctggctaacacggtgaaaccccgtctccactaaaaatacaaaaattagccaggcgtggtggcgggtgcctgtagtcccagctacttgggaggctgaggcaggagaatggcatgaacccaggaggcagaggttgccgtgagctgagatggcgccattacactccagcctgagcaacagagtgagactccatctcaaaaacaaacaaacaaacaaaaactcctagtggtttttatctgtaacgttcttatatccagggcctctatgggctggtgttcaggttctatactgcataaggattccatatctaagggaccactttccacattgtagacacagcctagactcctattaataatgggttacaaatgtatcttt

SEQ ID NO: 162643 - DNA, 123 bp, Homo sapiens
atgacatacatatatatataaaataatattgtctagttgtaaaaaaacagtttagtaaatatttatgtagttactacaaagagacatccaaggtatgaaaactgaagttgtagacagcatgat

SEQ ID NO: 162644 - DNA, 363 bp, Homo sapiens
ctcattctgttgcccaggatggagtatagtgttgtgatcccagctcactgcagccttgaactcctgaaatcaaatcatcctcctgcctcccaggtagctaggactaccgacacacgccaccacacctagctaattattttttgtagaggggtggtctcgctatgtttctcaggctggtctcgaactcttggcctacagtgatcctcccacctcagcctccaaaagtactgggattacaagagagagccatcgtgcctagctgaccactgaggggttttgaagaatggaagtggcattgctgtactaaatgactagagaccccagtcatgtggcccagaactgaggttaactgggcttagaaag

SEQ ID NO: 162645 - DNA, 348 bp, Homo sapiens
aagtaacagcaatacaggcatgttatttagagatatgtaagtaagccaggtgaggtgattcaagcctgtaatcccagctactccagaggctgaggcgggaagaaaccaaccttagcaacataaagagaccctgtcccaacaaaacaaaacaaagggggcggggagagaggagtcacaggcagttcacccacacctggaaaatcgatgacttcatggagaatgaatgactcggggggattcagatcatgaagtcatgagaagaaggcctttcttcccagggatgatgtttctcagtatcaataatcagttgtgggtttttttcttctatttcttccagcagcttattga

SEQ ID NO: 162646 - DNA, 195 bp, Homo sapiens
aagtaacagcaatacaggcatgttatttagagatatgtaagtaagccaggtgaggtgattcaagcctgtaatcccagctactccagaggctgaggcgggaagaaaccaaccttagcaacataaagagaccctgtcccaacaaaacaaaacaaagggggcggggagagaggaggggtaggtaaattactaaatgta

SEQ ID NO: 162647 - DNA, 149 bp, Homo sapiens
aacgatacggcagcgccgcggagcctcggttggcctcggatagccggtcccccgcctgtccccgccggcgggccgccccccccctccgcgcgccccgcgcgcgcgggagggcgcgtgccccgccgcgcgccgggaccggggtccggtgc

SEQ ID NO: 162648 - DNA, 418 bp, Homo sapiens
tggatcagggagcataaggacttctaaggcacattacatacactataaaaagggttcttaatgctgtggaagagaacttcagagagaacattatgagggtctggaaggattacagttgaagatgatgccatcatttttatagaaaaagtcatgaaagccatcaagtctgaaataataaattcctgttggagaaaactctccaggtgatatgcatgatttcacaggatttatgacaaagccaatcatgaaaaagatggtagatatggcaaaaaaggttggaggtgaaggatttcaagatacgaattttggagaaattaaagagtcagtagacaccatgatagaggaattaacagaagatgactgggatggataagagtgctttcaaaccagtgccacaagatgaagaagacaacacaga

SEQ ID NO: 162649 - DNA, 213 bp, Homo sapiens
ctaaaatacacatgaggattttattaagccacactgatttcaaaagcataccagttccattctttacttaaaaaccatcaaatccactatgaaaaagctgagattagtgcattgtcctaaaacaacccatatttacttctgcaaaaaactggttaaatgatgacatattagattgctcatgtcatacatatggggatcctcttagagtcggac

SEQ ID NO: 162650 - DNA, 152 bp, Homo sapiens
ctcctctgtttacctcagtgtgtgggacaaatactatcattttctacttgtaatgatatgacagctatcaaaacattagtaagaaaacaagctccaggctcagaaagaccagaaagattctctccactcactaaccaggagaatctctctac

SEQ ID NO: 162651 - DNA, 404 bp, Homo sapiens
gtgtgtggagctgtgtgtgtgtgtggagctgtgtgtgtgtgtgtgtgtgagctgtgtgtgtgtgtggagctgtgtgtgtgagctacgtggaatcatgtgagggaaccgtgcagagctctctgtgcagctacgggaaagtatgtgagaaaccgtatgaggaattgcgtggggaactgtgggaggatttgtgagaaactgaatgtgactgtgtggagaaggcggggaagcaggcgggaagtgtgtggggaatcgcttggggaaagtgtgcgctcgtgtggggaaccacatgggggctctgtggagctggagctccgcgtactctgaggacctgtggaaatgggagcggaagtgtgtggaggggtgtggggccgcgtgggaatcgtgtgagggacgccgaggagcca

SEQ ID NO: 162652 - DNA, 267 bp, Homo sapiens
agagtgaaccctcatgtagactacgggctttagttaataatggtgtatcaatattggcttctcaactgtgtgggacatttgctacaattgacaagccaattgaaaaatagggaaaacagggagagatataagggggtatgtggcaagtcggtacttttcactcatttttccccataaactcctcaaaatataaagtctactaattaaaaagaggctcatttctacaagtttttattatggaagaagcccaatgttacatgacagtag

SEQ ID NO: 162653 - DNA, 515 bp, Homo sapiens
ttgggaggacaaggcagggggatcacgaggtcaggagatcgagaccatcctggctaacacggtgaaatcccgtctctactaaacatacaaaaaattagctgggcatggtggcacacgcctgtagtcccagctactcaagaggccgaggcaggagaatcccttgaacctgggaggcggaggctgcagtgagcagagatcacaccactgcactccagcctgggcgacagagcgaaactccatctcaggggagcggggaaatacctgaaaattgggctgggcagatattttaggttcctgcatactgtagtggctcacgcctgtaatcccagcaccttgggagacctaggcaggaggatcatttgaggccaggaatttgagaccagcctgagcaaggtagcaaaactgtctccacaaaaatgaaaattaaaaaaataaaagacataaaactaaatacaacatggtctcttacactggatcccaaaatagcaagaggacatttgtggaaaacttgatga

SEQ ID NO: 162654 - DNA, 152 bp, Homo sapiens
agtgctctttggggagtgggtttctgggtaaatgtaagagaaggctttactttttgcttataaattttcacattatttgaaaatttcatcacacatgtattatgttgggcttacttttttgtaaaataaagtatgtgtaatatatcattttt

SEQ ID NO: 162655 - DNA, 438 bp, Homo sapiens
ctggcaagagcttaggacgagatatggagaggagactgacgggagccacaggccagctcttccaaggcaggctaaggatgttgaggtggttctgcggcgctggggagcattgcaggcttgtgtgggagtaggaacaggtagaggagggggcctgcatccgcagtgccgggagcggcgcaggtatcggggcagggatgggggatggctctcgttgccggcatattattgtgcggtccttcggctaaggtgttagcagagctggtgggggccaggttggtcacactagtctcagagaaaggcctgaggggctggaaagcaagtgcagaggcgggctattgggacactgttgagtgtcacaaggacatgggttcgagttctgcctccaccctgaccagcttcaggtttctaagaagttgatctttgttaggtttaaaaaaa

SEQ ID NO: 162656 - DNA, 372 bp, Homo sapiens
tctttgctctctcgggtttactccaccttgagtccaggccaatcagagcagacgttgcttctctgtctcccagggccatgagaggacagacaacaggacgctgacctcctgagaattaagcccatgaaccccagccagtgacactcattccccagtggtcaaccttccgcagagttcagaaatacttacccgagggcaacattttatgcaaccattgttggtccaagtgggcagcagcagatcagggcctggaagcccagcatccagtcacctattctctgtgcaagagccctcatctagaaacctggcactggaaagactgtgacctttgcttggggctttcatagtcttacagcatacacaccagaagga

SEQ ID NO: 162657 - DNA, 632 bp, Homo sapiens
tctactggcatgttcccaggtaacaggtaacttctatttgcaactgggagttcatacaaaccaacagaaaaacttgctttttattttcccaaattaatccttttaaaagcaaactgaatagaagaaaaatgagtaagcgctgttattgcccagactatgctgcaaatcattttcaactctgttaaatggatttaggaaggaaaagaaagatcatcacttcagactccagtaagataaaaacagaaggcggctagaaagaacttaatggaaagggtactataaactagaagtctatttgcaaaactagactgttggctggttctcctaaaaccaggctgttttcataatgagttagtttaacattttgtctttatgtgtaagcacccctttccttggtgcagtcacagccaaactgcaaacagaaatcgagaagttgtgagctccagatttgagagccacagagagtttgtgagatcaaaaaatccactctcagtaaataaatctgagcacctaaatcacacagtcagctaaaggcaagggaaccagagggaaaaactccaaaggagtgatctcttatacaatggcttccagaccccactcaggcaaagaatcgaccggggatcctcagagtc

SEQ ID NO: 162658 - DNA, 172 bp, Homo sapiens
gtggggggtgaggactggcagatcccacaaggccttgtagaaatcttatacagtaccttgcccgtagtaggtattcaataaatgtttgcccagtcatcttttgccttctaggattatcatcaaatagcatttatctgtgtatttattggagttacgtgtgcttttattccag

SEQ ID NO: 162659 - DNA, 265 bp, Homo sapiens
gcacattcaagcaatgctggagggaatgtaaactgacacaatttgacatatctaagataatacacaaatgtatttttgtgcctttattatcatagatatgatagtatctgtgatattatcatagacatcatgataatgtcataatattatcaaacctggcaattcctctcaagaaaattatcctaaaaatatacttaaacaaatacaaagagacatgtccacaagaaacattctatgtggtattttttataccacaaacaaaact

SEQ ID NO: 162660 - DNA, 559 bp, Homo sapiens
cccagggtttccatgcttccatgagcagatgatgactaacacagtcggggcagtcagatgcagacagacagtggagcccacttactgctcagtgcttgttaggagacaaagatatgaaaattattaggacaaggaatacggctttatgaactggaagtttaaagacctggccatatatgctgaaacaggtaaagctacctagaaaaatttccttctctcactctcttctgagtcttctctaactgcaaattatgccacggttctctgtctccaggcttgaccccacagaggcatcactggtttttaagcagcaagtgtcaaatattttgcagaagagaatttagtgaggcttttatgggcaatgccataaggtccagagactttctctgactatattcattttaggtgactcattttcctttcctgatttaaagtgagtcctacagaattaatgggtaagaagtagggggatgtgggaagtgaaaagggataagcaggtaagtcattgttaagtcaccagccaattgtcatgtttcaaatattaacctatggatactag

SEQ ID NO: 162661 - DNA, 159 bp, Homo sapiens
tgctacttacggagctttctcggaggagcccaggacaagctttgttctcctgccactccccttggcctcctcttccttccctacaccgctgtccctggccctcccagcaggacgtctcagggccacatggattgccagcccggccagcgtatcctctta

SEQ ID NO: 162662 - DNA, 320 bp, Homo sapiens
actacatacttccgaattaatatattaatacattgctgtatttttgagacggagtctcattctgcacccagggatcatgcgtccctgtcgtttcgagcaccttgcctccctcttgacatcggagcctggaaaatttctgtgccatggctcagcgtcatctgtcttgttaatgtcagagccagaacacgaaccagctctggcttcccgtgggaccgggctctcgcttgtgtgaccacgttaatagattccttggaagaatgatctaaggaatttggaccaaatcttccaacaagaaataaaaacagctgccatctgttgag

SEQ ID NO: 162663 - DNA, 383 bp, Homo sapiens
aaaaagtggcctttctattaaacgtgccctttgaccctcatgcccttggaggtcggtgccagcctggagatgggataagattgtggttttccttctgcctttttaacatctgttgttacagtccatttgttgaaaatttaaagaaactgttttattccactttccctcagcatttatgtgtgtggtttcagtagctctgtggctatatgtacgaacacgtgttatttttccaattggacatgtgataattttccaactggaccttgccttctattgatgtatttatttagcatcttccttactccctccttgaaaaagaatcactcaaaaacaaataaaaacagccgtaggggcctaatacagtgctagacatacaagaggta

SEQ ID NO: 162664 - DNA, 524 bp, Homo sapiens
tgctgaggttgagaagtcctgatgcagaggctaagcagggatttctttcatcaatgactttgtaggatccatagtagattctcaatgaatattagctaagtgaatgaatgaatgaatgacatttacaagagaagcatttgaataacccagaaatcctgctcctgagttgtagcttgtttacataacccaaagaagagcaaagggaaacagtttctattagattggtgtcctgtcgctacccaatgtagtgagataggcaggtaaggagagggtattttggcaaagggaaatactgtaattttctgtaattactgtgcatggaaatgacatgtgatgtgtgtgatagtttgtgcagatacatggagtggcccactggcattaggtatgaattatgtgactattgtcagacatctgggtatgtattgttttctccataagacagaggaatccattctaagtatttagcacaaaagcaacgcatcttggcacttttctttgtctaatgaagcatccaagaggttcag

SEQ ID NO: 162665 - DNA, 269 bp, Homo sapiens
tagttttaactaatttagatcatagacatttgcattaatgatatgaaacccataccaattcactgttgggcatgaatgttatagtatctaccaagagtaaactgctcctgtgacttacattttttttttcttttttgagacggagtttcgctctgttgcccagactggagtgcagtggctcgaaagatgggtcagatggacataagatcattagacacaagactaccagcagcaactgaaactaaaaatttttatttttgttttttttt

SEQ ID NO: 162666 - DNA, 307 bp, Homo sapiens
ttagacatgtggagtaatttgaaagatgggagggagggagttgtctggctgctctaagtgaattggcaggaaggtttgtgtgaaaggtcccattcaggctgacaggcacaaggggcagaccttttgagatataatgtgcttctgattgctggctgacaaggtattttcttttctgtcttctaaaatatgcaagatgtacccatgttgtgatttacaactgggttgggattcagccacctgtgaacctttgcaagctccgtagtgagctgccaatgagaggaaagatgttctgatagacgcttccaca

SEQ ID NO: 162667 - DNA, 1192 bp, Homo sapiens
tcagtaactattagctgttactgtcattatctgtgttaacctgccagacaaccttatatgggttgcttttgctttcacacctgtatgatagtcatggaaactgaagcccagagaggttaagaaatttgctaggatcacaccactaataagcaacagagccaggattcaaacccaggtgtggctccagagcccatcctcttcccactgctaccctaactcaaactgccacatgctcgtgtcctttcagtggggagagtggttcattagagggggttgctacttttattttggacaggccagttctccattctgcaggactatcccatgtattacaaacagttggcaaccttgccctgctcaccaaatgggagttgcataccagtattccccagcttgtgactacagagatgtcccagtatgtttctttctgcacactcttggggctctacctctttttcaaaatattctcccagaaggaaggaactcaccttgaacttagctttctttgaagggtaggaaacctggaagacgtacaaaggagggagaggtcaggtgctagaaagtttgtgcacattgagggcatgggcagaatctgctcccaaaagcattgaaagccaatatgaggccaggtggtggctcatgcctgtaatcccagcactttgggaggccaaggcaggcggatcacaaggtcaggagattgagaccatcctggccaacatggtgaaaccccgtctctactaaaaatacaaaaaaattagctgggcatggtggtgcatgcctgtagtcccagctactcaggaggctgaggtaggagaatcattgaacctgggaggcggaggttgcagtgagccgagattgcaccactgcattccagcctggcgacagagtgagactccatctcaaaaaaaaaaaaaaagccaatatgaatgtggcttcattcttctaggcacactggcaggacagtgtggtagtcaggagcacagggtcaagaggcaggcagccttgggacaaacacctggtgctgccagctctaatatgtgtaaattactcaagctctgagcatagttcttctacctataaaatggagagactacaggtacctcctcagaggtgtggggagggtctagtgagccccaggctgtaacatccctagagcacagtgccaagcacacagtgagcctagtggctggcc

SEQ ID NO: 162668 - DNA, 161 bp, Homo sapiens
tggttctaggagaaaggctgtcccctgctgcagagctgatccgcacccctgtgcaaggaggctctgggctggcgccagggccccagtcatagctgcactctgcttcctgcaccccaagaacccataggtcagcaggggagacagacactggaacgaaggac

SEQ ID NO: 162669 - DNA, 208 bp, Homo sapiens
gtggaaaccaggaacactagaggtcctaagacacccaggacagtctgcacggccaaagacttctgcattcctcacaacttcctcaagtcctgctgaatattcacgtgggtaaaaaacctgtttataattgtctgagcgtaaaacctcactcaagttattacataggcacaacgtatgtgttacaaagtatgtgttaaacaggaagact

SEQ ID NO: 162670 - DNA, 378 bp, Homo sapiens
gtgggtaggggcttggtcgtcttatctcacccacagaccctgcagggctgcagcagaactctagagagtgccttttacatggtgccatgtggcccaggtcacagcaagggattacttctatgatgactaggaggtgtgggagggcacgggcatagcttgctcagtaggtacctccaggcttccctcgtctctctccagatacctgcatccattgcatggctggaggctggaggacaaggcaaggaggaaagggggaggggcattacagaccttggctgtgtcatccaaaggggacctaaagccaccccattccaagacaccgttttttgttttttttgtttatttgttttgttttctttagacagagtctcgctctgt

SEQ ID NO: 162671 - DNA, 525 bp, Homo sapiens
attgaatataaaataatcctaagcaaatgtaaaagaaccaaaatcataccaaccacactctcagaccacagtgcaataaaataggaaatcacgattaaaaaatcactcaaaaccatacaacgacatggaaattaaacaacctgctcctgaatgatgctcttgaatgatggttaataatgaaattaagacagagatcaagaagttctttgaaactaatgagaacaaagatacgtcataccagaatctctgagacatagctaaggagtgttacaaggaaaatttatagtactaaatgccaacatcaaaaagttagaaagatgtcacactaacaatctaacattacaactaaaagaactagagaagcaagaggaaatcaatcaaatcaatccaaaccaagaggaaatcaaccaaatcaacccaaagctaactgaaagcaagaaatagcaaacatcatacatgaactgaaggaggttgagaccaaaaaaaacattcaaaagatcaataaatccaggaactggttttttg

SEQ ID NO: 162672 - DNA, 239 bp, Homo sapiens
cccgtgacaagacaaagcaaaagcaggccagagttaaacaggccccttgggtcccttccttcatttcataaatgggaaaatcaaggtctgggcagggaaagggactcagccaaggccacatacacagcacactgatggccgagccggggttaggactcccagcataccctgtagacttctctaataatagataggctgcttggtttttctttattaagggttggttacacattatctct

SEQ ID NO: 162673 - DNA, 417 bp, Homo sapiens
gctgctgctaccatgatatgtgcccagtgggagtggctagaaagatatatcaagggctccaactgatcacagaatggagaagaagggagggggatattagtgaggaagggtgcaggaatagtctgtctaaagttagcttatctaaaatctgaccttcctttcgagttttcccatctagttggatgtgctaatttttttcctgccaagtttttgcactttaaataattttttaaccaataaaaactaaattcagtgagcccactgtgatggttaatactgagtgtcaacttgattggattgaagaatacaaagtattgatcctgggtgtttctgtgagagtgttgccaaaagagattaacatttgagtcagtgggctggggaaggcagatccacccttaatctggtgggcacaatcaa

SEQ ID NO: 162674 - DNA, 260 bp, Homo sapiens
tgatgatgctgtctagctctccccaccccataaatcatctgtttagcataagagacagtaaattccagggtttttaggtttctgtaccagtaactaggggtaaagatcaaatatttattactacaccacagcatctactatatattatagggaagaaaatatatctacacatcctagattcatggctaagcttcccacacatgctgtttctcagatttctttagcttaaaatattcagtatgtcacagtgtcatgttttt

SEQ ID NO: 162675 - DNA, 439 bp, Homo sapiens
ggaacccaccttaacttaaaaaaagaaaatgtattggcatatgtcactggaagcccaagggctagatccaaggggtcatacaatgtcattgagacctacctctgtggtaccacttctgagatgacttcaggcataacagacaggctttctccaaggtgaagacccccaggttcagacggcccttgggcttaccagccctattggggcactccttttttttccactcaaaagcactctccttggttctgtttgcgtcgtgagccgatccctgagccaaacactgtttccagggggtgaggtacctagactagaatcctgggcctgggtccctcacatgtggcacagagggaatggcagtgttaccaggtttggagcaagagtggagacagttcctgaaaacaaaagttgccggacaggcaaaaaataataaacaccccac

SEQ ID NO: 162676 - DNA, 1278 bp, Homo sapiens
tacttagagggactgatttaatttcccaaatcaaattgctctgcatttcttacaactattgcatctactttcaattcagaaaattaagacattttaattttattctttttattactgccaaacaaagcattaggagtactcttaaaagaatcataaaatgtatagcaacactaacagaaggataaatatggtaaaagagctttaaaattgaagttagtgatagaaatagtaacagaagtagaagtagatgctagtgcaatgtcatttagacatttattagttttttgagacggggtctcgctctgttacccaggctggagtgcagtggcaccatcatagctcacttcagcctcaacctgggctcaagcagtcctctcatctcggcctcctgagtagctaagactacaggtgtgtgccaccacacctgactgattgattgattatagagatggggcttcactatgtttcccaggctggtgtcaaactcctgggttcaagccatcctcccaccttggccccacctaagtgctgggattataggcatgaaccactgtgcccagcatgaaacactgtgcccaggcttgaagtaattcatgattgagggatattgaagaaggagtatactaaaacattgggttgcaatgtcaaaattatagatacttgtacttggatagaatgttccataaatgaaaatattcataatcacatgtagcataggagttatcaaaagggcactatggaaaaagtcatgattatatcatgaaattgttcaaacatatgagaagtagaaaaaaaatcatgtcagtactttcatcacccaggttcaacagttttcaagctcttgctacacgtcatctttttttcttttttccttaaattattttaaatgaacaacatgtcattttacccttactcagtttgggtctctaagaaatacaaaaataaccacggtgacatcatctttattttctggcacttcagtcaaaattaaagggaaatcttttggcaccatctatacacagctcataaattaaatttcccagattgatttacaaatgtctttttatagttgatttgctctaatcaggataaaaacaagatccactcattataaacagtggttaatctcatcagatgctttaaaaaaattatgaacatcttataatagtttgatacatttatcacaattagtgaaccaataccaattcattgttattagctaaagtctgtactttattctgattcctttagttcttacccagtgtcccttttctattc

SEQ ID NO: 162677 - DNA, 368 bp, Homo sapiens
gattacatgcatgagccaccgcgcctggcccctcccaccttatttttaaagagtcttgctctgtcaccgaggctggaaagcggtggtacaatcacggctcactgtagcttcaacctcctgggctcaggtgatcttcctacctcagcctccctagtagccttgactacaggtgcaccctactgtgcctggctaatttttttgttggtttgtttttgttttagaccaagtttcttgctgtttttcctcaggctggagtgcactggcgccatctcagctcactgcaacctcctgactcccaggttcaagtgattctcctgcctcagcctcctgagtacctgggattaaaggcgcctgccaccacgcatggc

SEQ ID NO: 162678 - DNA, 598 bp, Homo sapiens
  misc_feature (28)..(28): n is a, c, g, or t
cgactctgaggactcccccccgtcacgnttacctcaacatggaaagctcttgctaaggtgggaaggtctcagtcctccaaaggaaacgaagttgtggcagccttcttactagaaggatcaacttagtaattaacaaaaatacttaaaataatgaagaggaggtgggtgtaatcaagaactatgattattcaggatctctgtaggagtaaatgtattacttcaaaattctccagttttgcacgcccatgtttattgcagcactattcacaatagccaagatttggaagcaacctaagtgtccatcaacagataaatggacaaaggaaaggttgtaaatacacagtggagtactattcagccataaaaaagaatgagatcctatcatttgcaacaacatggatggaactggagatcattatgttaagtgaactaaaccagacacagaaagacaaacgtcgcatgttctcacttatctgtgggagctaaaaattaaaacaattgaactcatagagatagagagttagaaggatggttaccagaggctaggaagagtaggagaagagtcgggggtacgtgggtgtggttgatgagtacaaac

SEQ ID NO: 162679 - DNA, 265 bp, Homo sapiens
cccattcacctctctaccactaccacctagttcctggtgtcaccccagaaatcttatattacacaagctcaattttctgtttttagcgttcaggcaaaaagaaagaaaagaaaaagaaagaatacatacaggacataatcccaagctctcaaatggcagactcactatctgatgatcttggccttctctgagattctatgaaagtcatgggccctccttctagagcaaaagacacatacttgcaatgctttacaattagaacttg

SEQ ID NO: 162680 - DNA, 502 bp, Homo sapiens
gtgttcatgaattggaagaattaatattgttaaaatatccgtagtacccaaagtgatctacagatttaatgcaacccctatcataattccagtggcatttgctatggtttggatatttgtcccctccacatctagtgttgaaacttgatcccagtgttggaggcggggcctggtgggaggtgtttgggtcatgagggtggatccgtcatgcacatattggtgctatccccttgctgatgagtgagttctccctctataatttaacaagagaactggttgtttaaaagagcatggcacccctcccctctctcgtcttgtgaaatactgactcctcttccccttctgcaatgattggaagcttcctgagatcctcagattcgtgcttcttggacagcctgcagaactgtaagccaaataaaccttaatagaacgatcctaaaattcatatgtaaccacaaaaggccctgaagccggggtaatttataaaggtcaattaaagagg

SEQ ID NO: 162681 - DNA, 630 bp, Homo sapiens
aacatggcaaaactctgtctctactaaaaatacaaaaattagatgtgtgtggtggtatatacctgtagtcccagatactcaggaggctgaagcacaagaatcacttgaacctgggaggtggaagttgcaatgagctgagaccgtgccactgcattccagcctgggtgacagagtgcgactctgtccaaaaaatcctaaaaatacctgttttgaatgatataggtcttttttcttttccttaagtaatatagaagtaatgccttaaaaaagaaaaaaaatcaaaattatcctatgacctaacctccatctcttagcctcagactgtatagtgctttaaaagatctacaaagcattctacctcatttgcatctaaccattctaagaggtggctgttactattatttctccttttcaaaaaatgaaataaattggcttagtgctgtggcacatgcctgtagtatcagcataatgggaggccaaagtgggaggaccatttcaggccaacagtttcacaccagcctgggcaacatggggagaccttgtctctactttaaaaacaaacacataaataaataaataatgttttaaaaaatgaaataaactgatttgtttaaggtaagatgaccagcc

SEQ ID NO: 162682 - DNA, 348 bp, Homo sapiens
tctagagacaggaggggaagccaggctgggcttcagatagaggagagcagggaatgtaaacgttgagggattgggacgttttaggacttcagagtgttggtagattggggtggtggaaagggaggaatggtggctcctctcagtgttcagagatttttaaatggcatttttgaccctggaaatagcttcagataaaaaagtaggtagctgtgctgtatagatcagtgggagttggggaggaggtggtgcacctgcaagcaggatctcattgcatttgaactctagtctgagccaggttgttgatgtgctcagcattggactctcaggtttccttaggattgaatcact

SEQ ID NO: 162683 - DNA, 239 bp, Homo sapiens
tagccaaccaagggtagagtttccacaattctgggctgaaagccacaggactcagcactcattccaggtaccttgctgaagcaagagaaaaggcacccactgtattagatctgggtccctgcgatgtacactggctgtgtgacctcagatgagtcacgttacctctctgggcctcagatttgtcactttttctttttctcattttttagagatggggtgtccctctgtcacccaggctg

SEQ ID NO: 162684 - DNA, 535 bp, Homo sapiens
ggtacctacttttcacaggtatactcaacacttcgggcctcatgcaatcttccactaggagtgcaaggccaggatccttaactctagttgtccaaaccatgcatttccctttgacttgatagaagattcctccctcccaacacagtgattttgagagatatgaccaagcatctcaagatcccctaaatgattattttctgtagtctcccgttttgaaaataaatttgagctaggcattcaaccatttagcaaaaacttggtgcctgtccaatattttgtgaacacatcaatataatattacctatatccgaatactattgttcttcctttgtcagtagattgattgcagtgccttatgttaatacaccttgtttctcccttattatattgtgaaatttagtaagttgttaaaatcagatctaattgattttctccatggcatttggctacaaaagcatctcatatccaaaattcaccacaggagaagaaatccaggtggattcttttgtggcattttcacttgtgtattaaaaat

SEQ ID NO: 162685 - DNA, 311 bp, Homo sapiens
tctctgttgcaagcttttagttcgcaggcacactggttcaagtttaatcaccacaaaaatactgctttgtgtgaaaataatacatgagtagtccttattgcaaaaggttcaaagcaaacagaaggaatacatcagaggcctctttcagctccaccccccagtcccacccccgaggtaacaggtgtggacagttcgtctccctacagtcctttttcgcagcatttgccctatggcgtagtggctgggactgtgggctttgaagcaagatcatctgggttcaccaactacctccactacctacaaaccttgta

SEQ ID NO: 162686 - DNA, 482 bp, Homo sapiens
ttagagagcaagaaaaaggtacaaccctcccggcaaaaaataacggaaagcatagttttaatcctcttcctcccaacgtccttcccgagtgaaaataactgccaagttcacagctagcacacgaccttcccccaccagccctgcctcttaagaacactaggagctgcccgagagtcgtattaacaactctgttcaccaccacacacaaaaaccaggccacgttcaatgagttttactctacctgaccccgtgagcaacacagggacgtgagtgtgctgtcgatggcaccccaagcgatcacaccctccaccacactgcctttttaacagagtatctcactgagtagctcggagcatgaaacagctgcaggggttctcagctcccagcctccgaatgaaagtgcgtgctcaagtctctgaaaaataacaccaagctagctcctttgatggaaaagggatcccccaaaatgacgcagaaggaac

SEQ ID NO: 162687 - DNA, 704 bp, Homo sapiens
aaacaaacaaaacaccataagaatgtcctaatagaggcagaaaaggcatctgacaagccttaaccaatttatgcctagtgttccctttttggaacgctaagcatgtgggaattgtttatatcctactgcttaaggtcatggccaaagtctgatttttcacacgtcggcaattcaaaaaagtgcaacctccagcataaataagttaatatctcctgatgattaaaaatgctcaataaattaaatataaaagagaagattccataagatgacaagagaggcactaggaacatagaaacatctactataaagacatgtactaaaaatgcaaacccagaggccaaggcagacagatcatttgagcccctcagttcaagaccagcctgggcaacataaggagaccctgtctccataataaagtaaaaaattaggcatggtggcacaaaacaaatggtattgaaacacctgaattagcaaatgcaaagaaatgaattagacacagaactgcaccttttacaaaactacttcctaatgaatcatttacttaaatggaaaatgcaaaactcacaatttctagaacgtaacactgagaaaaccaagacgaccttggatttggcaataaggtttcacacacaacacaaaaagcatgatctgtgaatgagaaaatcgataaattggacttcattcaaaacaaaaatgttttggaa

SEQ ID NO: 162688 - DNA, 393 bp, Homo sapiens
aataaattagtaagtacagatttaaataatttttagggatcgaatgtaggcaatgtcctatcagtcaactcaaaagttccagattggactcataattgttgaacacctggttctgaaaccctcctctcttctccatctctaatttccactatccaagacaggcctttatctcttacttgatgcaaatgatcacccatccagccttgcccacttaaaacccatcctccagactgccatcggcataccaatggaatgctggaatgccaggaattcttctaagaattcctccacaccaggggtgttcaatcttttggcttccctgggccacactggaagaagaattgtcttgggccacacataaaatacactaacactaatggcagctgaagagct

SEQ ID NO: 162689 - DNA, 357 bp, Homo sapiens
agttagagcttggctctgatactaatcagctgtgagaccttgggaagtcaatgtctctgagcctcaatgtgctcatctgtaaagtgggcataaccctctcacaatgttgttacacgttcaacgtaatgacacacacaatgtcctggcatggcaaacagcacctggtgggcagtgcaggccggctccctcccttccaccatcactcctcactgcccaatgcgatctcggctcactgcagcctccacctccctggttcaagtgattctcctgcctcagcctcccgagtagctgggattacaggtgcatgtcaccacgcctggctaatttttgtatttttactagagatggggtttcatc

SEQ ID NO: 162690 - DNA, 161 bp, Homo sapiens
ctgttagcgcgatggagctcactacgtgggtgactgccccttctctcttgaggatttgtacacatgttcatcatggataattcttcctttcactttgattgtggagagtctgatgactgtatgtcttgcacatagttgtcttgtgtagtgaggttccatcg

SEQ ID NO: 162691 - DNA, 541 bp, Homo sapiens
tggtagcactactacaaaaacaaggaaaccagattctaacattcccaaataggaatctttagaaaaagctggatttacatttcttttctttttttttaggatgcagtcttgctcctttgcccaggctggagtgcagtagcacaatttcagctcactgcaacctctgcctcccaggttcaagtgatcctcctgccttagcctcccaagtagctggaactataggcgcatgccaccatgcccgactaattttttattttgtgtacagacggggtttctccatgttggtcaggctggtctcaaactcccaacctcaggtgatctgccggcctcggcctcccaaagtgctgggattacaggaatgagccaccatgactggcccgggttgtttcttaattggcagaaagaggtgaaccagtttttaggacatctcaagctttttaaatttcatttctattttaattaacctcagggattttacttatgcttggaatgttctttccagtacccttatccacacctgctcctccaaccaagagtgtcg

SEQ ID NO: 162692 - DNA, 299 bp, Homo sapiens
ggcaaggctgatcagggaagtgaaacagggaaggagggctgtcccaggtcatccttgctggcttgcatggtctgagctgggggcaggaacagacactcagtgcctttcagggctgggctacagaacaaagagaaggaccatcccatgcaggagtctagcctgttgatgccaacaccctccaggggagaaaggagtcacactgccacatgctggacagggctgccggagggaggagcaccggggggccctgcgcacaccctgagcctctctgtggactcattctcccaagcacagctggg

SEQ ID NO: 162693 - DNA, 400 bp, Homo sapiens
agcagagtgatcctacacaaattactccaggtgtctgacccttcatttcctcaagcacatcatgggggaaagaatgcctagctcagcacctggcagagagtcagccttcgctcatctcccctaatggagctgacagctcttcaagtccgctgacatcttctcttagtcatcccttgaaatactacccgctgttacttctctgctcctcagtctcctcctatgtaaaatggggatgagaaaggagaggttgcgaacctttaatgagcgagcccttggagtatccagcccttcccgacgctaactgactcctacgagggggcctggtacacagtaggtgctaaactaatcctctccgagctgggcttggggaagatgcctccgttgggtgtacagcgtgggc

SEQ ID NO: 162694 - DNA, 256 bp, Homo sapiens
agaagaccactgtggctacagtgtaccagagagagcgtggctcacgatgaggcagaagaaatgcgcagtgacccagcagttatgctaaggatttatcttttaagtgtcctttcactttaaactggggaataaaagtatccaacttatattttgtaaatgatcttaccaaataagagaaaaactgaactgtaaaaaggaaaaagtggctgggggcagtggctcatgcctgtaatcccagtgctttaggaggccaagg

SEQ ID NO: 162695 - DNA, 126 bp, Homo sapiens
atcctggggctgtatgggaattccaaagggcacatttggctcaatggcctggatgtcttacctttgggaagcagggagctgggaggagcctagctggacccctgccgctctgctggatgggtttgg

SEQ ID NO: 162696 - DNA, 436 bp, Homo sapiens
ctggattgggactgcacagtcacagcccttgcctccggtgtcacaagggcttcatggggctctggagagtcagatccctgtgaaagcagatggacagaaaccagccagagagagaggctcagaagattggagcaggcagttctgaagctcagggctgtgtcaaaagctagccaaatgtgttggggcgaggcggcttgcctggcaaacccatctgctttttgcttaatagatgggtttggatgcctgtggaacagaggcctcgggggacgagctttgttaactttgtgttatgttgaaggaatgtgacagaggagggtatgactgtcatccacccatcagggatctgtccctgacacgctggggtagaggatggaagaacatggaatagaggatggaagaatatggaatagtgccctgactcgaaagttaaccgatt

SEQ ID NO: 162697 - DNA, 495 bp, Homo sapiens
cagcaggagatatgatttcccattcccaggggctgcctggctttaaaagagcagcttgttactgtcatcgtccatttccccctggagaaaggcttttgtggtcggtctgcatggcagtcacaccctgggtggtccatgaggcctcagatgaagtggcccgaggccactctgctctaggcccacagacaaggcgggaatagcagttgcaggctagaaaaggaagggccaaccagacattcacagagatgcaaccagagcaacacacagctgagtctcttaagtcttcagtcctgtgtaagttgaagcaagacatcagaaatctctcacctgagtaattccacacatgcacccactgctgtccaatgcagtgcttgctcagcagggagcacctcttggccaagcgtattggcagcccttctaccgtgaccagcgtcagggacgtctctaggcgccttttcagaatagctggcaacatagggagacccagtctctacc

SEQ ID NO: 162698 - DNA, 242 bp, Homo sapiens
aaagtaccttacaaagtggtgacaatgagcacagaccatgatgcctcatggggacagcaccagctgtggaatcacagaaataagaatcactattctctcatctgcctactgcctacgtgaccctgggaacagttacccagccttcttgagtctgtttcctctctgaaagatgagatcacaagacctatctcggggctgttttaagtaaatgaggtaaatgaacatagcactcagcatagtgc

SEQ ID NO: 162699 - DNA, 317 bp, Homo sapiens
cctgaaccagctatgtatcaataaactcagcagttttacagttaagttctgaaaccacagccttttggtcacttgccgccagtattcttccaagagagattaagaaatgtttgggcctagaggcaacctttaaaatgtactgagaagtgcatttttgccagctctattgatattacttctacctagatgacccacatacttcttgatattctttaaatctttgcaaactgggtttataacatttccctcctggggttaaaacaaccccagccccttaggcaccatgtctttaagacatagcattagagaactttcac

SEQ ID NO: 162700 - DNA, 294 bp, Homo sapiens
cattgttggacatttgggttggttccaagtctttgctattgtgaatagtgcttttaagaacttaatgtctagggctgctatctctaatacagaacaaagcataaacatcagtgcttgatggatgcatgtgagtcaggaccctcatttcacataataattgctaatcacaattagttttcctttctgtattccaaaggacagaattccttgagagtcttgaatttagcaatccaacactgtgatacttttcaagtcttatataccttaaatctatcctacatacttctgtcagat

SEQ ID NO: 162701 - DNA, 409 bp, Homo sapiens
taggaatatgtcagtccttattaaaatgttagcttaggtattaatcatttaagattgcaagtgactatatgtagcagaaactcttcaacagcggcttaaccaaacaggagttttatttgtctcgtgtaggtgtccagtgcagcatcttcacaatgccgccagggacctgggctctggctatcttctggcatctcttagattgaaaaatggctgctggatctccagatacccagttgagattccaggcaggaagagggtagggaaagaagagcagaaggccaaatgcctctcgtgaagctctgcctttattattctggaatggacagccttccttaagactttgtctttatctcagtctcaggactagagagcctgggaaatcaagttttttatttgacacaatgctgct

SEQ ID NO: 162702 - DNA, 587 bp, Homo sapiens
agactctgtctcaaaaaaaaaaaaaacaaagcgattgagaaaatcaggtctgtgtgaccttagcaatgagttatttagcttgggccactgttagcttaagtcaataacttcaagtttgcgttgtagttggaatcaatagaggaaaagctctcagcattaccacatatatcagaatgtgacattgattgccagaccagccttatccaaacacaagtcctaggctttttgccctgtttatgagctttatatgctgagggtatttgatgagtcttagggaaaaaagaacagccctggggacacagctgcttttatgatgagacatgtttgcacccataccttaatgggttttggtggcaatattctgaaatttgccacctacatttcaaagatttgccctttgggtgaattagtgctgtagtagaagtgggtggaggctgaggaggttggattaagcaggtagaggatttctcagtgcatggatcgtgctgaggatggagatagagctctaagacatccacgggcctttcctgagtgatcagctttggctcctgggcaggggaattggagctggattctagtgtgggagc

SEQ ID NO: 162703 - DNA, 397 bp, Homo sapiens
ttttgtatatatttcctagcatatgagatatgtatgtttattggttgtgtatatacctaagaattgaaatgctagttatggcagaaaaacttcagctttagtatataatgctaaacaatttccaaagtggctgttgcaatcagtatgcgagagttcttgttgtttcacgtttgtaaatatctggtacatttagcaatttgatgttattgcatagtacatgaacatcttcaacattattgcccaattgccctcataaatggttatattcgtctttaaaaacatttaaaatgggatttttttttcaatctagtgggggtgaattttacagaactatggtttatcttttcttagtttatcacttccctaataatgaataacattgaatgtcttttttttt

SEQ ID NO: 162704 - DNA, 156 bp, Homo sapiens
atatatatatatatgcacacacacacacacacacacacacgcaccatggaatactactcagccataaaaaggaatgcaataatggcatttgcagcaacctggatggaattggagactattattctaagtgaagtaactcaggaatggaaaactaaa

SEQ ID NO: 162705 - DNA, 513 bp, Homo sapiens
aactataaactaagtggtatggcgaaatatagttaagtacattttaattagaacaaggttttcaaaccccggaaaattttgtatcattcaaaaaggcatcttgaatatatctactattatctaccatttacaattttaggcaattttgcttaagtaacctctgagccttggtgtctatctatgaaatggggattaatagaatttacttcagcagatttgccagagttaaatgaaacaatgtaaacaaagtatttggcacaggacttagcacagaaattgaaaatacatagtagctactataaaacacagaaagtaaaacttggcaaccttcttagattaaatatgcaggaaaaaataaacaaaaatttaaaacctcacacattaaaaaaacaagaaatatgcaaaaaagtgaaattaagtattatagggattatgagttttaaaaggctaaaatccactattctatagtaagtcaactacataaaattggttcaagggtaaagaaatgaaaat

SEQ ID NO: 162706 - DNA, 283 bp, Homo sapiens
catgcctggctaatcagaatattttcttagtcaaagattgtcatgatgtgcaattgctgatgaccattgcctagtgaaaagttccatttgttccagaaaagttatgatctatccagtgagattttgttctctgctcacaggacatgagaacagtacagattaatagataatgatggttttgatggagtccagggaaagaactccattattttcacatattgtggtagcagtggaaacctgtaggatttggaaaaccacaataacccgaataatgttcgcttta

SEQ ID NO: 162707 - DNA, 730 bp, Homo sapiens
acaggacttgacattcattcttatcaaatttaatttttttgaggtttttggctttaacgcttcaaatttaatttttaaactattaagctccatatttttttatcctgctcaattttgtcagtcacccattccttttaatcagtatttttattggcagtatttttactggcaggccagtgttctcagtcaagtcaacattgaaagagacagggctgaaataagcatcctcacgtcttcaacttgagatcattctctgacctgttgatcagattaagcagtccctttgctcatcccttaaccagtatgaatggtgcacctattatttagtctaaatttctgcatcatttacacaagatatcataaagatatcataaaccgtaaagctgaattatagatatatcacaccaacagcaataccctctactgcaaatgcagtaatttcttcaaaacagaaagtgaattaactatggcatgacttattttagagaagtcccttctggcttctttctgtagtccctttccttttttgttttcttgagacagagtcactctgttacccaggctggagtgcagtggcacgatcttggctcactgcagcctccgcctcctgggttaaagtgattctcttgactcagcctcccaagtagctgggattacaggcgtgggccaccacaactggccgctaggagattcttaaaaccaattcgtgccaaactgtcatggatgctgc

SEQ ID NO: 162708 - DNA, 384 bp, Homo sapiens
catgtatattaacttttacaataaaaaacaagaaagcaaaatgtggaattcagccctctcagggtagaggcggggcactcaggaatgaaaagggttgggggtggggaagcccacaatgatacccagaaaaaataataataatagcaggccgggcacggtggctcactgctgtaatcccagcactttgggagggcaaggcaggtggatcacttgaggtcaaaagttcgagaccagccatgactaacatggtgaaactctgtctctactaaaaatacaaaattagcatggtgtggtggcacatgcctgtaatcttggctacttgggaggctgaggcaggagaaacacttgaatctgggaggtggaggttgcagtgagctgagatgg

SEQ ID NO: 162709 - DNA, 792 bp, Homo sapiens
cagcccatgtcttaggtcgactctacaggtatccacctggtataatagtgagagttggttaggtcatatctctgtcactgtaataattttctcagttataactgcaacagcagttccaagatcaggaaattgaagtttagagaggtaaaaagttgcttaaaataggggtactggaactgagatttgaacccagattagactgactctagacctggcactcttttactgccctcagtagcatctgttaaagacagctaattccagttacctttgtgggagaaaagtgtttgtccaaagaggaataattattcctgtcagttcttagattagttttgatttaactctgctgctgagctgagtaccttccttcactagatatataaataggttgaccataaaatgtatcatccaaattgagacacttaagagtgaaaaggggtgcttaattttggattaactgggatttgtggccatcttaaggttgggccaggggccccatccttttctttctgccccacctaatcttccttacctgtactccactagaattgctgctttggagatgaggttttctttctgtggagtattaacttttatttctcagaattctagttagccggggggctgttaagtgctattccttctttccgtttttaagtaacagtcatgctttatcccacaggggtctagaggggaacctagccagggtttgcattcactcgtaagccagtgtccccgtcccagggtacgacgtggtttcaaggcattggtcactgcctcttgttttaccaa

SEQ ID NO: 162710 - DNA, 399 bp, Homo sapiens
gtatatacaaggagaagcagaagattgtagtttgaaatgttcatatgcaattcataccctaaaggcttggattccttctagcattaccaactatgcatctctgtgctttattgctagaggagacttgactattactcaagatttgattttttaaaatgacctgacaggagtgttaagagaattttgacagtggcttgtatctttgtctttgagtttttagcacctttaaatgccaagcatgattttttttttcctctataacctaatcttggaagtgagaaaagagtttgttttataactggggagaaagaaatggtttatttttgtgtttgatgtcagtcacaaaagaagggaggcactgagagaaatgtaagctccttttttggtgaactttactaa

SEQ ID NO: 162711 - DNA, 297 bp, Homo sapiens
gacagttttggaaatttgaataaagaccatgtattagatgacagggaattattaagttgtataagtacgatgatgctattgtgagtatgtaagataacagtgttttcttaggagatgtgcattgaaacatttaggcacgaagagtcaagatgtttgcaccttacttcaaatagagaaaaagaaagagaaattatgtgtgtgcgcgtgtgtgtgagagagaaagcagggaaaattggcaatatgctaagaattactgaacccagctgggcgcggtggctcacgcctgtaatcccacca

SEQ ID NO: 162712 - DNA, 324 bp, Homo sapiens
ttggaggatacagggctagcacatacaaagtcaattatatttctatatactagcaatgagcaattagaaatttaaaatacagtataatttaaaatagtaccataaaacacttagaggtataaatctaaccaacggtagagtatgtatgatgaagaccacaaaacactgataaaggaaatcaaagactttggagaatataccatgttcataaaatggaaaactctatatttattaagatgtcaatttcctccaaattggtttatggattcagtgcaaccccagtcaaaatcccattgggatttgtttttctgagatggagtcttg

SEQ ID NO: 162713 - DNA, 284 bp, Homo sapiens
tctggtcatagctgactctagaggatacacctccataatgtgagcccagaatattgatggaagttacctgggttgtgggtttatagattttttccctttgtttttgtgcattttgcaaattttcggctttgtgcctaaattccttttacagtcaggaacaaagcaatagatgttattttttaaagttcatgggctcgtgcccgtaatcccaacactctgggaggctgaggcaggaggattccttaggcccaggagtttgagaccagcctgggcaacatagggag

SEQ ID NO: 162714 - DNA, 725 bp, Homo sapiens
ttatattttttgagatggaatcttgctctgttgcccaggctggagtacagtggcacgatctcagctcactgcaagctctgcctcctgggttcacgccattcccctgcctcagcctccccagtagctgggactacaggcacccgccaccacgcctgactgattttttgtatttttagtagagatggggtttcaccgtgttagccaggatggtctcgacctcctgagctcgtgatccacccacctcggcctcccaaagtgctgggattacaggcgtgagccaccgtgcctggcccacaaagggatttctatatcatgtgccagtaggatgctttttattggtgattcatcgtggctgatagcaaagccaacatggaggcaagagctgtaaacaatctaaggttgtggagtgggataacaaatacttaagtaaaacttcaaaggttgctgagtagggtaacagatacttaagtaaaatacttaaatgtgatttcttagtaattgatatggtgatagataatctaattggttgattaactcatactttcctactaattatacatcagttattaacatagcttgaacctcaaatggatacaagatgtcttttactttttaaattagaatgagatgactcttcattccagttctttttaagcttgttatatttgataagcttaaagtattttttatgcattttctttatgcaataatatgggcaacatact

SEQ ID NO: 162715 - DNA, 496 bp, Homo sapiens
  misc_feature (15)..(15): n is a, c, g, or t
ccgcaattaagtcgngaccgcacatctgtgtgtgtgtgagtgtacacgtacacacacacacgacacactcacacaaacatttccactgacttgaaggctcaggagatatccccaaagccaaggcatggatctgctggctgaggaggtgtgagccctcggagggcaccatgtgcccagtccacactgaccttgtgtcttgccatcccttaaggaccccgtctcctctgctgtgtgctcatagggaagtggcccggagaggccaggtcagactcttaattctttggcatctgagatgtaagaacatgggccgtgcagccaagggtggacagacgccatgtgggtgtgtctggcaggactgcctgcctgcatgaaggtcacgctgccctttacagtcacactggccccagctccccacggtgacctgctaccaggcctgtgagaggggccactgcttgctgggctgtgggagcactaaaaggaagacccccctcaccaa

SEQ ID NO: 162716 - DNA, 296 bp, Homo sapiens
tgtgaagagcgtgcccagaccactgaggagttctcaacacatgtacataaactgagtgtgctgtagatgctatgcttctgggttcactgtgttttgggttccctggaatgtatctagttgtcttgttagtgagtacttaagctcaacaccaccaatgccttatccacaagaaagatattggatggctgaggataaaggtggttgttacctggacttttggcctcatgaggacatctcagtgtgtaagagggatccttaaacatgctgaggaccctctttgtttggtttgctgatac

SEQ ID NO: 162717 - DNA, 251 bp, Homo sapiens
aagagttgaggtctcactatattgcccaggctgttctcaaactcctggactcaagccatcctcctgccttggcacctcctaaggtgcttgggactaccagtgtgagccaccatgctgcccgccacccctccccacttttttttgtattagtgattggtcccaccacgcactgcttgctgcatattctttatcatctattgttcttataattcacagaaccactcaaagaaggcagctgttgtttggccatt

SEQ ID NO: 162718 - DNA, 414 bp, Homo sapiens
atattaagagtatccttcataaatactgaaacattgcaatgcagcaaaactagaaattaatgcctaaagcttaaaaattattcctataacttgaaattataaaacatcttactaagtacatattgagacaaagaggaatttttataatgtaatgagattattttacaagcaataaaaaaatgagagcactactagacttatgagataaatcaaagctgtattcagtaagtatagtcatggccttaaacacttctcactaagaaaaaagaaataaaacacatgaactaaatcaagtcaagaaatcaagaaaaaaataaaataaaatcaatgcaagcaggagataagcagtggtgataagaggaaagataaggaaattagcaaatagacaaacagaattaagaatctatagatatg

SEQ ID NO: 162719 - DNA, 269 bp, Homo sapiens
ttgagaggactttgcactttggtggaggtgatcaagtcagcgttaatgttgtctgcacccatgctgttatgggccatatgatagacagagctttctcacccatgctgtttcttccatagctcatgtactgcacattttagtccttcattaatgtggtattattctttttaaaatctgtgttatctcttcagcaacatttcaaggtctttaggatcaaggacttttatgccttccacaaagtctatgagagttgcaaggcacagatagtc

SEQ ID NO: 162720 - DNA, 389 bp, Homo sapiens
atgtcaggaaatcgagaccatcctagctaacatggtgaaaccccatctctactaaaaatacaaaaagttagccaggcgtggtggcgggcacctgtagtcccagctactagggaggctgaggcaggagaatggtgtgaacctgggaggcagaggttgcagtgagctgagattgcgccactgcactccagcccagcctgggcgacagagcgagactccgtcttaaaaaaaaaaaaaaaaaaaaaaaaaaagctctgaggcaaatatgacaaaatgttaacatctgtcaattctggtaatacttatatggctattctgttttactactgcaggtacttttaacatttaacatattccctaataaaaatagaaaacaaattaaactgtaaata

SEQ ID NO: 162721 - DNA, 466 bp, Homo sapiens
tcaaagagacatataactgagttaaccacatttatcttttaaccgcaccaaagtccaaacagatgatctaataaatggcgatggcatgaattgggaaacactaattttaaggtgcacataggaatagttgaaggcacaggaagggtggagagaagttagtccaatatttactctatgcatggattatctttcttggccaaagttgttggcaaaaactcactgatactctggtacctctaccagaggtcaaccagtgtcttctatccagcctatcacaataagaattcaaattgtcacctctatatttctgcatttgtttttccttattaaatattctggctggccaagcacagtggctcaagcctgcaatcctaatacttcgggaggccaaggcaggaggatctcttcagctcaggagttcaagactggccagagcaacagagtgagacctcatctctaccaaaac

SEQ ID NO: 162722 - DNA, 433 bp, Homo sapiens
ggcagctctggggttatctgtcaaaggctggaccaggaggtggtttggccaaggctcagcctaggcaaagtcatgaacctgttaaattgttctttgtcctcttctttcttcagatttttgtcctctttcctattgaactccgtttcctttgccctggtatctctcccgtatgtcctgcatgtattcctggctgagtacctgttctttatctcattcttatttttggatcggtgtcaacgaatggctgtctgtgctaacagataagatgtgaggagaagagaactaatatttttgaggccctgttatgtgccaggcactgttagctgatagggttttagttatattcctgatagaggcaaatgaatgtccaaagagttgtccagaggcaacgggaagacactcccactcctctgccctccccttctgcccagca

SEQ ID NO: 162723 - DNA, 533 bp, Homo sapiens
gtgttgaattggcaccacccaagtgaggctgtcgtatacctgggtagaggaatgaacaatacatcgcaggttgtgacaggcttattcctacgcttcatttaatatggaacccgcaacactgatttcagtgcaaagaactccctttccttggtctctgggaagaagtcactgcaaaatctatgtaatttgctcttcatttctcatatcccaatgaattctcaaatcagtaatgtgtgatgatatgtctagatatcttgtgctgccatattgcccatctcaaaatgatttggcaagctgagaaaacaattaaaccaaatagataaatctatcattgtaatgaaaaatattaattacaagcaaatgagagccaaatatatttcaatcagtgtttgccttgccatgtactgagatacggatgacgagaaataggtcgactgtctctgcactccgtttcttctgggatgactcccatgttaataacatactcccacgttaataacatatttccacattaataacagtgtccctgtcat

SEQ ID NO: 162724 - DNA, 467 bp, Homo sapiens
tcagacagagttctgctcttgtgtccaggctgagtgcaaggggcgatctcagctcaccgcaacctccacctcccgggctcaagtgatttgcccacctcggcccccccaagtgctggaattatgggcatgagccactgcacccagacacaaggaacatttaaggaaatttgtaatgcaatcgcaagtctggtgggtaggtggtagcattattactgtttttcaaatgcagatattaagagattttgatttgtccaagatgttctgcagcatgttattggtaggaccaggatgtgatcccaagtctgctgacccaagatctcatgctgtttccactttaataggcagatgaccatgtatcatgaatgctatagaggaaatacccatatgtggggaggaacttagactgtgtatgattgtcagtttcttctctgattttgaaaatctttgattttctgaagattgaaatt

SEQ ID NO: 162725 - DNA, 359 bp, Homo sapiens
aacttctttatggccacttaagaagcatcaatgaggttataggcctgctcttgggagcactgctgtctgtttcttattatagtgtgggtggcagagggtaaagagtggtcaagcactaagcagcaggcgcttccccaccttggtactctgtcgagtacatcatatccccagatacaaaaatgggagatagtgacttccatgcttctgttttggagcctgcagctaaaactcccctatgtttttattcactattcattcaatctaatacataaacttgctttgttctttaaatggtcctttatgccctctactcaattttttaagtgactcagtttcaacatgctgacatttttgacaca

SEQ ID NO: 162726 - DNA, 375 bp, Homo sapiens
gatgaggtagattctagggaagtgcaaccttagccaatgtatctgtgagctggccagagtccgaggtcacccctcactgctcatggtaatcagggagtcaggaaagtataccatcccctaccgagtgcttctgccatcctctatgccaaaaatggcatccagccccaaactcttacaaacacttttttactttgactgcccttgccccatctctccaccattatcgacatttaaatttggacactcgggttagagtccccatctaaacttgctctttaggctctactacatgtaagtgcatgggccagaaagcaaggtctctaaagcaagaccagcccccaccgttgtttgtttagaaagcgggcacattcctga

SEQ ID NO: 162727 - DNA, 1065 bp, Homo sapiens
gcatattttggactctcaaataactactctgtcctttaataaagtaataataaggaatagatgtgcacatagttagaaaagtatgagtggttaaaaacaacagtctcccatactgcctgttttctctctcagaggggaccactaatgagcttctaagggcatttctagaaaggaagaaaagaagataagaggccaaagaaggagggacgggggttatggagagagaccttccctttccagcactaacgctctgtgaagggcgctgcaccttgcattcttcatgtggtgttttgtcttagaggtcgtcccataataacatataaagatctacctcattcctcctagtagctgcttagcattccattatctcagcggactatcatttatttgaatagccttttattggtgaacatatggatacttccagtttttatttttatatacaaatctataattggcatacttgtacatacatcttgacatagttttgtgactaaaacggtataaattccaacttagaaatggaattgctgggtttaaggctacatgtatttaaaattttgatagctattgccagattatcttctagaaactgatcgaaggatgtaactccatcaagagtacaataaaaggcccaatttctcagctttctataatagcactgggtattttcaaacttaatgtttttcccaatataattggtgaaacatgatatttacgaatattattctgattttggtttattttgtgtataaaatgggacatcttttaaaatttttttgtagttttaattttgatacatttatatattttacccagttcctaattgggttatttggctttttcttaatttgctcatgcactttgggacatttttgtcttatgtctttaaaatatttttatcatttgtctttcgatgttatttattgatttccttatttattggcatagagtttaaatttttatgttgtcaatttgtgagtatttttctttgtcgatcgtgggatttgtttccagtttttaaaagccttcctcattctgagattataaatagacttactcgca

SEQ ID NO: 162728 - DNA, 228 bp, Homo sapiens
atttgccccttttagtttcttatgaacactgtagctaatgtaagacttctttggagccttcctcaaaatctgtttgctcaagaggggctccccatacctcattttggagtatacacatctttctcactcacctagtatactttcattgtcaaataccagagtggtgggcaatgttggctaggggacaggggatactttgatgtatcctgagcgaccgttaggtagagc

SEQ ID NO: 162729 - DNA, 244 bp, Homo sapiens
cacactggaccctcaaccactcctgagtgcaggactttgtccatttcccctcagggcctctttctctctctttctttctttccttccttccttcctttcactctctctttctctttctctctcccttccccttccccttctccttccttccttccttctgctctctctttctctttctctcttccttccccttctctttccttccttccttccttcctttttctttctttttttttctttttga

SEQ ID NO: 162730 - DNA, 404 bp, Homo sapiens
agcttggcatagggtagggggcaatacccatttatggcagagcccagtggtagaaaatagctgagcctgtgtcacaggagtgctggcttctgggtgatcagaggtaagattcccctttgcctaggtctctcactttgtctcgtgggctctctcttgttctttctcactctgtgcttattctcactgtctcttgccttctttttttttttttttaattgatccacactttattcaatggtgtgcccaacacagtctcagagacaaagagcagtctgaaatttccagatgctttggtaggtcagaagcacatgccatccaccctcttacactccgctcaactcccctcaccttcttttgttctttcttgctctcttacttcctctctctctctctgacacacacac

SEQ ID NO: 162731 - DNA, 283 bp, Homo sapiens
tggtcaaaaattgggttaaccaatggggggagaatatttggttaattgttttaatattaaattttcaagtttataatagagttatggttgagtagtcatccatactgagtaatcacgcattttttaaactataattgaggctcttctaaagctttgttttctaatctaagatacaaaggatattcttgatcttgcttgattgtaactacatctaccagtctttaatgtctgtttggggtgagtggcgatcctctgttgtaggaatgtttttgaagatttctat

SEQ ID NO: 162732 - DNA, 107 bp, Homo sapiens
tcacagaggccacaagtggtagagttgggatttgaatacaggcagtctgtctccagagtccaaacatttaactgttcctgggtggctgctatgtgctcatataggct

SEQ ID NO: 162733 - DNA, 360 bp, Homo sapiens
cgatagtttgaaacttttatcatagctagtttctttgtggttcagaggtttaaaagaattgttttctggattgacaaaggttacagaatgctaaactggtgtttgtttcttcttccactttcttacattcattttgggaaaataattaaaacactttccagaatactgtgaataataacaaagtcttaaatatgtgatttccactcagccatttttagtagagaagtaaaaagtatatgaactgatgagagctttttaatacagaaacatatatgaataatctggatgaataaagatctgcagggttttttttgttgttgtttaaaaaatctccttgagaaataaattggtagaataact

SEQ ID NO: 162734 - DNA, 923 bp, Homo sapiens
ccaaccacagatctctgacccacctcaagagatggaaatgaccgagaccctggggggaatattatttattgacttatttattggttaggttcttggttttttcattaaacatcagggagcggggtataggcagagatacctaggaaccaataaaaatatccccagggtttgaggagcagccagttgtaccaagaaacagtggctgaagatggagaagaagcagagggatcagtaaggtaaagagggctgggaggagtcacaacggaataaggaacaggtaccatggtgcacttactagagatgaagaatagccaaggggtccagggtataggtggaagaataatgaagcaaacaggacatgagtcagacgctggagccagagaccaagaaacagtttctgaggctggagaagtggtgatcactgaggagcagggaagagccgagggttaaagaacagtgagaaggatcatgaaataggaggaggtatcaggaaatagaggaaccaaatagcagccagacggagcagtcagtatccagaggggtgaggaagcagaagaatcagataaaatggaaaaggcaaacatatccaaggaactgggtatgagcctgagggacaagcaacttcccgaggaaccaggaagcagttccttggtttagaagagagcttgagggcacaggcaaaagacagtgataccagggaacaagaaatgtgaaatacgacccagagaatggattgcagtcagaggaagcaggagacaattgctgaggctgtagaatgggcagagggatcagggaagggacagagcccatggaacaggtggaaagatgagagaagagcctctgaagctgcagaatggcctagagtactgtggaacacctggagcaaggaacagtcactgaggctggggggcagccagagggag

SEQ ID NO: 162735 - DNA, 515 bp, Homo sapiens
ctgccaagtctgatgactggacgtctgcagcagacaagaaaaatcaggttgagtgggatttcttttcttttatggcacagattctagagtggtcacatattttacttatttattttaagatttttaaagttgtttttaaagtttaaaaacttcagcttttattttagatatagagtgtacatgtgtatgattgttacccaggtgtgttggacccaggtaaggagcatagtacccaataggtggtttttcaattcacgtccctctcccactctcctcacttgggcagttcccagtgtttactgttcccatgtttatgttcacgtgtgctcagtgtgctcagttcccatgtgagaacatgtggtgttttgttttctgttcctgtgttaatttgtctagggttatggcatccacatccatctatgttgctgcaaaggacatgatttcgttcttgtttatgggtttgtagtattccatggtgtacatgtaccacaattttttttttttttttttttttt

SEQ ID NO: 162736 - DNA, 329 bp, Homo sapiens
ctgccaagtctgatgactggacgtctgcagcagacaagaaaaatcaggttgagtgggatttcttttcttttatggcacagattctagagtggtcacatattttacttatttattttaagatttttaaagttgtttttaaagtttaaaaacttcagcttttattttagatatagagtgtacatgtgtatgattgttacccaggtgtgttggacccaggtaaggagcatagtacccaataggtgcagtgaggaattgggtcatcatctccttcatcatccattcccaaatcttccaacatggtcttaatagtcacagattgtttggcattt

SEQ ID NO: 162737 - DNA, 624 bp, Homo sapiens
tgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaag

SEQ ID NO: 162738 - DNA, 306 bp, Homo sapiens
atcaatatatatgatatgccaggtagcatgctttctgccttttacatgcatgttctcctttcattctcacctggcattaggggataaattaaaaaattatctccattttccagatgaaaaaactgaggcttagagagagatgaaacatcttgcccaagcaacacagctgggaagtggggagacaggatttgaaccatcgcctgcctcaccctgtaattagtgttccccaggagcacctttccatccgttaactgcttcaatctttgcaacactgcaagatggcaaaactaataactcacttttgca

SEQ ID NO: 162739 - DNA, 338 bp, Homo sapiens
atggggtcgaggcagcatctgggcctcacctggaagctgcctcgcccttttgggaagaaggggggatttgtgtaaatgccctcgcaaacaagagtgacccctgttcttggttctgctggctgtgtgcctgcgcccaacctggcgtctggccgactagggcaggagggctgttggagggggctgggagcctgctaggaggctcttcccccggcatctggcacatcttggtaaggcctctaatgcttgggagaccatagggagccctctggttacagtgtacccagccatcggacttcaaaacgggtttccttttctggactattaagacttcatcaaaa

SEQ ID NO: 162740 - DNA, 469 bp, Homo sapiens
tcatgctgtgaggaaggaaggctggatgaatataaaagcatgtgggcaatcggtggtgctattgagcagatgtgcagtgtagtgaggatcagttagtttttttttcagccctgccctttcatctgccctcctggtgctcagcctcctcagccagcccattcccagtgccacctaggcagtattatagtcttctaggtagaggaggagaggaggctgctgaaagaagagaacaagagtttccagagcatgtcatagtaagaaaggacacggaaatgaactagagccccagagacagggtgcccatgctgggtcccggggaatcctcctgggtgcctgcagcttggggctccacaactgccctgaattctgcccaccacaaaatggatcatagaagagccctcatttattgtcttgtgaccctctcctggacatagcacacttacctccacctgtgtgcctctggtattcc

SEQ ID NO: 162741 - DNA, 693 bp, Homo sapiens
gcattaaggatgcacaataaattgttttgttggttatggcacctaattctttctcactgtgaattttcttttgccaccttcataagagtggaactgcttatttgaaatcaaattgtgtataattttagaagagatggaagtgtcacccacaaaattactaagggtgagttttcatgtcattttgattttatataactaatgttgatttgatatggttgatatagttagatttagtttgatgtcatcagttaagaatatctgatcactgatcagaaagaaaccaactttattaaattgaatgattgtttgtcttgcttcattttctagggcttaactatgaaaaatgaattattcatgttttcatgtaggcagtactaaaccagacaaagtttgggggttcatctactcctagaagtagcagtgcagggcgtggtgctggatggagagactatgccccattctaaagtctgcaaagaaatattttgattctgaattactataatttacatagggtattgcatgaggattgatggagcaatgatgaagatactttgcagtaacttatattttacaggtttctgaagcaaggattgatacttagctcttccacgaaagcgcaaataccacttgctaaattgtactctgctgtcccgtaccaaaaaaatccacaaaagtatgtttttagatatatct

SEQ ID NO: 162742 - DNA, 639 bp, Homo sapiens
aaaacctaaaaaattcaaagattagttaatgaagaagaattaatgttaataatgtcatagctctctccccttttaatccataaagccctgtttattaatagcaacagcaataacaagaatgagcatattccctctttcccccaccagtggccttcacagcttgacagagcgcttcattctgctgaatgagcaacactcaggacaccagtggccttccgagtgggcagaaattccttgggcagctccagatcccagcaaaccacttaatcagcctttacataaaaaaaaaaaaacaaaacaaaaaaaaaaacgtgtgtgcgcggcgcgcgcctcgggcccccgggaaaactctttaaaaacatagcgcggtggggcgcgcgcgggggccccagtggggatagagcggaacaggggccaaaaacgcggttccccgaagagagaaacacggggccacagagaacaaggggcgggggaactctccccccacaatataaaaaaaccgccgcggggcacaaccagccacagggctgcgcaggaacaaaactccagaagggagaccggaagaggcaaatacggggggccctactacacagggagcccaaaaggaagggcaagaatcaaattacccccctacacggg

SEQ ID NO: 162743 - DNA, 276 bp, Homo sapiens
tcccgggttcaagtaattttcctgcctcagccttccgagtagctgggactacaggcatgtgccaccacacccagataatttttgtattttagtagagatggggttttgccatgttggccaggctggtctcaaactcctgacctgagttgatctgcccacctcggcctcccaaagtgctaggattacaggcgtgagccactgtgcctggcccaaaacactttttattgaagtataattgcatatagaaaagcaagctgcacatttaatgtgcaactc

SEQ ID NO: 162744 - DNA, 507 bp, Homo sapiens
aagaaaggccaggagttgatatttgaggtggtcttggaagaaaagaagggtacacacttaagtgttgaggggagagcattcagaccaagggaacaacaaaggcacagaaacatgaaggtaaaaaggaaggcacttaatgcataggctgcttcagataatcattctactttatttccatactttatagcatgaatgtaattaacaacagtgtcggatgtgtttttgtttttttgactgagctgaaagcgcctatcaacattttcttagtaaagatatctaatatttgtataattcataacagattataaactttttaataattatatagactgaatgaattaatatactgtatgtaaagctcttgaataacacttactaaaggccaggcaatgttctaagtgtttgttgttattattattatttaattatgaagagaccagactgagacaaaaacaaaaacaaggttgaagcctggcgccatggtggctcacgcctgtaatcccagca

SEQ ID NO: 162745 - DNA, 539 bp, Homo sapiens
cctacatttttgttgttgctgatgttgtaagtgtgagcgttggtgctattttaagtacaaggttttcttccattttgtttcctagctttttccctgaaacatagaagtgctgttgattgtgtaaccaactacattactgacttaactcattgtttatgagagactttccaggagtactcttggattggctagatatgcaatcatattacctgcaaatagtcattatgttgtctccactttgtaattcttaaaatttgtattttttatctttatatacctagaataatattaaataagtggaaatattatttctcttaccctgttcctgactttaatggaaaatgcttctagtgtgcaacattaaacaagatgctatttttaaacttaaatatgtttttatcatatcaatactggatattgaattttgttaaatattcttgtagtctctaagaaaggtcatgtagttattctcatttaaccagtattaagaattcacctaaggctgggtgcggtgactcatgcctgcaatcccagcactt

SEQ ID NO: 162746 - DNA, 380 bp, Homo sapiens
acatgtatacttcagttccatatactaaaatgccattttataccagtactaagatgaggcaaaggtatccgtgacagggtttcaggccaaggatgaataatataatgcaaaggcccatagccagaggcatgtatagggcacacagcacagccccagccacaagggatttctgccacagaagctgccccaggacactctcagcgtctaggaagtcaactggaaggcaaagagtacagctttcttgttcaattttatgtggtaagaagcaaatccatcagttagggcagctaagaccccatgagatagagactaaaccttgggaatataagcagttaactcacagagaaaaggttaggcccaaatggctgaagtgtataagt

SEQ ID NO: 162747 - DNA, 468 bp, Homo sapiens
gcgttacacaagttagtagacaaatgctaaccacacatgaatatcaatcaggtgccataaaagagcagctgcaatgcctcataaatgctttaatcctgttactagtgaaatggccatgacttttctttccttcagcaccaagtcatttcagatgggagaaatgtaaattaatattgctcttagctttcaaacctgtgactgctagtggcgatttttataggagaaaaatgtggggtcaataaaattttatttatatggagataattatggagaggactctttttaagccatcttctcagcataaagtaaatgcataagatcctttccttgatgaaaaagaaatcagcttgaaataaagatattgaaggctttgccacctcttggtgatgtatgactagaagtgagagccctttctgagaacttgccaaggagatgattaaacaggaggagagcatctgaatattgaaa

SEQ ID NO: 162748 - DNA, 385 bp, Homo sapiens
tcctggctcttgtgtaagaattctgaccgtgctaaccatgcctaggagggaaaggagttgttgtttggtagaaggtgctggggtttgagagatcagtaggacacaattggcagggagagcacgtgtgtttttatgagaattatgctgagataggtaacagatgaggatgaaatttgggcttgattgaagtaatgggggctgtctgtgaagctttgcggcagtacagcctaggtaatttgctgagcttgatgggtgtcaggctcagtccaagtgaaagcgaagagaggctgggattaagggtgcaaaggaatagtaaagaaagcatgtctgagatctagaacagaataatgggttgtagaggcaggtactgaggataggagagtat

SEQ ID NO: 162749 - DNA, 514 bp, Homo sapiens
cgtttttgccctcctcacctcactcggagcccaagctccaactccagaggcctgggcattcctgggcttgggtgacttcctcagccacctgtgctctgactcctctgccagaccttctccatggaaattccataccctgcttgggttctgacaccatgtggcctccaccagaccaaccccctgcctagatgccttctgagttcttggactgtgacacccctcccaggctgccatgtcagaaagacgccttcttgagaatcactttttatttccaagaactttttgttctttgattgctttgttttcatactatggatatagtgccctcttgagtcacactgaggataacaactcagacattgtaaaagctttcttcggttttgtgcatttttttcctgtggaaaataacaaatggtataagtatagaaatgtttgtaccaggccgtttagctgaatggtttttataataatgaagaactggaaacaaagtattaataagttgcaagacactatt

SEQ ID NO: 162750 - DNA, 291 bp, Homo sapiens
gagaatacagggagtgctctgggtttgctgtcagcttcctccccgcgagtgtaacaggaaagtggtgttcttatctccttataacccaactgtttataccccacacaaccacgcagcccttggtcaaggccaacaagtataggtccttccaggcttgccacggtgatcagagagggagtgtcctggggtcagagagagagtgagtatgctcagctgtgtcccatactcagcagctgacccagagcacgtgccctgtgcccagcacgcggctggcagcaggagtgtgcagtc

SEQ ID NO: 162751 - DNA, 163 bp, Homo sapiens
ataaaaccagcttgcttggttagaatgtagattaagttccaaattttggcaaaattcaagtggctatctttaagtttaccttgcttaaatttcataacctttttgtaaatatacaaatactacctgggatcccattaatttatataattaatagtacacaaaa

SEQ ID NO: 162752 - DNA, 234 bp, Homo sapiens
cacaacaatgtgaatggcttacactgaactatacacttaaaatggttaattttatgttatgtacattttcccacacgcacacacaaaaaaaagtttaaagaaagtgttatcttcaggaaatgggctagccagtatcccaattaacttaaacatggatggcagagcactctgaagagaatcctggattaggcagcagaaagcacagttgtcttacaggttatattcgcgagaaaa

SEQ ID NO: 162753 - DNA, 241 bp, Homo sapiens
ttgtaggagggaggtccctccaggctgtggggtaggaggtaggtcaagtggagactaagacccgggcatccctctgaatccagggttacagcacatgctgttccctctacctgggtcccccttttccctgcccccttttcttgcctggagtaagagtttttttgttttgttttggtttttggtttttggttttttttttttattgctcatttcaaaaatctccagcatctagtatagagtc

SEQ ID NO: 162754 - DNA, 243 bp, Homo sapiens
ccttttgctgttgttgctttttaagcacagatttgaaagactcaggcttttcagaaggtcgacaaaagaatagtttcacttgttatcatttttcaggagtttactttgaaaataaagtttccgtggcggggcgcagtggctcacgcctgtaatcccagcaggcacaatttttgtaaagcccagtgttgcagccctgggctcctgccatttgctcaataacatatgtaccttggcagaccagcc

SEQ ID NO: 162755 - DNA, 537 bp, Homo sapiens
cagtcataccgtgtggcgtcaggaggtgggacctggccagccccggggtggtggtgggggcagctgccacagctgctgggctcccggctgtctctctggatcctctgggcacggggcctgggcccccttcgggctgagggtgtgggctgctgaggactgtggtcaccccggagcccagcgtggaaccacggaagagccgcacagaggcagagcccccccagctgccctgcacccccggaagaggaaaccggcgcccgatggcaacagagaaagaagcggcctcctgcaggcagggcgctggggcctgagccgcgttgcggaaccgcctgccccatctcaccgcccgcctgggcagttgggaacaccacggactccgccccttcacccgctgctgacctcggctggaaaaatggcgggacgcgctccccggctcccccagcctcgcctgagccgccgctcagctgaaaaccctctttattttgctagctgggccctcagcacacgcgccgctggctcctcgattgctggcagcggccg

SEQ ID NO: 162756 - DNA, 560 bp, Homo sapiens
tgctgggattccaggcataagctactgtgcctggccatggatattaatttttaaagttccccaggagattccaatttgctgccacagttgaaaacctctggcctccagccctaccaggtcagcagtaactgagctgactcccacatctgcatggtaatccataaaggcagaggaagacagacgttccattgcccaaacccagattccccgtcacccagagcatactaaattgggagctaggcagataccaatgaagaaaaatgtgagcatatttacaacaaagcaggccactgaatgcaaactaaaattccgcatcccgtgtaagtgctgcaagaatgaaaagtggaggtcaaaccaccctgcttgagaatctgagtcttttgcacagcctcccagagccgagtcctttccctcctccagtctccgtttcttagcagagcagggaccgccttgaagaaatgagaaatcaattgtgtgtgctctgctgaattaaggcttttccaggcttgtcgatctgcattcatttgcatgcattggcactgtcttccctacagaatgaa

SEQ ID NO: 162757 - DNA, 256 bp, Homo sapiens
tgctgggattacaggtgtgagccactgtgcctggccaggaataagttttaatgagaaggaaacccatagacctaccaaacactaaaaagcaactggattaacatggggagcttggtgaatttgcttagggaaggaggtacacagatggtaaaaagttaattttattagaaaaaattggtattggtatgtcctggaaaacaggtattaaaacagttgtgatattgattgccttgctattgaaacttctaaaactagg

SEQ ID NO: 162758 - DNA, 426 bp, Homo sapiens
ggcccgcttcagcctcccaaagtgctgggattacaggtgtgagccaccgtgccccgccatgatataatccattttaatcaataagtacacagtatgtcagatagtggcaagtgctccagacaaaaataaagcaacaagaggaaagaacacatggggaagggtaggtgagggagcaatctaaagtgaggttgtcaggacaggcctcacagactcagtgatatgtgagcagagatcaaagaagagcagaagctgccatgtgggtatgctgagagtgggaaagtacctggagttttctaggaataatgtgttgctagagcagcatgtctgaggactgagaacgaatacagtaggagataagagaacagtgtactaagagctagaactggagtattcacaggtctctgtaacatgggtgaatcaaggctg

SEQ ID NO: 162759 - DNA, 275 bp, Homo sapiens
gcgactgccacagtcagccaggttggggaagaaattcactcgaagaaagcttcccagagcaggtgttagggttagaccagttagggggagtagagaggttgttccaggcctcacatgctcaggggatctgctactgcagatcagtgtggctacaccagggagacagagaggagaccagcttagagacaaagtggaggccagagcctgttgaaagctgtctttattctttaggcaatggaagccatgtgggtttcagaaagacatatttaaagaca

SEQ ID NO: 162760 - DNA, 382 bp, Homo sapiens
gctcatctccattcttttggctcccccggattcatctgattggttttaggactctccttactatcactcccttctcctcgtgtggttctgtgctggtttctcagttgctgattactatttaaaagctctaacaatacttaaaaagttacatcttataccatgattcaatctctatgtatccctccccactcaattaaaaagtacgttgtggatagttcaagctgctacccaaacatatatttctgaaagctaagtcacactaaacactaaatcacaggatccatgtgaagcctgaatcaatctgaatattttacactatttctgaccctgctttgtagaatatgcaagcttcccttgcgtataaacaaacatttaaaataca

SEQ ID NO: 162761 - DNA, 343 bp, Homo sapiens
tgtgcagggcctaaaagggaattttttaaaagtatgctggatagcttacagaatcatcatgatggcttaaaaaacaggtgtggaggctatgcaatttggtctgtcctatttactgtactggccactccatgaggaacaacaaggaaaatgctgctcccaccagaggatgggtgttgcacttataccatggaacacatctggtcctggacactgattgctgcctgtattagtccattttcatgctgctgataaagacatacccaagactgggcaatttatataagaaagaggtttaatgaacttacagttccacatggcacgcgacatcgccaggggatcctct

SEQ ID NO: 162762 - DNA, 421 bp, Homo sapiens
tttaagcgcacaggtaatgagaaagtgcaaatacagccccctctggctgcagcagtcagagagccaagaaaaaactgcatgtcatgccatcctattataataacagattaaaagggcacaaacagggtactaattagcagtcataaaaacttgaagctccagattgctcatcttcatatctgggcagtaaaagtaccacgtgtgcagataacatagaagtaaaataccagggtgcaattgcccagagctcagccagcatcagctgagagaagcagttgcatccagcagcacatcctacactttctcaagaatccaaaggcattcaggtgactgcccaagaattaaaaatcagccagcccagagagaggcaagtgcctcctaactcagcaagggacagcgggagaccttgccaacttctgat

SEQ ID NO: 162763 - DNA, 274 bp, Homo sapiens
caaagtgctgggattacaagcgtgagccgccgcgcccgaccgccaaattcttgtgttactggtcattgaggttatttgctcaagctgtttcctcaccttagaaagtattcctgaaccatcgttaccgctctttccaggggacttgtcctccttcttcaaggtccatccaggtcagatatcatcttatctgaagctctctggcagaatcacttgccttttctctgagttcataccagagaagataagcttttgttacagcacttaattacattgt

SEQ ID NO: 162764 - DNA, 321 bp, Homo sapiens
aaaaatattaaagttaggccaattaacaaccctacagtggcctctacatattcaaatgaatgatagtcacacatctcacacttaaaatcaaaagttagaaatgagctcagtgaagaaggcatatcaagagccaagatacgacaaaaactaagcctcttgtgccaaacagccaagttgtagatgcaaaggaaaagttctggaaggagattaaaagtgctaacccagcaaacacatgaataataagaaagctaaacagtcttattgctgatatggagaaatcttaatggtgtcaaaagaagaccaaactagtcacaacatttc

SEQ ID NO: 162765 - DNA, 140 bp, Homo sapiens
actgaacatactcccacaggggggctcctggagatggtgactggcctggtaagagtcactaggactattttttaaaaattaaaagagatggcacctcactatactcctaggctggtcttgaacacgtggtcttaagtaat

SEQ ID NO: 162766 - DNA, 386 bp, Homo sapiens
atatttcaattattattttttaaagctattttgagcaattgtgctatgagcatttctgtgcataccccttagcccacaggtgtcagagtctgtcacggacactcaggatgcagttggtgggctgtggggtaatcgctgggttgctgagagcatattcaagtttagaagacaacttcaagctttttaaacgtgattatacaatctacactcccactggcaatctgagttctcgttatttctcaggatgctaacagagttcacatgtaagcatttcagttcagccctatgcctggctgattccttctcccaaatacttctcagattgtgaaaagcagaaacagcactggttttagagctagccctgggctcgatgtccagccctgaca

SEQ ID NO: 162767 - DNA, 998 bp, Homo sapiens
aagaaatcaattttgactcaaattcaaagaatgacaaaattcacggtgagagttgggacagggatagggtagagaggaaattcttaataaaaattaggaacatcaggacagagaccattctagtctaatgaaggcacagataaacatataaataacacttagctgggcaggacatggttgcaaagggatgcggatgaaagtaacatatcacgacacaataaaaatcatttctatcacgaactaattcaacaaggaatataacatatcaaaataatcttaagttggtaagcagtattagagatttggataggaacaccagatttaaaaaatgtgaaaacatttttgcttcatatcttttcctaaataaatgaagaaacttgaggaggtacaatgacttgtttaatgccacgctagttagagtcctggtgacaaagtctctattctagttctacttttataatatcagctcactcccaagaagattccccatcacctgttcatcttcctctttgcatctgtggggccaactgatggttaatatttctctatattactaatacctcccaaggccataacagacacacccaggaactcagtaagtgactcagtaaagaaccaagccctgaactcaggtaatgtggtatagagcgcatcaggaattactctgtcctaattctcactagacttttgcttatgtgtcttgatcccatatttcacaagagtaagattcacatctcacaaaaaaagctagcctagaattaggaaacagagatgcaaataacactgtggttaaacattcagatattcaagactctcagaagttataactttgtaaatacgtaccactgagtggctaggaaaaaaaaactttaatgaaagaagactttttttaagtaattagaggggatgttttcataagaggagttcacagtaattaggaatatgtgcatatatcatcttgggaacacttcttgacagacaaataagtacctgggaaa

SEQ ID NO: 162768 - DNA, 366 bp, Homo sapiens
gcaggcacacactgccacacccagctactttatagtgaacaccagagtcatctggcaaatctgttaaaacataaattcctgtaggaggctctcagagattctggtctagtgggtctaggttggggcctgaatttgtacttttagcaagctcccaggtaatgctagtgattcccagctagtgagtttaatatagtaaggaaacaaacacttgttgtccatattgttgacttgatagttataccccagtagcactgagcattcagatcttggtttttaaaggaactaggactttttagagaagtggctgatttagtgcgggagcagagaaaatacaagatgagcctgaaaaatcttatggtgcttgaa

SEQ ID NO: 162769 - DNA, 408 bp, Homo sapiens
aaaatcacactgctgaatttctattaagtcagatttgttctttccatctccaagacagttttatgtttagaccattatcaagacacataactaagtttttcgacctcaaacagcagaaaactctttactccttctagtatgattttggtttttttgttgtttttcttcctgtaaaagcacagattaagcccttccttttttgaatttcatccacaaatctttagacttttccagcctttctccaaagctccctcagtacattctggaaggattctgggctctgtgcaaaccctacaatacatctttttcatagattgcattcatgctatcaagataaattatatgaaaacttatgaagagaaatgttcccattcgagcctaagaatagaacatctagacataagtgaa

SEQ ID NO: 162770 - DNA, 461 bp, Homo sapiens
ggacttgatcttttaccatggggcaacttaaatgattttcaatcaataacttcatctaagagggatgttgaagcaaaatatcatactcagatactgaagaagcgcagaatttttggttgcttcctcccttgtcaagtcagtcagctgatgctttctcaagattctcacacgtggctttgatacaggatttgaatgagtctttttctgagccagtgatacaagaaatatattgtggaagtgtcttgtcttaattctgcaatcgcttctgtacatgtttgaagtcctagaccccaggaggagagacagtcaaattagccaaaggtaatttgtgaagactggccatgggaggtggtggctaaaagtcctccggcccctgctgtctgagcatccccacagaaagtcctgggccgcactgacagctgagaaagaacatctcagggcttggatcccctgtggagagg

SEQ ID NO: 162771 - DNA, 243 bp, Homo sapiens
actccctgttacaataaaatggaatttcttgtagctccctgaactagctatgatattccaaaatcctatgtatttccgaatgccactttttctttctaattatgatgtcttcccttccagatgacatcataattagtcctttctaagcctaattaaaacatctgctctggacaaaatcctttgttgacttccttccaccagccctgggaagaatctatcatcccctttcctctaacaccccta

SEQ ID NO: 162772 - DNA, 468 bp, Homo sapiens
agtgctatgggaacacagagatgacatccaattcaatgtgcagagttcacaaagagcttctcagctagtgatgtccaggctgagataagagagcttaataggatgagaggggcttgcaagtaaagtccaaaatggcaggggagtaacaagagaggccagctcaggagaggctatgtacttacgaaccatatcaagaacttagaactttacactgaaagccttttaagtcaggttcacctattagaaagctcacttaaactgcagtaggaaaactgactgtaaggctggagaccaaaaggagatctcttaaaggtagaaggaaatgaatgtaaatgtgaagaagagaggcaatgccagctttgagatagagaacagaaaaaatatctgcaaaagacgtatctaaaaaagaactgttatccaaaatatgcaaacctggccgaacacggtggctcacgcctgtaatcccag

SEQ ID NO: 162773 - DNA, 453 bp, Homo sapiens
tttgcatggagttgggaaatcgtcatagaagtgaatgcaattaccagggtagggtgctgagtgagaaaggagctaaaggctgagccttatgcaaggaataccagtatctagtggtcagctacaggaaggtatgcctgaaaagtggagaacagtgcaaagaaatgaaagaggaaaccagcagtctggtgtcatggaagccaatgaaggagagtgaacaaaagagaaaggagggatcaataaatgccgctgaaaagatcatgtaggatgagggctgaaaatgcatgcaaatatcaaagttaaacatttactgctatctagaaattaggactgctattagttctactcagttagaaatagaggctgggcatggtggctcacgcctgtaatcccagcactttgggaggacgaggcaggcggatcacctgacgtcaggagtttgagaacaacctgatc

SEQ ID NO: 162774 - DNA, 442 bp, Homo sapiens
tcattttacaaataaagcgacttcctgacatcccccagcgtattcttagcagagccgtaactagaagttattttactttcacaacagtggcctctcacaatgtgacagaactgaaggatttgatccatgaactgactttcgtcatttatacccacaaacctttttttacagagcagattggtcagcgaatttggttataataggaaatatcagtggtagaatactttctcagatgaaagttaggagcactatggaatttagtgaaaaactcattgaagaaaataggtgtaggccgggcgcggtggctcacgcctgtaatcccagcactttgggaggccgagatgggaggatcacctgaacccgggaggcggaggttgcagtgagctgtgatcacaccattgcaccccaacctgggcgacgggagtgaggccctgtctcaaaa

SEQ ID NO: 162775 - DNA, 459 bp, Homo sapiens
gctggtctgtggttgtataaaggaatgttcgtaggaaatacatgctgatgttttcagaggaggtgggaggatgaataacagaccccaaagatacccataacctaatccctgggacctgtgaatgtgaccttccatggcaaaagggactttgcagatgtgattaaatgaaggatcctaggccagtcgtggtggctcacacctgtaatcccagcactttgggaggccaaggcaaggggatcacttgaggtcaggagttcgagaccagcctggccaacatggtgaaccccgactctaccaaaaatgcaaaatataagctgggtgtggtggcgagcgcctataatctcagctgctcgggaggctgaaatgggagaattgcttgaaccagggaggtggaggtttcagtgagccaagattgtgtcactgcaatccagcctgggtgacagtgtgagactctgtccc

SEQ ID NO: 162776 - DNA, 476 bp, Homo sapiens
taggaaaggaggctgcagactagagttcagagatgaaggaactactgtgaagatacagccaaagtatagcaattgaactgtacatgtgaaacgtatgtagctttgcctgaagaactgtttagattttatattgcagtgttgggtagaattttccccaaaacttaaaatttttatgtaacaaaagataaaatttcagtaacccatagcttataaaatctcaactctagtttgtactcacttgcctgctgcttattacccaggaaaaacagtgctaaattactaaaagtttgtcaaagatatacagacaaatgtttttcaaaataaggatatgtaagtgaatagtgtttgtatgaagtgagtttttctaacacttctgtctctcagttccacaaaccagagtcactgcctgctgtggaccctgctttcctggctcctgtgatggagccccagagtagtttgactctaggcagtttaag

SEQ ID NO: 162777 - DNA, 1015 bp, Homo sapiens
ctcttgtcccccttccaaaatgcagaaaattccccaagatttcatatttagcccttgatttttatccatatcaaagatcagttgcattcctacacttgactcatcagttttgctgatctctatctccaaccctgatgtctcacatttcgtgttgtctgctgtgcatttccattcaactatcatctcaaattcactctctgaaacagaactccttatcgctgtcctggaaaatttgccttttacctcgaatctcttatttctgttaatggcataaccctcttctaatcctacatgcttagatccttcaatgagctttagtttttctcccctagtctttcacacagaagtcagtgcatttggctgatcctttccccgaaatcttttatgtctctgatcatttgtctccatttccatagctagcaccccggtaaaagtatcataactctatgtttgaaacccctgtcaaggagctccccatgtctggagtcacagactcctcacactggtcctcaagattgtcctcagttatagatttattcctgtggggaagggcagtacaagaaccagactagattctttattcatttcacctttgttcacaagtccttccttgcagattttgagagtctccaatactatgcagtttattcaaattgttaccaatttttctcagagcaatttaactcccaagtatatgactatgctttcccagaagatgtgatgtttttttaattaagaaaaaacaaaaacaaacaaaaaacagagactgggtctcaccatgttgcccaggctggtactgaactcctggcctcaagtgatcctcctgccttggcttctcaaagtattagcattacaggtgtgagccactgcacccagcctcatggtgtaatttcttccttttagcttccatttatttagaccacttacactgcatgtactatatacatctgtgacatctgctgttttactctttaatgtttctcacgcatgcatatatagtagatagtaaatgaac

SEQ ID NO: 162778 - DNA, 878 bp, Homo sapiens
tgttcactgatggagaggggcacttagagcaagatacccgaccttgactggggaccaagcacgaaatccctaagaggtgacaggaagagagaagtctgaaacgttaagtgagttaaccagatggtgtcagaagtggaatccaaagaagagctaacaacccccaggagcgctgagcgtggttcccactcggcccattgtgcccattgctctcttggagcagctggggatcgtggctagagtacaatggcacaatcacgggtcaccgcaacctccaccccctgggctcaagtgattcccctgcctcagcctcctgagtagctgggattacagaatttgatcagagaagctgaaccactacaagcaatgttaagaatttattgctggaataccccttacacaattgagagagccagttaagctatgtgagcctgctacccctagaactggagctgggcttgaagtctgtaagactaggaaggaatgaggagggcaggaccaaagtggaacctgtgaaggtaaacttggcatccatatctgtttctcagctgaactggcagtggtatctcagcacctccaagcctccaactttgatgatgttctgcaaaagagcttgaacaaattggcaaaacatcagcccctgacatgagcagctttcagaaaaactgaaggaggagatccaggggcagtttgagaagctgcaaccaagctgctgcactatgcagatccacaagaatgtcataaactgtgtgagcagcaacagtgcgtgacccacacaggtctgagtgtaatcctggctgctggatccagttagactttaaattccatgcaaattcacttggtggcaaatcttaacttagaactgaacatggaagagaata

SEQ ID NO: 162779 - DNA, 799 bp, Homo sapiens
  misc_feature (285)..(285): n is a, c, g, or t
tgttcactgatggagaggggcacttagagcaagatacccgaccttgactggggaccaagcacgaaatccctaagaggtgacaggaagagagaaggacaaaaacagaaaagaaaaaaccaaacaataacaaaaataaaataccaaaaaaaaacaaacaacccccaaaaacactaaacaaaaaacccacacaggggcccagttgtgccctattgcgtcgtctttggagcagcgtggggagtcgtgagttttcgcgtcgttggtttcccgagggctagagttaacaanaagagcatcagtatacacgagtacagccagtcaagcctacctacccctcaaaatctacaaataaataatcccctatcctacaatcctacctagaatgaaatcaaataataaacattaatataaaatacataataaaatctaaaagctcagtgtaagcgtagattcaagtaatagaaagttaagtatagtagagtagcttagtagaataaccctctaggagtatcatatagtgaagtagaagtctcagggtagaaaagtctaataatgaggaaagtccgaagctgaagtctcttaaagtaaaactaagttaatatcttaagagttgtcttaggaggaaatttttgattaaagtaaatagtttaccttaaatgtataatattttgataaattaagtatttcattttattatttattgatactctatttatgtttggttatatctctttaattataaatttggtagtatatctgatgattttatgactttataaaatattaatttgttcttactatt

SEQ ID NO: 162780 - DNA, 399 bp, Homo sapiens
tggggatgatcaattgtttcttagtcctttgagccatctcagttaacactgtcaggacattaggcacagacaagagatcgacaggcaagagagcttttcagggcagcatgtaagcggcaatcagctataatcagtgaaaaaggttctctccacgaacgtgagggtattctgttagcttctactacagaggaaagagagagagagagagcgcgcacaatgtgaccacttttcagaagttataaataaggaacctccaggaggagccttctttgattacaatgtgctttgtcaattttcagtctgagtgctagcatgcctcttcaaagaaatgttagattagcaccactcttctgttatcccaaaaactctgtagaaattattaaatgtccttttcagtac

SEQ ID NO: 162781 - DNA, 856 bp, Homo sapiens
acagcatcagaaactggatgcctaacaagattcgcctgcacacagggactgggccatcacaatgggaagtaaccaggactggggtagcccaggaggtatgggaacttgtgcctcttattaagacctgatggtagacaaactcctgactcctcaccccccctcaaataaaaagagtcacctgcctgccttcccccgaggctatgcagtctggaatacacggatactaaacaaaatcaacctcttcttcagctggccaattgtgaatctcccaggcacaatgactgtgtggctgcctcaaaaccgtgaaaatcattacgacaatgaagaattcacataatctatgaacagcacagcaactcacgcaactcatcggcactactcacatctccaacccccacacacctagaaacatctcctggtacacaacactgtgcagcagccctcaaacaggctggagtggagagggagggataccagtctcttaaagccaactgcttcatggcagttgagaacaaacaatactgtgcccttagacttttcaaagcctaagctagtgtgattggcagctgagtgattttgggattgcagagtatggggtcacatacctgactgcacttcagagccaagttaatacctttcattgttcactgcctccagttcccactagatcaggggctcttatcaagcacctgcatcacaatctcataggtcccctggtaaaaatgcagattcctgtggcccactgaaaataaacatctgcggagtagcctgacaaactacttttaaacactacccaggtcatctttatacacatttaagtttgaggacctctgccttaaagcgatgcttctcaaac

SEQ ID NO: 162782 - DNA, 2208 bp, Homo sapiens
cctttccggtgtcttgggtcccttcctgagatgttctctgcagccttctgcatggcgttcaacatcatttccttcatcaacagtcgaggattacggtcccataataacaacagtaattaacgtttattagcatttcccaggtgctgacctttgcacccgttctcccactgatggtcatttggtttatttccaacttttcctactatgcacagtgctaaattaaaccacctgataccaccaatctgcacacgtgggcaggtacatgcaagatctgcagcagggtctggaataacgtcctttagttacaacgttgatgataaaaagttgattcccttctgcacccactgcctgtgtggagtttgtgtgctctcacgactccgtgggctttctctgtactctgctttctttcacatctccgagatgtgcacattcagtgaactggacatctaagtggtcccagtctgaccaggtgtgggtgcgagtgtgtcctgtgatggaacggcgtcctgtccaggctttgtgccctgggagaggctctagccacctgcgaccttgaactagaataagcgggctggaaaatgaatgaatacaagtaattgtcaactaaaaactgttgaagtctacaacaatcacacaaatgcatgacaataaatgatgggatccgaatgcagcctgagcccgacacttctgttcttgtttggttttgaactgtgtggtggtaggaggtgctgtggcataccctcgatagctgcggggagtggggggaaggggggtcctgaagcagaccgttcaggtgtggcttgtgcacacaccccttgacacccaagtgccacaggggaccccaaattccgtcccagctgtgcatctgcaaagctcaaatggactcttgtttcaaattcgacctaatcggtggcacagaaaagctgtgaagatcgtccccagagaaaccgagcggcagcaggccctggaacaggcagagattgtgctgttctgtcctgtccctccctttgggtgacagagaaccacgaacgtctgtgtcctcagagggtcacgggacacgttccagaggggggtggtggggagcacagtgagcacagaacatggtattttcaatccaggctgtactggcgaggagagagagtctctgtgcccagccctgctgatcccccccgctatcagggaggaactgttttcagggacagtctcaccaccctgtgaagaaggatccatttccgtcagcaccctgcctttcatgctcctccctgctgttgagcagcgtgtgctccctccctgcgcccacgctgcccaccccctgttggcatggcctctggaagctgcggacttgcagggactgaatgtgtgtgcaggtacagagtggcccagacgaggacgtgcctcccgtctgctgggctgaaaagctgtggcagccccagacccgcctgaaaagcactgcttttgcccaagaggatggacagattgtcacagctatggttatcataagtggcctgtggctttgtgaggtattagcctcagggagctgagtggagacacacaggcctgccctgtgctgtttttgcaactttcctgaaaatctaaaagtgttctaaaataaaaggtaaaaaatgccacggttggctgggcacagtggcccatgactgtaatcccagcattttgtgaggttgagtgaggcaggtggattgcttgggcacaggagtttggaagcagcctgggcaacatagcaagaccccatctctacaaaaaaatataaaagtcacacctgtgatcccagcactttgggaggctgaggcgggtggatcacgaggtcaggagtttgagaccagtctggccaatatggtgaaaccccatctctactaaaaatacaaaaattagccaggtgtggtggcatgtgcctgtagtcccagctactcaggaggctgaggcagaagaatcacgtgaacccgggaggcggaggttgcagtgagccaagattgtgccactgcactccagcctgggcgacagagtgagactccgtctcaaaaataaacaaataaataaataaaaattttgttaaaaagggcatggtggcacatgcctgtagtcccagctatttgggagtctgaggtgggaggatcatctgagcccagggaggtcaaggctgcagtgagctgtgattgtgccactgtactccaatctgggttaccttgtctc

SEQ ID NO: 162783 - DNA, 579 bp, Homo sapiens
ctgacaaactcagtaaagttgcaggatacaaaatcaacacacaaaaatcagaatcatttctatataggagcaacgaactagcaaaagaagaaatcaagaaagcaatcccattctcgatagatttttttaaaacttccaaaaacaaccgtaggaataaatctaaccaaggaggtgaaagccctctttacaaggaaaactataaaacactgatgtaagaaattgaagaggtcacaaaaaaattgaaagagacaccacatttgtggactgaaataattaatattgtgaaaaaaaccatactaccaaaagctacctacagattcaatgtaatctctacaccaatgacattcttcacagaaatagaaaaaacaatcctaaaatttgtatggaaccacagaagacctcaaatagccaaagcatttctttttttttttttctttttttttttgagacagagtctcgctttgtttgcccagggtagaatgtagtggcgtaatcttggctcactgcagcctcctcctcccgggttcaagagattctcctgccccagcctcccaagtagctgggattacaggcacccac

SEQ ID NO: 162784 - DNA, 506 bp, Homo sapiens
cgtcagtgtcctgggtgtaaacctctgcgagatgcccctgggtgtcaggtcctggctgcaccccatcgttaggactgggggcagcagcagatgagggaagacttgtctcctctggcccatggagtgtccctgtttttcagctcagccagcatcccatactcaattctgccggcgagagctgtgggcctgttttgcaggttgtgtcgtttcagcgggtaactggtatgtgtgtgcatgcgtgcaaaagaaaacatcaaaatgtttggggagtgttttaggaaaatagcaaggagcagattgccaagattcgcttatatgtttctttttctttccttttcgctgtgtacatgtgtgatcagcatcccggagtgttctgaaatacagctttggctttcttaccccaactattcttccgtatagcagagaggatacaattcaccaccaataataccgagcaataaataacccagagaagatgaatagccttgtgtggtggtaaattaaag

SEQ ID NO: 162785 - DNA, 529 bp, Homo sapiens
ctgccaatgggaatgttcagccgcaggtgcagtggctgcactcgaggcctgagctaggaggccctgcctggtgaagggcagtggggtgggagttcacagggaagagagactgggttccactctgtatggtggctgtagtgtgctggaggtacgagtaaagcactcaggctctattgcttccccagcccgagggcagcaagggtggaccccatgcagtggcaatggcagagagcccatggctcgtctctgagatttcctttttccagagaagtgcacagccaccgcagaagtgatcaagcagaggcagggcggctgtgctaggggcccagatccggaagccccgcccagtgtggagtagcagggacagagaccttgtggagagtagacttgtcaatttttcataaggcagctagctgtactgtgcaggaggcccaccatcaaatcctttagctcttcactccctgtccagcctgaaggcagtagggtcaggggctgtggccgtggctaaaatggcgggcttgtctgttaa

SEQ ID NO: 162786 - DNA, 300 bp, Homo sapiens
tacctctgacagacatccaagggaattattcttgttaatagtgttctcgtttaactttggctttagagatgatgttaaaaaaagtttgttcctctcctgattctctcaagtgaaatagaatcatgattctctcaagtagaatacaatagtttctcactctgttagaatagttcttcacataattcatacaatttattgttatcccttgttagatatggcatggcacagtattattgtaataggatacttttatcagcagcaaggcggaagttcacgctcttgtttttagcaaggctgata

SEQ ID NO: 162787 - DNA, 130 bp, Homo sapiens
cagatatgaaaatgattgattatattacagataagataaaatgccaaaaaaagtctaagaaatcagctgacatcatggtagacgattaattatgaccaagggatcaacgagatgacatttaaggtagaca

SEQ ID NO: 162788 - DNA, 322 bp, Homo sapiens
cacctacgatcggttcactttcggattgcgaagcacacaggacagaatggcgttgctgcaccatgaggatggctagacccccctgagggagcgacacagatgctgaagatgtctaaaccccccctgagggagcgacacagatgctgaggatggctagacacccctgagggagcgacacagatgctgaggatggctagacccccctgagggagcgacacagatgctgaggatggctagacccccctgagggagcgacacagatgctgaggatggctagacccccctgagggagtgacacagatgctgaggatggctagacccc

SEQ ID NO: 162789 - DNA, 151 bp, Homo sapiens
gaagcaggagaatcacttgaaccttgggaggcagaggttgcagtgagcgccattgcgcttcagcctgggcgacaaagcgagactgcgccttgccagattttttgttttagaaaatagccttcctaatgattgtgaagtggtatcttgtaga

SEQ ID NO: 162790 - DNA, 536 bp, Homo sapiens
gtggttttcccacccatctttgttgttgttaagcatctgttgagggctaagtgctggggtaaatgcctcacctatatcacttaactcttctcagtctactatgaagcaagtattttatcattactctgcagacaaggaaatagaggctcagaaacattatgggatatgcctaagatcactcagcaggacagtgatgggacagaatcagaactcgggactgctagcctcaaggctgtgctctcaggccacagtcccccagacaagcaccctagtcagactatgaccaaccaaccctggagacccagggcccaccccatggggtccaccacatctctgggaaagctgcaggaggcagtggccaggccagaatatcccatgccaggcttcttccatctcactcttccctagaccagcctccagcactgaccccagggtaccctgctgccttagccctttcccatccaggaattagcacctccaacccaagaggcaacctgttgattccagaacaggcagaccgccaatgagaagacagc

SEQ ID NO: 162791 - DNA, 545 bp, Homo sapiens
tgagctacccctgaagccgcgaggtcatgggactgagggggagtcgttagcatgccctgtggggacaagcagccaggcagtgtggtgcttgccatcgctcttccctctggctgtaagatgaatgggtagcaggctgctcatcgccctccaaccagccccctccccagctcctcccagcaggccttgcagttgcatgggcattcccttgccatggcagccctgccccacaaggacagggtatgctggtcctcttatgggggtggcagatgaggtgcgtgcccagtgacgtccctggcctgtgaacactctggttctggccctttgaacttccacctgactgcaggttggagaagagagatggggaaagcctgacctggccttccctttcttcttcagcgtcagagtgcgtatctctctccccctattggtgaacagaagcaaagccatcacccctgcaccccaagacctcggccaccatagccaaaatgatgggtgctaaatgtactgggcaggaccatgtattccgtggttttaaacttacttag

SEQ ID NO: 162792 - DNA, 491 bp, Homo sapiens
tttaaaagagctgatgaaggtaatgtgaagtcattaaggtggttcttaatccagtatgactggtgtcctcctaagaagagattaggacacagacgcgcacagaaggctgcatctacaagccaaggagagaggcctcagaagaaaccagccatgtgcacagcttgacccaggactttcagcatctcaattgttataaaataaatttctattttttaagccacccagtctgtggtactttattatggcaaccctagcaaatgaacacaggctataatcctattctgtatataacatgaaaaaatgtataatttaccatctttaccagttttaagtgtacagttcagtggtaataaacacattcatattctttttctcccccatcacctcctccccttctttcccagtctctggtaaccaccaatctatcttcatccaatccacttttttagctcccacatatcagtaagacaacatttttttttacagaaaag

SEQ ID NO: 162793 - DNA, 285 bp, Homo sapiens
cacaaataaactgcagcaagtttatggtccatagaaatatcttcccagagcattaacactttcatattcatgagttcaatggattccaataataaacatgtgaaattggctgtgcaggtttcatgcgattctgcagggaggtgggaaacaggagctaagtgggttgccatagctacaaagacatttgatgtcagctctgggaccaaaacctacttcaagttctctacatcagccagtccctgacccccaactcccaggatctccactccctgtgacagctcttgc

SEQ ID NO: 162794 - DNA, 499 bp, Homo sapiens
agatggaccggtccatgcccagttgagaatattatcttgatctactaaataaatagattttatttccataatgacttatttagaattaaaagcgaagccctgagttatatatatattaaaaaaaacttacatgcatttgctagtcaggccagtttaacttatgtgagagccaaaaatcttacataattattaacagtttaatgatgatagattattgattataattaaacctaggctgtcagactaatcaatggtaagtttagtcttaggccttgagttgctaggtcagatctggttttcccaggctgatatttcaaaagtcttacagtcttctttggttgagaatccttcacttttccagttactccaaaggagacctcagtcaggccaaagtttgatggaggtcaagttaaaatttaaaccatatctggaagcaaggtcagtgcagcaaaggcacattctaaagcattacttcatataccttaattcttccggaaac

SEQ ID NO: 162795 - DNA, 252 bp, Homo sapiens
cagaaatatacctaacactgactgtgctgacttacttagcatcataacttaagatacaaggccagaagttgcatcagaatataaatgaattcaccacaactggcaggaaagtatctggatagtggattgtggctcatctggagctgctcacaaaaagccttttaaaagagaaagatggtccatcttcttccagtgaagcttgtagaacacttttcctcagaaaatgttcctattagcttttctccaactcag

SEQ ID NO: 162796 - DNA, 397 bp, Homo sapiens
aaaataaaaaataaaaaataattttcacctatatatgactgtaatgaagggaaaaaaataacttcaggattatataataaggagtctggaggctggaggctggggtggtcagagaaggcctctctagggcagtgagccaaaagatgaagtggcagctatggagaggactgggcacagaacattatagatgaaggggccagccgcatgcgaaggagcttgtctaaggagctgaaaggaggccattggggttggagctgagtgaatgaaggagagaaggtgggcaggatcaggtcaccaggggcactgcaggtcttcataagaccttaggtgtctacagtaagctctttgagggttttaagcagggagtgcactatcttattgaggtttttatttactt

SEQ ID NO: 162797 - DNA, 436 bp, Homo sapiens
  misc_feature (61)..(61): n is a, c, g, or t
agctgttcctgatgtacccgccctgcgcagaccttaccggtctctgaattggataaacctncggcacctatatatgactgtaatgaagggaaaaaaataacttcaggattatataataaggagtctggaggctggaggctggggtggtcagagaaggcctctctagggcagtgagccaaaagatgaagtggcagctatggagaggactgggcacagaacattatagatgaaggggccagccgcatgcgaaggagcttgtctaaggagctgaaaggaggccattggggttggagctgagtgaatgaaggagagaaggtgggcaggatcaggtcaccaggggcactgcaggtcttcataagaccttaggtgtctacagtaagctctttgagggttttaagcagggagtgcactatcttattgaggtttttatttactt

SEQ ID NO: 162798 - DNA, 259 bp, Homo sapiens
tggggggtaccggcgtaagcatggggccctcaaacattgaaactgactgaggccaaataggcaggaggatatgggtaaagccaggtggatgggcaggggtggcactgagaagatgccataggctgaaggcagtccctgaggtcttctcacctacctaatctgcccaggcagctgaagctgcactgtaccacctcccagattaagtgagtgagcacagagattagaatcacgagtaaggggctcagtccttgccttcagg

SEQ ID NO: 162799 - DNA, 306 bp, Homo sapiens
atttttcaaacaataataaaaactagcctttccctctgttagcttaaatgagtgatatttagctattttggagacttattattattatattttaaaaggcagcccaggaatttgcaatgctcagagcctcttcctgcacatgcgcccctggtcttggcctgtggggaataagggaggggacagtgagcagcatacccagatggattccttaaggtcactcacccagcacgagaaaagcaggtctcttttcatatctttaaaggagaaaaacaaagtagagagaaccccaaatacccaataatcccc

SEQ ID NO: 162800 - DNA, 358 bp, Homo sapiens
cggggaacaatcacttccatgagccaccatgcctggccataactgacttttatgatgaaaccagcgtagtttttatagtactttacaggccagcgaacatagtaattagaacctcatggaagtgattgccaaaatataaaaattagaaaaaaagaaaactgtatctttgtcttttactccataccagggtaaattcttgatttttcccagagttcaagataaaaaaggaaaaccttaaaaatactaggagaaaacatcggtcaatataaaaactcttgggtatggggagggctttcacaagaagccttatagagaaatatttataagtgtgcctgatttgtaagtaagattgttctgt

SEQ ID NO: 162801 - DNA, 167 bp, Homo sapiens
ctcttagcaacaacagtggccagatgggagctgagtcttcaggtggcatgtgggaatcagcagaaaacggcagcgagtgagaccaggtgagaattcatttaaacaaatatgctttggacttatcatgtatgcttacctgattctttgggggataaagagataaagtt

SEQ ID NO: 162802 - DNA, 942 bp, Homo sapiens
tgagtcacagggctgcttcaaggagcacaactgaggccaggatctgcaggcctgcctccagggtcatggctgggtgtgtcttcctgcaggtctcttgatgggaaggaccatttctggactacagctgagattgagaactgcttcataatcctcagtaagaccaagctgcatgcaccattttcttgtctgtagccatgtctatgggctctggagttggccacctgggtgagggcctgctttttccaaataacccttccttggtctttgactccactgaggtttcacaaccctaactataggcaagcaccattctacttatgttttctaggaatttactacttaaaatatcttatgtaagtggaatcatacattgtcactttgttagtgtcttattaaataatggtgtctaaatagtgtcttattaaaataatggctttaagatttatccttattgtatgatccgacaagatattttcatttgattctaaagaatttttcattgtatgtgtaagccatgtaggccacatccttttttgtttgtttgttttttttttgagatggagtcttgctctgtcacccaggctggagtgcagtggcgcaatctcggctcactgcaagctccacctcctggtttcacaccattctcctgcgtcagcctccagctgggactacaggtacctgccaccacgcccggctaattttttttttgtatttttagtagagacggggtttcaccgtgttagccaggatgatctctatctcctgaccttgtgatctgcctgccttggcctcccaaagtgctgggattacaggcgtgagccaccgcgcccggccaagccgcatccttttaaattattcatctgttgaaggatgtttgaggtttttcactttttggcttttgtaagtaatatggtttggatctgtggcgccattcaaatctca

SEQ ID NO: 162803 - DNA, 461 bp, Homo sapiens
aatttattttcctgcatttgctacatccatctcctcaaaaattctgatataggcaggtagaaaccaagaactgaggaaaacacaggcggttcataaatgggtcaacttcatttctagcaatatggcaactagagacaaagcctggaactgcagcacaatgcaaacttgggtatatccccgattccaggagctcttggtggatgaactaggagaaaacccatcccactgattatgatatgcctactttggtattggttcaggattggaaagaaaaaaggaaagcagtatcccctgagaatttctaatcttaaatccaaaaccatccagatgaagggctggaattcataccagctctactacctaaataattctaagctagaagtgtagtttaaaattattccagattattccactgcactccagtctgggtgacagagcgagactccgtctcaaataaaaaa

SEQ ID NO: 162804 - DNA, 509 bp, Homo sapiens
ggctcaagtgatctttccatctcagcctcccaagtagctggaattacaggcgcatgctgtcacatccagctaattttttatttttcgtagagacagggtctcattatgttgcctaggctggtctcagactactgagctcaagcaatccttccacttcagcctccctaagtgctaggattgcaggcatgagccactatgcctgacctcagaaattttaatttgaggaaatgtagacaccatttaggaaattgattgtggttttaggatcctgcactctggcaacaatagtaggctttgagagatgaaggatgtgatattcgatgaactgcatgagttaaggatgaatctgagatagaggttctgaaacttgagtgtgtattaggatcgcctaaggagcttggtaaggttctgattttggcaggttgggtaagaggacagaaattgcatttttaaaggcagtctcggcatttctgatgtaaatggtaaacaagttcctagccagagacacc

SEQ ID NO: 162805 - DNA, 409 bp, Homo sapiens
ccccttttttacagaagaaaattatttcattccctcctctttcccacctctctctctccctgacttgctcatattagagatagaggcaaatgatcagagtaaattcgttgtccaatagtaagttcatggtattttctcactatcccatatgtagtgaacaataataccttgctcttgcacaagaatcacataactaatagaatcaatataattgaaaattgatatttaaaaattatgaactcttaaaaatcatggtttataaatggataaccaagtaatttttgttggtttctttttaaagaagataataaaggtgtacaaaatacatatttacttactttttttttttttttttgagatggagtgtcactctgtcaccctgactagagtgcagtggcacgatctcggc

SEQ ID NO: 162806 - DNA, 321 bp, Homo sapiens
ctcagccaccctgagaagagagaaggtaaattttgcgatccatttgcaaatcaagctagaatgtattttcagacctgggtgtgtattcagggcccgtctatttccttctaccattaaacctgcgaggacgaaagtaactcaagttcattgttctccaccacgtaatctttcttcctatcctggattgtagcgggggcagctcagagggcatgtcaagaaggaaggaaggggaagggctatacaggatatggtgctggggcacacagtcagtgctttgggtgatcaacatcaacgtggtggtcctgggttaggattttgagg

SEQ ID NO: 162807 - DNA, 790 bp, Homo sapiens
aaaattgccttagcatgtcacaccagcatttgtcatccagctctggagaaatgacatgactgttagatactatgcctgtttaattgcctctggattaagtcattgatagctagacttttgagctagttagctgtagaaataatagaatccagtgtttcccaaagtgtgttccaaagaacacaagttccaaagatgctcttctaaatataggattctaggatgaaataagtttggaaaacacataccatcttagaaagttagtgaacatgagcacatcaaaggctctaatttaaatgtcctgtgaggagagaaaaacacaacaaatatctactgtcagttagcccagtgttttccagattaatttgaccacagaaacttttttgagtggcacctagtaacactgcaaggaacttgtgttctaaagaacaccctttgggaaattctggtatattgaaatattgctgtgttttcattcacgatgactcttagtagcagtacaatttgcaacttagaagcatgagcctttcatatatgaagctgacttgttaataaaagcagtgttaagaagtagtatgacttaatatgaccaacagcagcctcatattgatagcagaacaatcctacttaaagctctaaacatcatccccccctttttttttttaacggaatctcgctctgtcacccaggctggaatgccgtggcgcaatgtcaggtcactgcaagctccgcctcccaggttcacaccattctcctgcctcagcctcctgagcagctgggactacaggcggcc

SEQ ID NO: 162808 - DNA, 144 bp, Homo sapiens
aaggaagataccctcatcaacccaattttacaaatggagaaatagaagttaagggaagaatctgaagtagtctcaaaggcagtgacaggaaggatgtggagaaagctgagtgtcaaagtcagtattcaggaccggctttactgc

SEQ ID NO: 162809 - DNA, 221 bp, Homo sapiens
atgtgattaagaggaaatgaattttaagctgagaactgacatatgagagcatgtaggtagggcaaagagtggagaagggcattctaagcagagtgagcagtatgcaccaaggcccccaagtggaaaggaatttggggtattagatgacctcaaaggtcagtgtggccagaacatattttgattactgaggagtaagatgaacctggagagttaaggaggaa

SEQ ID NO: 162810 - DNA, 153 bp, Homo sapiens
cctagactagtgatatgctctgctgcagtaaatgattcaggcttcagtcaaaagccctaaattcagtttggaaaaatattgagtgtttttcaataagccaggattaatgcaaaagccaatttgcaaccacagttggtgctttttctactcctg

SEQ ID NO: 162811 - DNA, 367 bp, Homo sapiens
tttaaaactaacaattctatttaaaatttagaatccccaggtacattttcaactcagttatttttgtcaattaattatgagtctaaaattaattaatattcacacaacattaaaataagattcctctgtcaaaagcaggccaaaattatcaccagtagataaatataagctccaataatttagcatgagaaagtctgtagggcaggttttgtaaaaatggaaatttcaaacaatgcaaggcaaacaccaccaatctcaatactgtcaagactgtgtggatactgaaacctgctcttagaagtataccacactcctgagatacagagccagttggttaaggagcgtaagaagagatcgaggtcttgag

SEQ ID NO: 162812 - DNA, 301 bp, Homo sapiens
tggggatgacatgggtggaatctcatgctgacctttaagaggtatgctatcccacctacaaggggacactgggttcttgaggccaccgtcacaggcatttgtggaccctgaaaacatatcagggctctatgagaactgaaagattgttcagcaaatagctgatcccttctggagtctgtggatggcactgaggaccaaaaatccaaacaatactcatctatctgtccccctttcatgtcccacaagaggaccccacaatcttcataggtaatgaaactgcaggaattctttcattgactta

SEQ ID NO: 162813 - DNA, 768 bp, Homo sapiens
gatgctttatctccagcctgctccctgcccacccccttccttccctggtttatggcattccatggcccagagttaggcactcctgcccacaccccaaacagtgccttggccgaggggaaggagaccctctcccttggagggcagggccctgcaaggctgccacagtgatgagaaaaagccgggaggttgtatcggccagcctggcatgccgcctgctgggagagtatgcaatccaggaatccaggcctcagccaaaacatcccttccacacccagacttccatccacccatggaccaggcgccacgtcctaactgtgtgaccttgggcaagttgcttcccctttctgggttccccccatctgtaaaatgtggaccctaacagtacctacccccatgatgttattgtgaggattacatgagttaatactggcaaagtgcttagaacagggtctggcacatggcagctacaatatcagtatttgttggccgggtgcggcggctcacacctgtaatcccagcactttgggaggccaaggcaggaggatcacttgaggtcatgagtttaacacaagcctggccaatagggtaaaaccctgtctctacaaaaaatacaaaaattagccgggtgtggtggcacatgcctgtagtctcagctactcgagaggctgaggcaggaggatcgcttgaacctgggaggcagaggttgctgtgagttgagatcatgccactgcactccagcctgagtgacagagtgagactctgtctcaa

SEQ ID NO: 162814 - DNA, 145 bp, Homo sapiens
aaaaatcagtggttataatgcaaacacacacaaaaaggcatatgcccattactgcattctactccatactgtatgtgtatttgagttagtataaaagttattttaacattgctcactatttaattaattctcccttggaaactga

SEQ ID NO: 162815 - DNA, 348 bp, Homo sapiens
attgcttctcattgtctgtctccccacatcctcccattagaatgtaagctccacgagggaaaggatctttgttttgttattcaacgtatcccaagtgtctagacctgtgtctggcacatagcagttgcttgataactatttctggattgaataaatgaatgctgggctgtggtatgcaaaaataggatcactgaaatttcaagtcctggtggtttaatttgcagtgctgatgttatttttctcattcattggctaattttttcttttcttttttttttttgagatggagtcttgctctgtcgctggagtgcagtggtgcaatctcggctcactgcaaactccacctcc

SEQ ID NO: 162816 - DNA, 601 bp, Homo sapiens
agacggataagcaaattatgctctagtcacaaaacagaataccatttagcaataaaaaagaactagttcatgccaacaacgtggatgaatctcagaaaacaagttgtgagcaaaagaagccttataaaaaagcacatactataagtcatcacactacatgattccattacgtgaggtctgagaacaggcaaagcaattcatggttacagaaattagcagctgggcgcggtggctcacacctgtaatcccagctacttgggaggcggaggtgggaggattgctttaggccaggaatttgacaccagcccgggcaacagatcaaaatcctatatcaacttttaaaaagttgatgtttgttatacaaaattagcacagaaatgtctagaaaagaaaatcttgcctgtaagcctatcatccagtcatacttagcgctaaagaaaacatactcctgatgttttctctaccagtcttttatctataattatgtatcttttttaaagtcaaagttggagtagtatttccagttaactttttggctgattattttctgtaacacaaacggaatgaatgtttagcataataatttagggtgaagattttc

SEQ ID NO: 162817 - DNA, 396 bp, Homo sapiens
atggtcatagctgactctagaggataaaccgaggctcaagctgctggatgctgtcttctgattccattccatcaaggtggtgccgccaggaagacaggtaggtcaactctccatgaaccagaatgtcagtttctccagtgagcctcattccccacctgcagcatagggtacctgtggaccaactttgacactaatatttcactgctcttctgtgagccatcagtcctcccagtgtccctttgtgcctgtcagggagagggctacacaacaaggaacccaaatgaagtaccttccaagactgattacaccaaaacaagattttctaattctatatgatcagctaaacaaggaattttttttccttttttttttgagatggagtctaactctgtcacc

SEQ ID NO: 162818 - DNA, 443 bp, Homo sapiens
tcatgctgcaaatttaaaaatgtttcagatccgctgttctagaaaaacatgcctaaaccaaacatgccctatccgtgtctgtgcagactgctggatgctgtcttctgattccattccatcaaggtggtgccgccaggaagacaggtaggtcaactctccatgaaccagaatgtcagtttctccagtgagcctcattccccacctgcagcatagggtacctgtggaccaactttgacactaatatttcactgctcttctgtgagccatcagtcctcccagtgtccctttgtgcctgtcagggagagggctacacaacaaggaacccaaatgaagtaccttccaagactgattacaccaaaacaagattttctaattctatatgatcagctaaacaaggaattttttttccttttttttttgagatggagtctaactctgtcacc

SEQ ID NO: 162819 - DNA, 467 bp, Homo sapiens
caaggtgacataaaaaataggccctgcaatgggagtgatgacattttaaatacttggtgtcaggaaaaccagaaacctgtcaccaagcatttagcatcgcctctctttttggtcttatcttctggggcctcaaacaatgaaactgtgttaatgggaggtcctcacagagcgaatatgcactggccggttttggagacatgtagtcaagtggtggaaaacggaactggaaaggtggtatgggttagagttaggaggcttaaacaaagacatctagctttgatgtggtaggcagcaagcagccaatgattatttctgagcacagaaatgaaagtaagttctgtaaaaaaaatcacaaacaaaataaaaatttaagttggttcatgatgtgatgctggttgctgggcattttggcaaagttctccaaaggtaacaactttcacaggcaacagttttttggatctgatctt

SEQ ID NO: 162820 - DNA, 419 bp, Homo sapiens
aggcgggcaaaaactcccaaatcccctcgctgctatgttcgattctcctaatgagatacactcatgggatatttggaaaacaaaagtgggcagagggaatttttcttgagcagggggcgtggttatgtgcaggcttcagcagacacaagtttgtgcagtagccagtctctgcagccccctctattcccctgcttcagcgtgaagtagctgtgaggttggcataatttttccttcagggttcccaccttggagtacagatgctgtgatgcctgatatcaactctttgacttctgcagtggcagccattcctgtgcccatgttagtacctatttctgcttgaaacaccaagagtagtttctgatttgtgcactgatttctggtaaaagtggtgttccctgcttctctgcgacttgagtctg

SEQ ID NO: 162821 - DNA, 503 bp, Homo sapiens
tattttaaaataaaataaataaaataaaaatacccaagtctggacagaaagactctgttccagtaataatatcattcatgtatcacatatttattattacatgccagtgctacataccaggcacaatagatgacttctctgaccttccatctattgtgcaatgtctctgggaaaaggcagccactggaagccaggagcagtaggtaggaagctgcagtggtttctcttgagaccaagcaaagcggcagtgcctacagagattctgcaatttgaaggctatggagagaaaaacatcaaaggaagagccatccccacttctctccctcaaagttatacaaggatttcttttgcttctttggtttgttttggttttggtttctttcttttatttttttttggagacagtatcactctgtcacccaggcagaggttgcagtgagctgagattgcaccattgcacttcagcctgggagacatagcaagactctgtcccacctcccaaa

SEQ ID NO: 162822 - DNA, 185 bp, Homo sapiens
tatttacatttttaaactaagactaaaggttgtttgaaaggtagattttttgggagctttctgcaataatctctgaaggcatgcactttggtttggactgagaaaaaattataggtgaggaagaaggggagatcaacaatatacatctcctcaatagccttgtttttaagggaagcagagaatgg

SEQ ID NO: 162823 - DNA, 423 bp, Homo sapiens
aattccctgggtctgcaaaatgctacttgtggtgtggctggctttgaatctctgtggtttcagtcatcctgcatatcctttcctgtattcaaaatgctttctatcccttgcctcaagttttaaaaataggggcccaattttagcatttgcactccacagaaaggctgcaaattaacagtgtttgtgttgaccttgcatttgaaatgataaaaataaaactggggttatattctttgctcatgcctattcaaatttatataatttgttaattacataaaatgtttttagtctcctataaccaggcaaaagcaccatgtaaacttatcaaaaaagcaatttacccatacaacgttgtttcctatctttaaagctttgtttttatagctaataagtgtaaagatgttgctttgaatcctttggcat

SEQ ID NO: 162824 - DNA, 203 bp, Homo sapiens
acagtgaccagagggaactacaaccgggcagagggaaccacaacaggcagaaggaacagccacaggcagggggaacagcgaccagagagaactacaaccgggcagagggaaccacaacaggcagaaggaacagcaacaggcagagggaaccacgaccaggtggagagaactgcaacaggcagagggaaccacaaccaggcaga

SEQ ID NO: 162825 - DNA, 281 bp, Homo sapiens
gtttaaaaactttttccaacattacatctatagacggtagttttcttatagagctttatacaaacttttaattttgctctgatcttatttggcactcaaataagaattaaatgtaacaattttttttaaaatgagtatttaaatggaagagaaaacatccctaaattttgttttagaaagactgatgaaatgggatcattctgttgggtcttatagatggcctatttcttttagttagtgatgcaaaacttcttgctagagcccagttctaatgtgaggta

SEQ ID NO: 162826 - DNA, 902 bp, Homo sapiens
ggtagacacagccccatttggggaatggagaggttttcagcctctgctcaccgccttggctgggcatccatatgtagtcagcaacctacacaactgtacgtggtggtcatgggtccttgtcagtgagagcctctgttttagtctatgttgtgttgctataaaggaatacatgaggctggatcatgtataaagaaaagaagctgatttggctcatggttctgcaggccatgtaagacacatggctccagcatctgcttctggtgagggccttagggagcttccactcttggcagacgggaaaggggaagctggcatcccatggcaagaggaaggaagcaagagagaagggaggagataccaggctttttccaacaagcagttttcatgggaactaacaaggcgagaactcactcatgacccaaggacagcaccgagatgttcatgagggatctgcactcaggacccaaacacctcccacgaggctccatctccaacactggggatcacatttcaacgtgagatttggaggggacaaatatccaaactgtatcaccgcatgcacaggtggtgtttgtaattattgaggaggtgtgttgccatgttagaaacaggccagcactggctgggcgcagtggctcatgcctgtaatcctagcactttgggaggccgaggtgggcggatcacaaggtcaggagatcgagaccatcctggctaacatggtgaaaccccgtctctactacaaatacaaaaaaattagctgggcgtggtggtgggtgcctgtagtcccagctaatcagagactgaggcaggagaatggcatgaacctgggaggcggagcttgcagtaagccgagatggcaccactgcactccagcctggacgacagagcgagactccgtctcc

SEQ ID NO: 162827 - DNA, 111 bp, Homo sapiens
tgagactggggagggacaaaggctgctctgtcctggtgctcccacaaaggagaagggctgatcactcaaagttgcgaacaccaagctcaacaatgagccctggaaaatttc

SEQ ID NO: 162828 - DNA, 557 bp, Homo sapiens
caagtaaaatcaagttgcattaagaattatggaggaaagaaaaaaaaggacaaaaatcaattcaacaaattctacttcataggaaagtttggatttttctttaaatcctatttgtgccttttaattttctaccagtgggttttaggtcattcatttgtaatttttttttcaatttgggttaataaagaaatcatgcaataaatatccttcattcttggcattcaatgctcaaactttcttgctaattctagagtcccacttttgcaataaggaaactattcctgacagtccaaggctacacaaaagaaaaccactgaaagggtaaggttgctctctctgtttaaatcactaacactgttacagacgatgtcaataagcttcttctgtagcaaaaatacatgagtgtttttttgtttgtttgttttttgttttaagatcagatctacaattaaagaggcaatgtggctgaatgaattaatctcaaggctggaagccaaaagttttaaactgcaaattcacctctgccaattactttctgaccaactctgacaatcttc

SEQ ID NO: 162829 - DNA, 368 bp, Homo sapiens
  misc_feature (348)..(348): n is a, c, g, or t
  misc_feature (351)..(351): n is a, c, g, or t
gtcttacgagatttctagaaatcactattaattgattttaactagctttataatctcccccagttactcaaggcttttatttatttatttatttatttagagacagggtctctgtcacccagactgaagtgtggtgacgtgatcaaggttcactgcaaccttgatctcgtgggcttaattgatcctcccacctcagcctccgaacacagcagagttaatggcaggttggctctacttcatcagaggttctggaggaggaaaccaagatcttccctgaaaggcaagatctggcatgtgccaccacactggctttttttttttttttttttttcttttttgggtcgtaanacntacccgcgggacgactc

SEQ ID NO: 162830 - DNA, 353 bp, Homo sapiens
gtcttacgagatttctagaaatcactattaattgattttaactagctttataatctcccccagttactcaaggcttttatttatttatttatttatttagagacagggtctctgtcacccagactgaagtgtggtgacgtgatcaaggttcactgcaaccttgatctcgtgggcttaattgatcctcccacctcagcctccgaacacagcagagttaatggcaggttggctctacttcatcagaggttctggaggaggaaaccaagatcttccctgaaaggcaagatctggcatgtgccaccacactggctttttttttttttttttttttttggtagagacaaggtgtcact

SEQ ID NO: 162831 - DNA, 226 bp, Homo sapiens
gcggcagcctgccttaagtcagcacacctgccttcgaatgtggcggctctggctcgtggttcctgcaactaccaaacagcatgacacaaataagagaagaggaggcaggaatacccttctaacccgcctgcctgccctgccaggacttctttttttgtttttgttttgttttgttttttgagacagagtctcactcggtcacactgtgtctggagtaatggcgcga

SEQ ID NO: 162832 - DNA, 182 bp, Homo sapiens
cagtgcagatgtggaacgattccaatttaattttagtaggaaaaaaaaggaaagagggctgccaatggctttggcttaaaaccataattacttttaaaaatcatttctatccaaggcagataagatttaataagaactgaagcttgtatagttgtttatttgggaggaagggggtagtgctt

SEQ ID NO: 162833 - DNA, 216 bp, Homo sapiens
aaagctgggtgagttaatgcctggggatagaggtttttcttagtcttctgggattcagaggaagagttccaattgtaattagaagcaatgatcttggcatgtactagaacccattagtctagttttaattttacttttataaacccttctgagaaattaaagctccatctcccactttgcacaattttgacttaagtacaaggaagggctcatgtt

SEQ ID NO: 162834 - DNA, 510 bp, Homo sapiens
agcgatcattttgagaagtgtagtggaaggagagagagaaaaaatgtgggtagttcctagatatattctaatcaatcttaccattcagatcatgtccaaggccccaaggtatatttctcaagccccatgagagtagaaagaatcccctgaaaactttctgatagattgaatgcagatagagaaaatgaaaaaatcaagaataacactcagatgtttggcatgggaaaacagatggcaggtggagccattttggggatagaggcaactgagaaaagagtgtgttggtgaggagtgtgcagggaggagggtacttttttagttccgtactaaggaaactaaatttgagatagctattaaacatccagatttagatgtcaagtaggcaactggatacaaaggtctgcacttttgtctagtgaggtcaagactgaggatataaatttgggagccatgaacacaaatgatctttaaagttctagaactggatgaaacatctcaataagacagtgc

SEQ ID NO: 162835 - DNA, 367 bp, Homo sapiens
ttgaagcaaaggaacagcaagtgcaaaggccctaaaacaaaaatgtgcctgccatgtttaaggagcagtaacaaggctgaagagtaaaggacaagtgggaagaatggtaacagaggccagatcatactggtgaccatggtaacaaattggcttttctccttttttttttcccccttaagacagggtctcactttgtcactcaggctggagtgcaatggcgtgctcatagctcactgcagtcctgaacttctgggctcaagtgatcttcctgccttagcttccttagtaactgggactacaggcatccagcaccacgcccagctaagtttttttttttaagagatggtatttcattatgttgcccagg

SEQ ID NO: 162836 - DNA, 288 bp, Homo sapiens
ccccctccccgggtactaactcccaacagaggtaaccactattcagttctaacctactctggcttttgtcaccatagtttagtttgcctgtccttaaacttcatataaaaggaatcatgtagtatatatactcttttggatctggcttctttcactcaacattatgtttctggaattcatccaggttattgtgtgaatcagtcattccttcttttttattgctgcatagtagtctattgttagcaggtagtaattttttttttttttttttttgaaatggagtttcac

SEQ ID NO: 162837 - DNA, 647 bp, Homo sapiens
agtacccttagcatgcttgtcattgtttaggagctacccagagaaatatggcctttctgtgaacatggtggtgaatccatagggtggaactgtcaactatgctccaaatagtagtagtagtggtagttgttgttgttttaaggagatttgagcagtccacctccatggcaaccccataaagtaatttaaaaaaaaaagaaccaagttggagagctcatcctccaatttactaatcttgcttttatatttcaagacctactatagctatagtaatcaaaatagttttgtgttggcaaaaaataaacatatagattaatggaacagaacagaaaatccagaaatagacccatgcatatattgccaatttttaataaaagtactaagacaattcaatttgaggggggaaaagggccttttcaaaaaaacggtgctggatatatccataagaaagaaaaaataataaccctattaacccttacctcataccatatacaaaatttaactcaaaatggatcatagacctacatataaaacctaaaactattacacttacagaagaaaagaggaggtgaccttggagtagacaaaggtctctcagaacacaaaaaaagtaggagccataaagacacttgacaaacttgatcaaa

SEQ ID NO: 162838 - DNA, 540 bp, Homo sapiens
  misc_feature (145)..(145): n is a, c, g, or t
ggagtattgggggttatgatatcactcggctcatcgaagctcacagaatatgtaaggttctggcacgtccaaagatgttaggcaaatgtaagtagaaggcgcaccgggcgtgacacacgtgtttcatcgatacaaagtcttctgngcattccttcattcattccaacgcttcccaggcatccaggatgcgccgagcgcggtttcagctcacagtgaatcctacatcctaggaaacaagaacatgtcaggagttgggaagatcatgaaaacaaagctccctgttacaaaataggcagcaagcaggggccagagatacaacccacttcactccctgcccacttctgccctctccagtgctttctcaaattgagatattaataaaatccacaaaacacagaatcagtctttaacagtaaacaaacttagcggcattgagtatgttcatcatgttgtgtgaccatcacctctatctagttccaaaacatttatatcaccatccccccaccaaataaaacccagatccatcaagcattctcccca

SEQ ID NO: 162839 - DNA, 512 bp, Homo sapiens
atgtagacttggacaagctacttaagcttactaagcttcaatttccttctctgtaaaatggggataacagaccttatctcatagggtgattatgagcattagatgaaatcgtgggtgaaaggctcagtacagtgccaggtatacaagaagcattcagttaagtaatagctgttattgttataactgaggttttcacaagccgcacacttttgctcctgatattttttcttaccatgacagcaggccattgtttggttttctgtgctgagggaagcagaaagttaattaaaatggaaacccccaccaagtgacaagttgagagagaaaaatgatcgttcacatgatgcataaaaaaagaataaaaggtcttttttattagggaaaatttcaaacatacaaaagcacaaagaagagtgtaaggaaccctatatcatatcccttggcttcaactatgactgaaacgcatggctgatccgtaaccccatggtcaaccccagattacgtgcaagtac

SEQ ID NO: 162840 - DNA, 459 bp, Homo sapiens
caggcacccccacggcccatgtcacccggccgtggagagaactgcctgtttagaagtgacatttcgggctctcctgcaccgtgaagactgtgaactcattcagttcactgcttcaggggctgctggtggaggctgtgatggaggagacctgaggccggggggtggggcctccctacacctgatttgatggacagctggggtttggtgtcccaggagcagagcaggctgtgctcagggtccagctcagcaactgcacccactcgaggcagttccttccccatggagaagcctttgtccatgggagagtctaggcctgtgtccccagctctgtccaggtgagaggcacgtgccaagaacctgcaaggcaggtctgggccgcagcccagctcatgaggttccacgggaagagtgatgtgcaggctcgggagcgtgctctgtggtgaggccctgagtgtcagc

SEQ ID NO: 162841 - DNA, 1198 bp, Homo sapiens
ctcctgacctcaagtgtgccgcccacctcgaccccccaaagtcctgggattacggcattaagatactgtgcctgcctgagtttgtaaatttctttctttcttttgttcgttttttggaaagaagaataagagatgaagaaaaatcagactggaagagggttgttttttcccttttgtagttgcaaatcctaagtgggcagtggtaaatttctagaatcatttgtagcattctgttttaaacttggcaatttaaagatgttataaatgaggagtccccagaaaatggtcatttcattatcaaaagcagggttgcaaatttcagattgatcttttcaaaagttagatttgtacttgttctcagtgttcctatctctggaaactaaagaacctcctccattgttagctgaaaattgcacagtgaatttgaaagtcaagatgtcccagtcatggacataatgctgcgataggttactttttggaatggagaaaacatcttagagattgagtctgcatcagaatatattctgaatgagcatggaatgttctttacccatgttagatattaattaattaagtttttccatgtttaacttttttaaaaaagcaagacaataaaaacagtcttgtaatctgaacacatatttgggttttgttgctagcataaaaattattacctagtggatggtaacactgttttgaaattctagcttggaggagatgtttgttacaagagaaaaggtgtttcattgaaacctaacagggtaatttacatggagagatacttgtttctcttttgagttattgttaggttaagacataaacttagaaaaattgagatgctcatctttcccatcttagatttactttcactatgaactttataaattcttttttttgagacagtctcactctatcgcccagactggagtgcagtggcgtgatcagaattattcaagcttatgtatgtgtgtgtattacacatatattacacatatgtataaatatcaaatatcttttttacattatatataatggtatatatggttgctatatgttttatgtgtgtatagcagtatctatctatactgccttatttcccaggcatatttatatgcgaaactttttttctgtgaaatcttattgtaccaagaggaataagtatatatgcccacaaaaagactgggtcatagcagctttt

SEQ ID NO: 162842 - DNA, 557 bp, Homo sapiens
tcatatagtaatgaggcctgtcctctgatctgttccatgttaagagttttctgtttcacagaaaatgtatgatttgtccctaaaatatttgcacttaatattcacctataaacagtaggtttctgtgtttaagtattctttataataccagatttgcacagctatgggcacaaatggggttattgaagaattttttttttcttgcttgagcttacttgaatagacaaaaggtgttttgtggtatgttgatagtcagtgtaatttggagaaaaataacaaaaacagtaaattgctaccccctgccgtttaaaaaagtactggaacattttgacctgttaaaacattagggaatttgaagcagaaaaagagattagatacagaaaaaaatcatcagaagtgagctcataaaatacttagagatttattttattgatttgttatatcctaatattacaggaattaatagcacctattaacagtttctcatagtagattgatagtatttacaataatgacttttttttttttttttaagacagcaactcactctgtcaccc

SEQ ID NO: 162843 - DNA, 233 bp, Homo sapiens
tccctcctggttgagcagcattaatactctggctagatttaaattctggctttctccagttagaactgaaagttatgacaatgtaatcaaaatagaatgtgggtttacagctggccccctggcctggtttgtgaacataaaacagaaacagaaagtgtaagtggtgacatcatattctctcattcaatgtgaaaggccaccgaagtctttccagaattatttttgagaataat

SEQ ID NO: 162844 - DNA, 860 bp, Homo sapiens
gtttgaaaacctatatacatgcgttaagcaagatgctacagcttatttctctactagctggctgtgactttccctttcgttttccctatttactctattagtgaggagccccttatctcgtattttaggtccacatttgtacatagttcacaacaggaattagtaaataaaagctgctgacagcagtactttaatttccccctgaagctcattcatctgggaggtagccagcctctgttacaccacaaagacctggcttcaagcttcccgccttattttatgagaacatcagcctctcaagtccagctgattattttgtttcttaagctacatcagtatagaaacagaaggaaaagtggaggaagttaggagaatagaccctgagtgtagcaagtagtaaaggttgacaatctgctggaggaaagtcagcatgcaaaagtccagagatagctaaaacacacagtacgagggggagtggacatgaagggcaacccagacagtccggatgcttagctgagtgagcatcagtcaccccaaagcctgactcatctcaaacaccttgattttctctactgtataccccacacctcaccatgaatggagagttgctgtggttgatttcactcctgagttaccatttctacagatttcaccaacaagaacatgagtgattgtttcagtattgacctaaactttgactcttggggttgagacagttttctcaatgaactgagtttgaaccctggtggcaaggtgggtgccaggtggtgttgatggtaggacaacccagagctgtgatgactccccaagagcacggcctatgaaacctcatggacttggcatgttgttgatggaacatc

SEQ ID NO: 162845 - DNA, 294 bp, Homo sapiens
tcagcttggtgcagccctgatttcaccatgagctatgttcatcctgaaccttctccctagaggcttgatcagcgactggaagtgtcactccctcccttctgagtctctggcagctccagcccaggtactgcttttgggatggcagcatggccaggtggccttgcctgccccacccagctcctcaccccacccctgctctgtagatcctgcctccagtagcaaacttgggccccatgataagaagtgcccaccagtctggcagctgttatggaaatgagcaatgcacacaccatc

SEQ ID NO: 162846 - DNA, 411 bp, Homo sapiens
gcggttcagcgtctgcgcgccttccgggccgcctgctgcctgtgtggggctgaatgttctcctcaaggccatccttaccgttgggcacttcccttgggcttacactgccctgcccgaggcagcctggcaaggggccccacccgtcaggaagtaattcccctccaggaaagtgaaacactgtggcgatacggcttacgggttcctcacctccagttccaggaaaaacccaagacaaacagaccagatgctaggaataagcctcaacccacagcacttagaaagccgcaggctttgtgtgtcttcagggagtggcttcacccttcttggaatctgtcttctgccagcgtcactcatactgctgccactccttctcccgagccaacagcacacctgtcacctcggcacacctgt

SEQ ID NO: 162847 - DNA, 504 bp, Homo sapiens
ttctcaaggtacctctaggccaaaaggaatccctaacagttctacttaagtagttagggccaaataagtatttaagtcctaacaacttagtagcaatttgaaaaaataatacacataaaaagatttccatttcatctttttttttttttttttttttaaccagggattaattcaaggcctctgtgattttagagaaaaaaaaattgcaaacccagcgattgtgttttgttaaaaaagtgtttaaaaccagctaggaaaaatgtgagtgaaatcgatagttgtgtcgcaaatacctggggagagtgtacaggatgcgcataaaattggcattgaaattaaaagtgattttaaaagtacaaaataggacttcaccagggtaaaagtatcgaagggtgccctgtcaccaaagtccatctatccactctaaagaggagtcaaaattgccgaatgggggatagtcccaggagatatccgctacaagggttgggagaaaaagcttaaacc

SEQ ID NO: 162848 - DNA, 232 bp, Homo sapiens
gaaatgcattttgtatgagtgtgggtatatatgctgaatttgaccagtttgtaaatcagtaagtgggtggtaattcaaagtcaaacgaaaactattcagttggtgaaaagggtggggtaagagaatatttaattgttttggaatgtactcaataaaaatatttctttttttaactctaggaaaatacactggatactttgtttctaaactcactgttgcacaaataaataaa

SEQ ID NO: 162849 - DNA, 515 bp, Homo sapiens
taaaaaaatttcaagtgtcatcgaaatcagcaacttagggtattttgtgtaactgaatattctgattaagtgggggctgccctgtatgccacttaacatgaccaatttccaaagattagatggccataattgcccttgacactaaaatcatgtgaaacacagccagtttctttgatgactcaaaacgtactttgtgatcttgccaagctttgagatcatcgttacaagcagcattttggttgtgaaaaacaactctccttatttaaccttttggggtggattctgagcaagaagttccctaggctacggtcaatctcgctgaaatacaaccacccaccgctcctttctgggtttagaaatctggttttcagaggtgggagtggcttcaagcagcgtctacctgtgttcagaaaagatgaagaaagacaggctcaggctccctgtataggagaattcaagttcattgtagtcactggtgactggttctgaaattgaggaactagtttgaggaactt

SEQ ID NO: 162850 - DNA, 203 bp, Homo sapiens
taccagttatatggcaaatcaatggtctgtggtcagttttgtttggaaatataccccgagtccctctgctagggatctataatacacagactacttctcccttctcccctccagcacctccaaaatatattaagcatctcacaggtacaggtggtgctaaaccatttttccatctcgaatatatttctataggtctgctatgg

SEQ ID NO: 162851 - DNA, 195 bp, Homo sapiens
actcgttattcttctgcttggaacattttttttgccctcagatcttcatatctgcctccttttcatttaaattttatttcaaattccatgtcttgacagaggcttctctgactactttctgtcaaaatactctattttctattttctgtagcatttactaaggtcttcaatcttcagtccctgccccaaccttaa

SEQ ID NO: 162852 - DNA, 435 bp, Homo sapiens
attgagcaggatgtgcagagagaagtgtgtagttgttggagagagaaatacttgaacagagcttcatggagtcagcttattttacttccactgcaggaagaaggggcattggagaggcaggctgcatttaaatagtatgactttccatcgtctgaaaacatgggttgttttaaaggcagatttatactgacattttatattcaacatttatctatggatcacagttgttaccctctcactctgccacatcccggtgataagtcgttatttttatccccatttgttggggaagggagtagagatatagaagggttaagtgacttgctaaggatcatggaaccagacgctaaacagagtcatgattagaacttagagttcctgactcctatgctcagacacagatcactaagcaacatttgcttgcctgcaggaaga

SEQ ID NO: 162853 - DNA, 218 bp, Homo sapiens
attctaatttaaatttgatttagattagaaaataatttccaagtgtgatggatataatgcatggtgttgggttttgagaggtcatggagtgactgcccccacagtaccagaggtcagagtattttgcccttagcagagacacttgataaatgtttgtagaatttcatttcattttcccaggactaacacctgaatatgtctgtgttgcagtgatgctg

SEQ ID NO: 162854 - DNA, 242 bp, Homo sapiens
tgataataaatttgtgttgcttaaagacaccaagtgtgtggtaaattgttgcacagccgtagcaaacaactctactagcaagcactctctcctgtctctttgccttattcgaccccagacctatcaccccattgctgttcctcaagcatattctatgccaaaccttctcctgcttcaggacctttgcacttacagttcccccagcctgaagcaatttttgcattgcaaaccacatcccttga

SEQ ID NO: 162855 - DNA, 117 bp, Homo sapiens
ggagtttgagaccagcctaggcaacatagtgagaccccatctctacaaaaaattaaaaaataagccggaagtggtggcatgtgtctgtagtcccttctacacaggaggctgaagtgg

SEQ ID NO: 162856 - DNA, 463 bp, Homo sapiens
  misc_feature (430)..(430): n is a, c, g, or t
actttcatcaccctaaatttattataattgtcataactatacccatttcacaaaagaagaaaaagggaattagagttgttaagctgccaaggctgggacacgaacaccccatacggttactacactatactctctctttcaagaggcttgattaattctgctctcaactctttaattctgcttaattctaattcaattgacattaagtgaatgcctactctgtggctggcacaagtaggcaccccttatatctgtcatcttctttctttttccagttatgtggtgaggtattaaaattcccattttgcagataaagaaatcaaagctacctaagtaacccctatttttgtttccttttcttttctttttttgagatggagtctcactctgtcgtctaggctgattggtcaggtcttctgtcacagagacntaatacatttagggttgatggggtaccgagctc

SEQ ID NO: 162857 - DNA, 222 bp, Homo sapiens
cgctctaagagatacagagaaagcatataataaaattcaacattctttcatggtgactaaaaaaaaaaagtagcaggccagactcagtggatcatgcctgtaatcctagcattttgggaggccaaggtgggcagatggcttgagttcaagagttcaagaccagtctgggcaacatggtgaaaccctgtctctataaaaaatacaaaaaagtggccaggtttg

SEQ ID NO: 162858 - DNA, 420 bp, Homo sapiens
agacacagaaggactgactgatgacagttaaagaccaaagtgccttagtttgtctaaataatgactttggggttgtcatatgtatgtataagataaaacctaggacaaggtgatttgttgaggataagaaaaaaggaatgagggagattattgctgactttaaatagtgtggaatgatggagtcattctgcggatggatttgcactgatattttctattttatttagtttctggcctatgatctattgggttagtattagtacaatttatttaagtaaggtgaatgcctctctttgcatgttttccctacagaatctgacatatgagattctttctagcataaagttgagaaactaaagacgtttgggtatcagcagaattatagactgaatccagggacacttgtcatctgcagtggat

SEQ ID NO: 162859 - DNA, 244 bp, Homo sapiens
ttgtcgccagctatatgggcataggtgagagccaccacatggtactaaaatatggacggttgtcggatatatgcaataggttcatgagggtgtgtaaatttgcataagttaaacaagaaagcttttctaaaacttgaaggggagcctctaaactttactcaagtcagcttactttagggcttaagttcatgaggcaaacaagaatgttggcatctgttgttcctttgctgctgcacattagagg

SEQ ID NO: 162860 - DNA, 327 bp, Homo sapiens
actgggtggcttaaataacacaaatctgtatgtatacagttttagagcctggaagtacaagattaaggtgctaacagggttggtttctagtaaggcctttctatttgatttgtaagctgccttcttgctacctcctcatatgaccttttctctctatgcatggaaagagagatctggtatcttctcctccttagaacgataccatttctataggattagggtcccctgtatgacctaatttaaaattaattattaatatctccttaaagaccctatctctaaacacagtaacattgggggtaggccaacccttaattagtgaatacc

SEQ ID NO: 162861 - DNA, 323 bp, Homo sapiens
ggaaaataaaattgaaaaaatttcattgctgttaatactggtgtgaacagaaaagcaaggcacagaaaaggaattagaaaagtaacaattttcttaattctttcacattgaaaaaaacaaaaccacaatttttaaaaacagggtccatatactaacagcctgaaagatgatctaatctcaacgataaaggcaaatgagttcaactgctctgttaaatttcttgaccctctgaattttctactaaccagttcttaattgcatttcatcagtgatcacatgtattagctttttttttttttttttttgagatggagtctcgttct

SEQ ID NO: 162862 - DNA, 205 bp, Homo sapiens
ctcctaatgtctgcctagaattgaattttggcttaaaaaagtctagccaaattaacggtcagaaataaaggattgctggctgggcacagtggctcatgcctgtaatcccagcactttgagaggccgaggctagcagatcatctgaggttaggagttcgagacaagcctggccaatatggcaaaaccccatctctactaaaaatac

SEQ ID NO: 162863 - DNA, 621 bp, Homo sapiens
aaaaccaggctatgttcaacccaatcctctccatgtggccaaagtataatgagattgttgtaataaatactgcagtaaatattatgattttattttttatgcctgacgttgttgtaactgtaaatggggcaaaatcaaatcaagtatcatagattgagtagctgttgtgtacatggtagctttgaaaaaagagaaatttacttgtgatcaaaattcctttcaatgtctagaaatgcttgcctcttcttatgacatgataccattcttatctttgaaacagaataccttatataatagaaacctagagcaagcaatttcacatgaggtaacaaaagagttcccagagtttttccagatcagtggaagacttaagtacaggatggagggaaattttaaaattgttcaaaacaagaaagcatttccccattagagaatcaaataactgaagagagggtgtgtgtgtatctctttacagtttcttttctttttgctgtttatgtgcttgcattatcaagacattttcccaatatcctacttttattttagtagcattttcaaaatctgtatcaaataaagatagcaagtagtagagcaagatgaatgagggagggagaaagaatg

SEQ ID NO: 162864 - DNA, 446 bp, Homo sapiens
agtccccttcccaagccactcacaccaacaagcggccctgctagcccttctcctccatgcccctgcagtgagctcggccagagcaggcctggtacagagaaaaacatgggtgccagcatcacaccagggggatcccaagtcaggcctgggacagagaaaaacatgggtgccagcgtcacgccagggggatcccaagtcaggcctgggacagagaaaaacatgggtgccagcgtcacgccagcaagatcccaggtcaggcctgggacaacccatgcgtgcgtgtcgtctctgatggtcctgaatttcatatgtataattgttcactttcacactggtaattaagtgttatgaatcagagtgatttgactttactgtaatgtccacggtatttatttactgaaaaagaacaagtaaagatattttagtaaagataacaagcaaaatcc

SEQ ID NO: 162865 - DNA, 307 bp, Homo sapiens
cagaaactttttcagctatgggatcttgggaagcaattttggatcttcgtcggtgtctacactttgaggtgctctggagttttgggccaagtggccaagacagtggcagacatctctcatcagtgagcccatctcagctttgggaagtcacatcccatcccagcccactgatgtattatgctgctccacactgatgcagttatactccctcaccaccaccaggagctcatctgaaatattttacaagaaaaacacccagtggaggttattgacagtaaattcggggaatgaagcaattgtgatgggc

SEQ ID NO: 162866 - DNA, 132 bp, Homo sapiens
gattataggagtgacctgttacgcatggtctcatttattgtttttagtgtttttaatgtttctttttttgagagtactactcatgcctctgattcacttgctctggtacctatttcagcaatctgttgactt

SEQ ID NO: 162867 - DNA, 240 bp, Homo sapiens
cttttgcaatttactcactttaattagcatgatgcactgcttctccataatgggagtcctaaatataggagatttcaacataataaattaaagacaattaggcaagacagaaaccaaattcattatttgcaattctaatcctcttattggatatacttgacatttaatgcaaaataagtgctccactgccactactatttatacaatagtagatactcattaaaaagttagtgttagaaa

SEQ ID NO: 162868 - DNA, 221 bp, Homo sapiens
tcctcgcccagctaggggtcattttcaacattaacatcaccaacaagaagcacacaaatgcgaaaaccgtggtactccatagaccttcaacagggcatgtgtttacagtgtgagaggctgaacgagaaggtggagtgtcgcctcgctcagcctcagctgggaacctgtgtgggaactccaagttttctccactctgcaccaatatgaatggattcatgttg

SEQ ID NO: 162869 - DNA, 352 bp, Homo sapiens
atgataactggggggcggcagcagggtcagttttccccagcgatgaggaggctgcaccgtgggcgagggtcgtcctcgtaacagggaggcagggataaaggagcagcggctcccaggagaggggcgcgggttggggaaacttccatccaggcctaggatttccagggactcgtttctgagaagtggctgtgattctgaggcaagactttgatttcgagcactagaccatggagtgaaattctgtgttgtctgaagagcaggactcctgtctagggcaggacgtagttagagacggagggagaagggtgatgtccccagggggaagatctgccgggagccaccaccatctgtc

SEQ ID NO: 162870 - DNA, 454 bp, Homo sapiens
atattcactgtggctcaatgttcacgttcaagcatagaactacattactatattctctactgtagcggttggtgtctaagcacttaaatgttgaaacatatgttttaagtagcttttattttgtttttcctttatatctgttagggtgttatattgatcgttaaattacatagtagatcagatttacctattggttttatctgaggataataaaggggactttgcaaagtacccattataaaaaggggtttcaaacaaattgtcaaaaatgtataagttactcagggaagtatgaacatggtaattaaggaattattattaattatctctagtgtaataatcatattgaggttatgttttctaaacgagtactttattttaaaagattacatccagaagtattttcagataaaatgctatgatttgccctgaaatcatcagggtggtagagtgg

SEQ ID NO: 162871 - DNA, 458 bp, Homo sapiens
aagtttaagaactgctattgtttcacatagtatacagggaccatgtatagatttgggtctttgagtatttttaaattttcagtgggcatccatccttctgtttaatgatattattactaatatatttccaattaaaaaaacacttaggaaaagttaccatatgaaactcagaactctcaatgtgtagttccgtgatacaggcatataagctcaaaagtgtactgtattctactttttaatcttgtaatcttgtgacttacactgctgtgattagggaaaccattaaaattttacaaattgggtgtatataaaggctttagaataatttacaaattaaaagtgtaatttcaatgcagttttattgctaggactatttcagttttttattctagtaattgcatataagatatttgataaaaggtttttgttgactgccacgaaagataatatggtatata

SEQ ID NO: 162872 - DNA, 295 bp, Homo sapiens
atggtgagcgagaacccaacccccgggggggtggggggcatccagtgtacctgcctgccattgtcactctccagtgtacctacctgccattgtcactcttggattaagagagacctggcgcagtggctcatgcttgtaatcctaggactttgggaggccgaggctggcagatcatgaggtcaggagttcgagactggcctggccaacacagtgaaaccccatctctactaaaaatacaaaaattagtcaggtgtggtggtgcacacctgtaatcccagctacttgggaggctgag

SEQ ID NO: 162873 - DNA, 330 bp, Homo sapiens
tggagtcctgataagtagcacaataaggaagggtccccaggttggggagagccccaagttgagaacaataatgaacaattactgtatgaacaattgttagagacagctaatcacaaacaacctgcgggcacaatgacctcattccacacgtagcacccttcagcaggaccctataaaactttcctccagcccctgcctctttgcaggtagccccttctctgctgagctgcccactgcaacatattttcataatttctctaataaatctgcccttctttacctacaactatcttggtaaatggctttaccacctgcaaaactgaccctagg

SEQ ID NO: 162874 - DNA, 328 bp, Homo sapiens
agccactttgtcttaaagccataaaacaagttcttgtggcatccagatgtgttgggctagagacctaaaatagcagttcttctcccaaagtgctaccactgaagagtggacctcctctgcgccttctcggcatgactctcataactgtgcagtcactctcgggtctcaggatgggctcattccagtcctatctcttctaaacttttgtctaccatctaaaggactccttggtacctggcacaggccagcccatgaggctggtccccatttagaatggaagagagttgtggttctttctcctgagtcttctctcccctctatggggcag

SEQ ID NO: 162875 - DNA, 177 bp, Homo sapiens
aatggggagaagaataatcactcccctattagcaggcaggggccatggggatggaatcagagaatggagtaaaaaccctccgtagactctgtggaccccacaagggggggggaacacataccccccaaaaaaaaaaaaccggcagatgatttgtctctgctttcctggtgcccaaag

SEQ ID NO: 162876 - DNA, 464 bp, Homo sapiens
ctcaaattaaatacttataagtgaagcttaaaagcctgcatggaacctgaggacatgcatttggattgcatcctccgtgttaaatctacttccttttgtctctgcttcttcctccccctacacacagatatttgaaaagtcactacaaagtaaaaacaggaaaaagaggaggcagaaaaaagataggggtgtaataaagcaataatgatagctaaaaacacaatctatcataattactgctgcgggaactaacaaactgttagcacgtgctcctgtcatattgtcaactcagctgttctacttcactattggcagccatgacagaacaggaaatcagacggagggtgtagcaaacataaaaaaagacacctcgttttgactacatactttatttggctctcttatagtctaaggatgccatgaatttggaaacaagcccggtaggaacaactattcttcctgtc

SEQ ID NO: 162877 - DNA, 518 bp, Homo sapiens
cacatctgcacagctgatttctgacaaaggcacaaagacaatccagtagagaactaatctttacaacaaactccactgaaacatctgaacaccttaggcaaagaaatgaactcaggtccacaccttgcattgcacacaaaaattaactcaaaatggatcacagacctaaatatacaacttaaagctacaaaatttctagaatacaggagataatctctgtgaccttgagttagggacaaagttcccagctaggaaaccgaagtccaaaccaaaagaacaaactgaggccggacgtagtggctcacacctgtaatctcagcactttgggaggccaaggcaggcggatcatttgagctagagttcgcaaccagcctgggcaacatagcgaaaccccgtctctacaaaaaatacaaaaattagccaggtgtggtggcatgtgcctgtagtctcagctagccaggaggctgaggcaggaggatcacctcagcctgggaggtaaaggctgcagtgagcccaga

SEQ ID NO: 162878 - DNA, 299 bp, Homo sapiens
ccccataggcactgccctcatctgtagggctgtggcatgtgggagctcagagaggctcctcagaccctagcttggcaggagacagggagaccaagcccaggccatccccctatcatcctgttttcctgcttgtttgggtccctaggttagctttccctaaccccccagaggctgcccctggcctgggcgctgctgaagccccgtgtgcttagatgcagcaaggggactgggcagagggaggtgggtatcattgagtcttgggcccaagttcatctcctggcccagccatggactcagag

SEQ ID NO: 162879 - DNA, 345 bp, Homo sapiens
ctttttattatagagagacttaattataaaagattcaaaccatgcagaaacttgcagactaaaaaccctaaaaatccttcctctgtccccgacctagagaaatggagaccaattcatcaatttgtttttatatggattttgtttttggtgtcacatctaagagatctttacctaacccaggtcagaaagattttctcctagaaattttctagtcttaggttttatgttaggtctatgatccattttcagttaattcttatatgtggtagaagtatgaattgaggtttttacatatgggtatccatttgttccagcatcatttaatgaaaagactgtgttttctcc

SEQ ID NO: 162880 - DNA, 403 bp, Homo sapiens
taccttgctttgcatctttctaaatataaattctgactacatctaggtgtgattctcttacatctgatacttctctgcaacttttgtctcagcatagtaaccacctaattgggccaacatacaaatccttgaggaaattaatgaagaactgacggttaagaaaccttcctgataatttaactcttgcttccctgaacagattcactcctttcacgacagggaaggtgttttgattcctctaatttcttcagtttaacacactgatagaccagagggacaggaagaaaatgtttaataaatctctccatagctgtcctcgctctcacatttgccctcacactcaaccttattctactatcaagagtcaaaaagtgccatcggcacctggctcctctacctcctt

SEQ ID NO: 162881 - DNA, 230 bp, Homo sapiens
tcaagcgtcaggaggggaaacacctgctcctccacccctcctgtggaggagaaagtgcttgagaaatagacaccaatgattacgaaacaacagactgaatagtacaggaaatgtcacgctgtgctacaacaggagtataaataattcaagaagaatttcagttactaacacaacaggttgcttagcatacaaaaccacatggtccacagtaaaacctatgtacgatatca

SEQ ID NO: 162882 - DNA, 495 bp, Homo sapiens
tttttaaaagttttttttttttccccccaaaagggggtcgttcagggggggagaattgcttgaacccgggaggcaaaggctgcagtgagccaaaattgcaccactgcattccctgggcgacagagcgagactccgtcccaaaaaaataataataaataaactggtttccaataataatttgtttgctgaagacagctttggttgttaaccacaaaaagcaaagacatgaagtcctttgtgtaggagaaatcttgatctaggtttacactgtagtgggatgttaaaaatacttttgtaggggtagagagaggtgttacttgttttcgctctctaagccaagttctctacaggtcatgttttctgtatatggccaacaactatttaaactttataagaaagagtgtcaacatagtatttgatagagggtgtatgttctaatgtatttcatacctaaagaatgtctgaatgtgtcttttttttttcccccagatgggg

SEQ ID NO: 162883 - DNA, 473 bp, Homo sapiens
gtcccagctacttgggaggctgaggcaggagaattgcttgaacccgggaggcaaaggctgcagtgagccaaaattgcaccactgcattccctgggcgacagagcgagactccgtcccaaaaaaataataataaataaactggtttccaataataatttgtttgctgaagacagctttggttgttaaccacaaaaagcaaagacatgaagtcctttgtgtaggagaaatcttgatctaggtttacactgtagtgggatgttaaaaatacttttgtaggggtagagagaggtgttacttgttttcgctctctaagccaagttctctacaggtcatgttttctgtatatggccaacaactatttaaactttataagaaagagtgtcaacatagtatttgatagagggtgtatgttctaatgtatttcatacctaaagaatgtctgaatgtgtcttttttttttcccccagatgggg

SEQ ID NO: 162884 - DNA, 248 bp, Homo sapiens
catggtgtgagcagggcatctgggccaggtgtgacctcatcacatggtgtgacctcacttttttttaaagaagggaatgaattttttttttaaggagggaacaaatataaaaaatctttgtcctagagtcagaaaaccaaggttcaggtcctacagttgagaccttcttagctctgtaactttgagtaatttactgtagagagctgatgttggttccttgaagtgtaacatgggaattgtgcctatta

SEQ ID NO: 162885 - DNA, 666 bp, Homo sapiens
caaagtattttctttgatatgacttcattaaatctcaaatcaggattatcatgcccattagggaaatcgaggtttagggaaaccacaggacttcggtaggggcctggaaagagaaaattcaatccagaccttctaactccaaactccaagctcttccactctgccacctggggtggatttgtcaatcccagctaagagaggtcaccctggacaactgcatggaggaaaataatgatgtatgtttagcataactttctctgttaaatgccagggagccttagatacattcttgatattgtaattaaatagctttttaatattaatttgtgattatgcttgcaaggaaagtcctaggaaacttaaaatatgctatacatctgagcacatttttatcgcacatcagaattctcgcagagtttaattgggcccatggtgtaaacagttcctcattttcatccagaacgcgtggcatgctgttatgttttcaggaaagagaaaattatcttaatttatgtaaagagtattcctaaagatatgtataatgtagtccacgaggattaaacaccaaatgtgtaaatatcacaaacttatctcagcacatattgtctctgaaatggaaacaactttctttgctgcaaacagtcactcaggagagccttgaatttt

SEQ ID NO: 162886 - DNA, 219 bp, Homo sapiens
ttttagcttttaagattttaaagataatttcaaatttacagaccaattccaagaatagtataaagaactgatatataccctttacttggattcaccaactgctcatatgttgccatatttgccgtgatcattactttttaaccatttgaaaataagttgtagataacatagccccaagccttcagtgtgtatgtcctaaaatcaagggcattctcttac

SEQ ID NO: 162887 - DNA, 314 bp, Homo sapiens
agcccttctgcccccagaagctcagagaagacaaggccaatatgtaagtcacattcctgggaagaactgaaaattttaatttcaaatgttaaagcactttgtcttttttttttttccaagtagtttaacatctctttggcaaataaaactagcatattgtgacaattgctgaggttttccttgcttgtaggagacatttattaagtcttatgaaatctgaaaggattatttccaaatatcaaagtaacattcacaaagcaatactgtataacttggaaatgtcccaagctttaggtcagtcaaaatgttctctt

SEQ ID NO: 162888 - DNA, 1101 bp, Homo sapiens
ttagctgtatgtgcatgtgttcctctggatgcaagtgtccatgcgatcgtgctggagcactctggtttccaggtgacagacacgattcacggtatagtatgagacctctgaagttggagcattctctacagctttaatttctttcttttagttcttggattcaagaattgcttttaaaaaagaaagttgtaatgcttgttaagtagcaccagctacagtttgtgctgtgcttaaagaggtacagtgattaagatttcagaatgttgtgtaataaatatatcacttattttttttgtccaaagcaaatcagattcctttcttctgtttcctcagtagaaaatgacaaacatttaggaattttagaaatttatgggcctcaacttgataacttaattgaagtaatcaagttcttccttcatatcacttccagcattaaggagacaccatatatattttgatattttggtcagaattagaaacaaaccttcttctttgtccttaccagtcagtatactttcatatgtcttagctgggtacctgagaccttagggagctctgcagtgctgacttgatgtagtgaaggcacacttcccgtaaaagtgttgcttgcaagtcaacctttgggatacttagagggagggtattttatttagtcttggaagtctgaggagtgttgggtcagcaggttgccctagatcagacatagattttgagaaggtcctgaaataggcctttttaaaacctgggcttccactcacctgtctttctgctggcttgtgttgcctaaagtgttttagaagttctagtttcctacggatattcatcaagtcatccaattttgaaattattaatgtccaaaaagatcaaggtgttttaggctggtccttgggataattgaagacactctagagactaccataaaatgttagaaatcacttatctgtttaaattcttgtaattcatatgtgcttattaaataatcacataagctatactttaaatcattgcattgagatctcacattttaatgtgttctgtaaaatgttttcagaaagtgctaaaagtggccgggcatagtggctcacacctgtaatcccagca

SEQ ID NO: 162889 - DNA, 610 bp, Homo sapiens
tcaagacccatttatagctccccaggtctactagcatcagtcttacttgccagccatgttcagggccttcccaccagagtctgccctgtagccatcagcagtctctgttgctgacaaacagagcagttctttctggcattatgtgccttggaattgccatctactaacccagcagctcttgagagctgttcatctgacactgcagaatccagcagtttttcacacagttccagtgtcagttctaggggaaaagaaactccttgctcaagggtatctcctccttccattctccaggtagtataaagcatttccgttttattatggaactcttccggacactgccatccccattagaatgtttctctgacatcactggagacagtatgggtgtttcaggtgtcatagggatagcttcagctaatgtttcatagcaagacagtaaatgcccctcaagtggaaatactctagtccaaaccccagtagttgttgctgggagctactcagaagctttagccataagctcgaggagctgtttcacagagggtgatgaagtggagaatttatccttcccagcactctagcttctaccctgcgacctatgagtggttca

SEQ ID NO: 162890 - DNA, 201 bp, Homo sapiens
aagaaatgaagtgaaaagtgaaaattttgcctgttctaatccctgccgaatacctttgggagctttttaaaaaaggcagctgcctgagttccacccatgaagttggattcagtaggtggggcccaagcccctgcattaaaaaaatcctatcatcagtaacagtagctattaacaccaacctaatacaataatacaggctca

SEQ ID NO: 162891 - DNA, 434 bp, Homo sapiens
cacactctcagttgcttacaccactttcctgttctaaataaagtaactgtcttaatttttttaaaaaaagaaaaaggccaaatgaattgcgtcatgtgaaaagtacagcattacatttgctgtctatatttaatcattaaggaaattaaatactatatttaatccatgtcaagataaataattaaaacaggcccatttttattatttacaattaggccctatttggctaatgggaaataactcaaaagtcagagaagttatttctttagttttcctaattcttccaaaagacaataactaaactttattatatcaaattttgactatggttatagttcctcaggaatacctgggctctcctaattagtagcactataaagattacttcccatataatggttcagaattgatacctattacctcatcagatgacc

SEQ ID NO: 162892 - DNA, 319 bp, Homo sapiens
cacactctcagttgcttacaccactttcctgttctaaataaagtaactgtcttaatttttttaaaaaaagaaaaaggccaaatgaattgcgtcatgtgaaaagtacagcattacatttgctgtctatatttaatcattaaggaaattaaatactatatttaatccatgtcaagataaataattaaaacaggcccatttttattatttacaattaggccctatttggctaatgggaaataactcaaaagtcagagaagttatttctttagttttcctaatatcatgttgtaagaaaggcacatggctttgtgaagcaagt

SEQ ID NO: 162893 - DNA, 105 bp, Homo sapiens
tcttaatatagaattgacttcttcccaggtaagttttaattgcttctcatgcttgtagaaaggtgtatcatgtgttctaataggttaggatttaattatggctta

SEQ ID NO: 162894 - DNA, 245 bp, Homo sapiens
ttatgcattcattcaacaaatactaattcagaggcagccaagtgtaggcctccattagctactgtaggtacaagggtgaccaagcaggacatgccctgggcctcaccctgtagcagagagacagtcagtcaagcataacttccatgacacaaaattgctatgtgatgagtgctgggagggaagaggagtaactattccacacacaacttgcccattttccaacttattcctggaggaaaagctct

SEQ ID NO: 162895 - DNA, 237 bp, Homo sapiens
atgtccccagtggctggcttacctgagctaagagccagctggtttaaaagagagactggggcttgccagggatccagaattaagtgatataatgttaaagtgatttgattgtgaagagttaaagggtgagctataaaagtcacattctagcttcaggttaaacatatgagcacagagctgaaaactagaggcaaagcctaacattttgggtagactgtgaactgagtatggaaggag

SEQ ID NO: 162896 - DNA, 315 bp, Homo sapiens
tttggaggagtggcagtaccagttacagaggtagataagtctcaagacccaacaggtttgaaggagaaagtcagaggttctgctggggcgcagcagaatacagcgcaagcctgcagttgttggcagttgacctgtaaggggtagtgccgagtcaggtattcagaagtctgcaggctctttaggagccaagtttaatggttactgcttgaggacaccagaggggagaaaaacagctctgtgcagggaagagctggtaccctgggtctgacgagtgggatctttgaccagagagctgcatcccacagattgggcagg

SEQ ID NO: 162897 - DNA, 183 bp, Homo sapiens
ctcccggagagagcatgatcatctgctttttatgatctcctgggacttcctgagctgagccctaacattcactttttcctaaattcaagcccctcctaccaagggcatcccaggcgccagacgcttgtgctaatagctgctggcaattcacagagggaacgatgggcacattttctgttcttc

SEQ ID NO: 162898 - DNA, 312 bp, Homo sapiens
cttaaatgttctgttggatgaaagtgtttcacttatagtactaatcgccatgtggtattcctttactttccctaacatttgcttgtttgtttttattgtgtatctacatgtattgagtagttaggtgcttgtacaaatcttctaccttcactcatggtcaatcaactgtaaaccttacctggggccaacttgccaaaggttttacagttaacaaatggtatttgaaatttgtagtaagagtaaatgctttggagtaggaatgcctatctcagcaatcctgctaagcactatactctggataaggtaattacc

SEQ ID NO: 162899 - DNA, 380 bp, Homo sapiens
gcaaaataccaacaatgccagaaaacagtaccatggaaagctgagctattcagaagctaccagtattgaaaacccaccctggatgacatgaccgctacttctcatggctaagtaaccacatcacagaagcagcaacatgaactggtgagggggtatataccctgggcaggccggatgctgaacctctgttggattctcagccctctctcctaacaggcaaaggaaaaagccagaaaacacttggcttttcccactgactttgcaggaacagtaatcccaaattgcatagaggtcaatttacttcatcttattatctggttacactttgtcccaaacttagaacaagttaaagaatgaaagtgttaattcatctccactgg

SEQ ID NO: 162900 - DNA, 479 bp, Homo sapiens
tggggagccacttaatcttggggagcctgtctccccacctggaaaaggacgatgatgtgacctcacagggtcgtagtgggactcaaataagataatgtgtgtgaaaacgccttgcaaagtgctaagtgagttgttgctattatgattaggctcaggggctgcctatctgacactcatttttctaatgcctcaacagctgtctctcttaccctcccagggcaggtaccacgttggagaaacttctgagggtgaaggacacccaccctagagtagtgggcagttaagctgcccgcatagacacacacacacacactttagttacacaagcagaacacctttttataaaaattcgaaaggcatcatgtgcctacagcctcagttactcaggaggccgaggcaagaggattgcatgagtcctgggcaacagagtgaaacccatttctactatttaaaaaacactaataagaaaaaatagataa

SEQ ID NO: 162901 - DNA, 792 bp, Homo sapiens
ataattaagatatttctaggagtgtatgctttttctaaataataatcagagggataatctctcccatccacatatgtacgtagaatgtttcaaactcatagtagtttttcataaaataaagtcatttacaaactgccatgctaacttatgatttccctttcaactggtattgctggagaaagaacattttctttcttcatacaactatttctggtataattcttccctatctcttttacagatagtttttccattgtaacagattcctttgacttcaaacatgtccttcttctctccatactccactgctgttgtcactaataaagattttatgtccctccgctgcctaggaaatcttgctctggccactataatgcagacaagggaatggtttcaactttaagatagatcatatgataggaaaaaaaacaagtatcagtaaatttaagaaaatataaattatatcaagtactctcttagaccatggtggaataaaattggaaatcaactccaaaagtaaccctcaaaactatgcacatacatggaaattaacctcctcttgaatgatcactgagtaaacaatgaaatcaagatggaaatttaaaaattctttgtacttgactataatagtgatacaacctatcaaaacctctggaatatagcaaaatcggtgctaagagaaaagtttgtaacattaaatgcctacatcaaaaagtctgaaagagtacaaataaacaatctgaggtcacacctcacagaactggagaacaagaacaatccaaacctagaccc

SEQ ID NO: 162902 - DNA, 191 bp, Homo sapiens
agaaggaacatggaaggaggtctgctgactaccaacccaacaccacaagcagattctaggaaggtctatctggagcttagaggaaatcacttaataaggagccaagggagtgtgacctccaccagctccaaaacgaggctggggcttttccaagctccattaacaatagccaggcttttaaaaaaaattct

SEQ ID NO: 162903 - DNA, 378 bp, Homo sapiens
aataaactttaagtacagtaacagagactatccaaactgaagtacaaaaaaaaaagacagacaaaaaaagaaggcctcagtcatctgtgacaatattgaatgggctaacctaagtgtaactgaatattaggataagggtttaaggatgtaggaaaatgtgatgaaatcacgaccaaaactttgtaaaattttatgaaaactctaagcatacagactcaggaagctcaatgaacaccaaagagaataaacatagaaaactattccaaggtatatcagaatcaaatagctacaaagtaagtgactaatagaaaatcttaaaagctaccaggggaaaaaagacatagtacatacagatgaataaagataataatggaagca

SEQ ID NO: 162904 - DNA, 448 bp, Homo sapiens
tgaggataccctacgaatactatgccgaggactctgtctcctctgcttgcctccgtgcaccctgcgaggtcacaggcccctcctttggtttgctggggacacgctgagactgtatttagagaaagggtctgggagagagaaactcctgccccttccccctgggatggttgccaaggggttgagacaggcaccccatggaatgtggggagcatctgctccgggtccaccagcaagagacgttgaatgccagtgtgttttgatctctgttttaaaatctcaggccttttgggatgatttctttgatgttctgaagcgacggttctgaagtgccgctaggtggggctctcttcattgacctgatgagcctttcgtttgggacgcgtttctcagggaaattctttttctgttctcttgggctgtttttcctagtatagggggaccgagctca

SEQ ID NO: 162905 - DNA, 157 bp, Homo sapiens
gaagtataaattcagtcccttttatttcaaatgagcagaagtcctgaacttgtatttctacttagaaaacagacaaaattctatggccgggcacggtggctcatgcttgtaatcccagcactttgggaggccgaggcgggcagatcatgaggtcagg

SEQ ID NO: 162906 - DNA, 535 bp, Homo sapiens
gataagaagtcatttactccatggggaaattcttctcatttctttaaactgaaaatagtggtataccaaaaggcaaacctgtatcatagtaccttccatctgttgggaaacaattctcattttagtctgttaattttaacttctactttcccactcttctttccaaagtcagaaaaaggagaaaaataggattattttaaaaagggattaaaacaacccctctaattttaatatttacatagtgattcacttttcaagttcttcataaccatttcctggtgatgttatatatttccaataaagtgtccattaaaatgaaaaaaccttcgaagaaatgtaacattacagaaatgcttgttttcaatgtataaactatcattacttgcattttccccctagaaatgagacagtgaaatgtgcatagtttcaaacttcttaatataaagcacaaagcaattatttagaaaaaaaatctggcatttggacatcacagatacattgtggtgtttgccaagatattactaaactaacatgt

SEQ ID NO: 162907 - DNA, 135 bp, Homo sapiens
ttctctgtgcagacagttccaaagaaggctgcccctaagagccgtcaacctcaacctccggacaggtacctcctagaaacccctagaaaccagggtcagggcagtaagagactccaggctgcagctcgctcagct

SEQ ID NO: 162908 - DNA, 280 bp, Homo sapiens
ataatggttaaagtaacgcaatggtttcaagtctcaattggtctctcttctgttatgttcattggaagatcagggcaagtatatcccctgcaactccccctcccctcatataaacattagttgtgtgtgtggatctttctgctttgtccttcatgtggcctccaagggtgataaagtgagagtcatctgatctacaatgaaaagaactgggaaatgattctcagcagacccagctgttctaaaaggcaaaagcttagtatatcaagaggtcaaacataca

SEQ ID NO: 162909 - DNA, 384 bp, Homo sapiens
ctgtcttgttccttgcaatgtaaaatgagacttctaaagcccaccttgatgctgatatggagaatgctgaggttctaggatttcacacagcaggaatttttttttaataggtgtcagctgtggggtttattttttacaaagtaaggacattaaaaaaaccaacccgtctatcaattcataaaagaaaggatgttctgataccaagactgaaagaagaaaggatgtattccaaaacaaaggaacatccttccaagaaaggacctatggcttctttattccgacataccccaaaataactgcatgataaataggtctatatttaaaaagctctagtgtcgaatgttttcaaaataaaatttaattttatgagattaccctgaatgc

SEQ ID NO: 162910 - DNA, 504 bp, Homo sapiens
gctatactaagggtctaaatctgattcaggttagctgttgatgcctttgactgtaactgtaattctctaactttcaacccttttatcatcaaggacctcaactattattttttgttccatatttgaaaacttttggtgttccagacacactgcattggttaataactaattttcccgttgtaaaaacagacacgtgtaactgaacacacaaatgagccatcaacagtatgaatataaaagtgtttgtgcaatgagttggttgacgtttcagctagcttgttcagttgtttcatgggtaagtgtatagtttttgtttgaagttttgatatatgaaaaatagttccgaggtcttctgccttattagacatgtgatagacaaaggattctaggtgagaacttagtttattcttttatgagttgctgaactgccctggtcattagagcatcaagtaagttgtttatccacatgcagttcatgtcttttcagttgtctccttattggtc

SEQ ID NO: 162911 - DNA, 333 bp, Homo sapiens
  misc_feature (47)..(47): n is a, c, g, or t
cgggcgacctgaggacccacgtcagcggatgcattaagaaagacatntatttcaatcgtgtctaaagcctgaatcccaagagttcctccttttagaaactctctagatatcaatttagcaggatacagttaaatattacaatagattaaacaaaaaggaaaatgggtatccggcagggttttcaggagagaaaattataaaaactgaactacaactactattaataaaattatggggctgagtgtgatggctgagagtccttttagaaatgctcatctatgtgtttatggatgaaatgatttgcactctggcatttcctttgcaatccgcttg

SEQ ID NO: 162912 - DNA, 132 bp, Homo sapiens
cacagttgttctaccattgagcagactagctagttgaagtggcccaacatgaagcaagaaagactctttgttgttaggcctcagtctgtctttgaaaatttatgttggtactcagagttatgcagtcaaagc

SEQ ID NO: 162913 - DNA, 522 bp, Homo sapiens
ctttgatcctatctactgagacgtgtatcctctttggaacatcaggctgccttagttgagagtatttgcactgcctggcccttgtcagctcgtgatctgtatgggcatggcctttcaatttccccttgtgcaattatggtcaagcttgttggatcccccaatcagcatcatgtgggggtggcagacctcagagataacccctcttgtccctgcacctgacctgtgtttaaactagggcaggagcaggttcttgggcttaaagtcttccagaaggggccttcttggcatttataaatagatatccttttttattagtgttcagaattatccttaataattaacctttatcagagaggaagggaagggacagccaaccgtatggggccaggaccaaaaattaaaagtgtattaaaacagtgggacgtggttaattgttaaccagcagataaagccagaggtgtgtccgtaaatctttggttggaccagttgtgtgaaagacttgggggaaagcagagactctta

SEQ ID NO: 162914 - DNA, 157 bp, Homo sapiens
cccgtccgtcagtcggcatcaacgcatcaccaggtccctacccatcagtcggcatcaccgcatcaccaagtccctgtacgtcagtcagcatcaccacatccgcaggtccccgttcatcggcttcaccgcatccgcaggtcccgtccatcagtcggca

SEQ ID NO: 162915 - DNA, 158 bp, Homo sapiens
gcaggctgcattcagaaactgtaagtcatttgttagttagagtgtaaagtacactggggtgcaacagtagatgagattagaacatctagcaggagcaataggtggaaactctctttaaccttccgaggaactgccaaacttttccacagcagctgtac

SEQ ID NO: 162916 - DNA, 339 bp, Homo sapiens
aaagaaatgaaattctaatacaagctatgacatgaatgaacattgaaaatattatactaagaaaaagaagcctttgacctttgatatgataagcagattgggaccccatcccactccactgaaaaaactacagagattgtatttgaagataaaatactttcttttctcctgagtattctagagcagcactgtccacaacagccactcacacatatttcaaaaacatagtacaaaaacagaaagaaagaaaaaagaattctcatattttcttgataacatgtttaaatgataatatttggagttaaaatatattagaagtagctgggcacagtggtatgc

SEQ ID NO: 162917 - DNA, 241 bp, Homo sapiens
gtattcaaagctgatagaagtaacacacagaggggaagttgagaaggactctagccctactgggtatttaaggatgggactgaaggaaggaaaggataatccaaaggaccaagtgatcaggagctcagctgcaacctggaagctactaacagcataactggaaacagaatatttttatattttgagaaaaactaggatttggtaactaattgaagaaagaaagactcagggatgattcctg

SEQ ID NO: 162918 - DNA, 602 bp, Homo sapiens
tccaggcatttgcacctcatcccctcattttgatgcagctggtctggggaggacactttgagaaacaaggataccttaggcttcattctctgctaggagagcagatctgaaaaatgtgacaatcagatgtgagtgagtgtgataatcgattactgtgttgcctttgaagagcatgtatgaaaggcaatatgatgtcctggttaatagcatggaggctgggttcgaatctctgctcatcagggttatctcatctcactgcaacctctgccttccaggttcaagtgatccgtgtttcagcctccccaatagctgcgattgcaggctcctgccaccactcccagctgatttttgtattttgttttgttttctttttgagatggagtctggctctgtcaccaggctggagtgcagtggtgcaatcttggctcactgcaacctccaactccctggttcaagcaattcccctgcctcagcctcccgagtagctgggattacaggcacacgccaccacgcccagctaatttttgtatttttggtagacacagggttttatcatgttggccaggatggtctcaatctcctgaccttgtgatccatctgct

SEQ ID NO: 162919 - DNA, 146 bp, Homo sapiens
atgtcacaaaatgcaatatgtgaatacattaaagtttaaacaaaaatcttaaccagctcacccattgtagtcccttatcctatgcttcactttccccttaaaattcttttcagaccgggtggtggctcatgcctgtaatcccagca

SEQ ID NO: 162920 - DNA, 221 bp, Homo sapiens
tgaactttgttctagatgagaatctatagatcttttctcatacttttttagtgattgcagtttccttgtagggccgaactctgatatatttaattattcatctcttgagtgacatttgtgttgcttccggtcgttgctgcttgacactgagcacctgtgcatttcctggaccccagtgctgctgattctgtagaatgggttccttgaggtggaactgttgg

SEQ ID NO: 162921 - DNA, 138 bp, Homo sapiens
tataagatggaataaatgggtggatggacaaacaagccccaatgatgcaagatccctgggcagttcctctaagaaaagaaagaattctagagaagggacttacattaagtgtcctttgtgaagtcaccaggcactggg

SEQ ID NO: 162922 - DNA, 221 bp, Homo sapiens
cacaagcacacagaatttcactgtggaattggcaaggaataagtgagccaaatttggcctgtagaaattaacactggcaacttcgtgagtaaaaattacatgaaaagcactcatgagggaaggaagaaggaaaaaaaaaaaactaggataacagtgcaacagaccacatttcctatccacagtctgtcttctcgggggtgtttgtctaaacagcattgcca

SEQ ID NO: 162923 - DNA, 211 bp, Homo sapiens
gctgtatgtgataatctgattaagcagatatgccactaatgtctgccacacaataaggcatgttagtgactatgtcaatgtaggcttgaaagctacattgatagagaagttgtctccccgctatttgacttcttgagtcgtttctttgaactgtcgagagtattttacaagtgcttttctgtttgaggtcatttcactcagagtatagcaa

SEQ ID NO: 162924 - DNA, 218 bp, Homo sapiens
aaaggcaaaaggggggaaaaggaaaccaaaaaccactcaaatccctttagaaacactatttaataatgcaaactctcttttccatagaattccaatcaaggggcactttggccatgaggaagcaattaggaacatctatgatttaatgaaaatgtaaaaaaccaagggcaaagaaaacaaccatgtaacaagagtctacttctcatatcctgcaccat

SEQ ID NO: 162925 - DNA, 186 bp, Homo sapiens
atctctttcaaacattatacagaaagaaatcaattccagatgaattaaagacaagtgtgaaaagcaaaatgtggccaggcacggtggctcatgtttataattctagcactttgggaggccaaggtgggcagactgcttgagtccaggagttcgagaccagcctgggcaacatggagaaattctgtc

SEQ ID NO: 162926 - DNA, 357 bp, Homo sapiens
gaagacaaagaaagaaatcttgttagcttgtcaggggcaggggttatggcggtggcctcggggggggttttggcggcggcctcggtggaggtcttgccggaggaagcagtggaagctactactcagcagctgtgggggggccggcctaggtgggggcctcagtgtggggggctctgttttcagtgcaagcagtacccggggagggggggattacaggggcataacacacctggttaatttttatagagatggggtttcaccatgttgggcaggcttgttctcgaactcctgacctcaggtgatctgcctgcctcggcctcccaatgtgctgggattacaggcatgatccaccgcccc

SEQ ID NO: 162927 - DNA, 430 bp, Homo sapiens
gttaaagattccacctgccatcttgtacttttatgctgcccactgctgccaccaagggatacgtgaaagacattccagcgtgatcttcgtctttgccacataacaattctatacaactgtgttcacaagtaagtcatatcagtgcctcatagccctggtggtagttaggaaatccttcctttttttctatcctaaatctctatttctgtagcactctaagcctggatcttcttagcttctctcaggagggagaggacaacacccttgggtgtcttcagcattctccaactgcataggtgtttgttctccataatggccttgggcacatttttccttcctcctcgcagatgggtcacctattgaaaatgctgcggtgctgtcatgtggcatccccaggtaggtatgatgaaggatgtcatccgcctctcac

SEQ ID NO: 162928 - DNA, 180 bp, Homo sapiens
caaaacttatgttgaaaccctaatccccagtgctatggtacttggagataaggcctttaggaggtaataagctttagattaagtcaggagggtgaggttctcctgatcgaattaatgcccttttaaaaagagtaagagaggtgagctagttctctgtccaccatgtgaggacacagtgaa

SEQ ID NO: 162929 - DNA, 356 bp, Homo sapiens
caggctttttcctgtagcagtaataagtgtaagttgcacaaatacctgaaagatatcagaaccatcatatttgcttcctacctgggtttctagggaactgggattgaagaagggttacaactagattggtactcaccatacagttaggctaaacattagagttgtttttagatagtgatttctcagaggaacagaagataagcccacctaccatttaggcatttgtaaagcatcattcacttccagtagaagatcacagtgagtaaagcataagagctactgggatagataaatgaatgggagaatggaaaaattagagcaaagaagagaattgaaattgagggccagataaagta

SEQ ID NO: 162930 - DNA, 183 bp, Homo sapiens
cttcttcatccgtggccctccctcgcttccttccttccttcccttcctcctcctgcatccatccttccctcctttcctttctttcttctctctcttcctccctcccaccctctttatttctttacttccttccttccctttttttttttatatcctttacagttctaggctacagtagggaga

SEQ ID NO: 162931 - DNA, 233 bp, Homo sapiens
cccagaatgttctgagtcagaaagacagtgaatcctctcctctgggtcagtggggagggagagagagagatttcagagggaagaaagcagaaaaagatgtcacaaaattgcctaatcaaaagttaccatgatgcctgcctcatctggaactgggctcccagtctctagtgagggagacatagtccagtccagtcccagtctccagtctgagccaaagcagaacaaagctggac

SEQ ID NO: 162932 - DNA, 180 bp, Homo sapiens
cgagttggatcactgaggtcaggagttcgagaaagaatgctgtaagaaaccataaaagcaagaaatacgggatgatttcattttttttcatagaaatcaggaagaagtaaggttagggtccatgataactctgagaagaaaacatattgccaagaaaatatactgcaaaatgttaattga

SEQ ID NO: 162933 - DNA, 247 bp, Homo sapiens
gctgggacgtacagggcacaagctactatactctgctaatttttaaactttttgtggagacggggtttccctatgtttcccaggctggtcttgaactcctgggctcaggcaatcttcccaccttggcctcccaaagtgctgggcttataggagtgagccaccatgtgcacccagcctgtggtttcttttatcaatgtttttgttccacttctacatccacttttatctaactcaggatgcttcttga

SEQ ID NO: 162934 - DNA, 226 bp, Homo sapiens
ttgatattttgggtactgaataatatttcattgtctgcatgtaccacagtttatccattcacttttacattcctcctccacagtttattcattcatttactggttgcttccaagttttggcaatgatgaataataaagctgccataaacattagtgtgcaggtttctgtgcagataaaagttttcaactcggtcgggaacggtggctcatgcctgtaatcctagca

SEQ ID NO: 162935 - DNA, 193 bp, Homo sapiens
aggagaaacttagaggagctaattttggaggataacttctatatctggtatatattgtgcctcagttgctgaaacttaaatcaaattaactgcacaagcccaaggcgtgaaaactattatttagcagactttgaagaaagacctgggcttttcacctttgttgttgctcctgatgactttattcaatagcaat

SEQ ID NO: 162936 - DNA, 144 bp, Homo sapiens
cactgtcagctcttctggatggcaagaacgtcaatgctggtggccacaagcttggtctaggactggaatttcaagcataaatgaatactgtacaattgtttaattttaaactattttgcagcatagctaccttcagaatttagt

SEQ ID NO: 162937 - DNA, 199 bp, Homo sapiens
gaatggtttgcatattttcatgtgggttcagatcagttatctgattcatgagagaagttaagttaaataaaatgtgtacaagtgacatttcagcctgagttaacagaatgtgtttttggtagggcaaatgaccttttatcacataattatctggaacatcttagagacatgaaaacacattttatcataagtacagttt

SEQ ID NO: 162938 - DNA, 422 bp, Homo sapiens
accccctctcagagctagaacatggttaggaagatggatactgggaggcaattgttctgatgggaaagcacagcatgtaaagaagcccataggaggcacttaacctggcgcagaagaacagggtaggcttcctggaggaggaggtaatctctgagccgatacctgaggagtgaatggaggaggggacaatgaggcaaggcattccagggaaaggtccagagcctagacagaactcttttaggagaattatgagaatcacaattatcgaggacacagtgaagactcagataactcaaatataggttttgcccgcaaagccttcctgtctggtgggtgagacagtctacagcaagctgctccaaggatatggaaaaaaaagtttttcctctggccttgtaggattggttattactgagcctgga

SEQ ID NO: 162939 - DNA, 278 bp, Homo sapiens
cctagaggatccccattggatagcggatagggctgggttggtcaaggagctttctgttagctgctgtaacaaatcatgaacatagtgacttaaaacaacacaaattgattatcttctcattatctttcgtttctggaggtcagaagcccaaaacggtttcacctggctaaagtcaaggagtctgcagggctgcatcccttctggaagctctaggggacaatccgtttcctcacctttttcagcttctagaggtcgcctgcactccttggctcacggcc

SEQ ID NO: 162940 - DNA, 238 bp, Homo sapiens
gaaattggagacttatatgtagctggagtggatgacttctttcttttgggggaagaatgagagatgcacatttcgttagtaaattgtgaacaacttgaaacaaacccaaatccaattttgaatttaagaagtagagttaaaatgaaaggtagccattcaaatactatgccttgctgccttcacttattaagttaggattttcttccttttagccctttagggatacagtagtttaaaa

SEQ ID NO: 162941 - DNA, 334 bp, Homo sapiens
cttaataaatgattgctgaataaaatcctgactgaagcatacgggaaaatctgaaaccatgaagggatctggagttatttactttaagaaaagttatggaagctgattatctttggggtaaaaaggaaatggatttttaaaagcctataaacttcagggaagaagcgccaagatacatgtgacaaggcaatctgagctccactcagatccaagaacaaagggttcctggtttaagctatggaagtatctgttccagaaagcagctgggcagaatttcctcacacgaatagctcttaatgtatgggaaaaagaaaagagcaaaacaaaacaagca

SEQ ID NO: 162942 - DNA, 334 bp, Homo sapiens
ttatttccagctccaaatgttattattttcctcaaacccattataaaatggcctctcttagcactatgagatctgtaatacaagaagtagaacaaacacatgaagttcctgttggaaattcaaacttctcatacagccttcactgagttctactcattatggataaaggcttctgctttgagtcacctaagtacttttgacccccaacttaatcaatgccttgaagtgaaaatacagtgtcaggcagtccctattcatgacacaaacaaaccaaccaactcatatcatgacttaatggtgtgagacctcagtaaaaactttatatgaactaaat

SEQ ID NO: 162943 - DNA, 643 bp, Homo sapiens
catggcatacaagctgtatctgggtgtcttgtctactgctgtagcctcatctggtgtcccttgacctcttgctggctgcatcctggccttgcttgtcatctctggattcctttgacatgcgctacttctttcttccttaaggcctttggctgtcttgttccctcttccttgatagttcctcctctttctccttttcttcctcctcctcttcctcttctttctcctcatcatcactcttgtcaatcagggatgctgctgtatctcttatgtcaagccctgtgccttgcatttggtaggtactcaataaatacttgttgaatggatgaatgctgcatattggaacttaagttcactgggcacagtggctcacacctgtaatcccagcattttgggaggccaaggcaggtggatcacttgaggtcaagagttcaagaccagcttggccaacgtggggaaaccccatctctactaaaagtagaaaaattagccgggcacggtgatgcacgtctataatcccagcaactcaggaggctgaggcacgagaattgcttgatcctgggaggcggaggctgcagtgagcccctgcactccagcctgggcaacagaatgagactgtctcaaaaaaaaaaaaaaaaaaaaaaaa

SEQ ID NO: 162944 - DNA, 549 bp, Homo sapiens
aatgtgccaaagagcttatatccaagccaaacagcgtttgtattggagaagttgcctttctctcaaaaaggatggataggaagcagtttttaaaaaaaatctgcctgctttctgaagatgaacacaaatctggttacatccaacagaagatagaatgattatacaacatgaggcttaaatgtttgtcttttaaaatgttcttaggttatgcagcaagagtttacagtagccaacctgtatttccaaggagatttaatcagaggaagtatcaaagaattgaagattagtatgattttgaaggttttcctaattatttttctgatgatctcttctcaactaacagagctgttaagtagagttgattaaacaatgtcaattttttgaaaagcccttaatgacatatttacacagtagttatgaagagccccccaaagcccatcatggattataggagcaagttatagccattaaaaccatctgtgattatttttttgtagtagagagtgatgtcaagccatcagcttctgttcaacatatttcttagaaaag

SEQ ID NO: 162945 - DNA, 526 bp, Homo sapiens
cagctacttgggaggctcaggcagagaactgcttgaacccgggaggtggaggttgcagtgagccgagatggtaccactgcactccagcctgggtgacagagggagactctgtgtcaaaaaaagaaagaaagaaaacaaaagatccctgggaattcacagaaaccttgggggtgattaccagactttctgaaacatttggaagggggaagatgatgtaactccagccgatatctgcattacaatatatattatttcattttaatattacaacagaaaagaaacagaagatcagaaaggtgaagtgacttgcccaagattattcagctaaatagcagtgcaggaatcttaaatcagctatttctgactccagaaaccatattttttccaagacccagcacaactgaggagaaaacgtggcaacaagtgtgtactcagttaggtaatggttcaaagaattgagcaaatgcttcatagagaaagtgacagctaatttggtattttgatatcagataatcttatggagaga

SEQ ID NO: 162946 - DNA, 284 bp, Homo sapiens
atgctcgcaaaatacagaagcagagatcatcatcccttcctgtattggtattaacgagtcagccaacgtgggtgatcaagctctcaggaagatgatgacaggtgtcgttgacctagactactgcattgctgatgaagcagtagagactgctacatatgctgacagaagtggccaatccgccatggtatagttgaagattgggacttaatggaaaggtttatggagcaagtgatctttaaatatttaagggcagaacctgaagaccattattttcttttggtaag

SEQ ID NO: 162947 - DNA, 653 bp, Homo sapiens
tcattctggttctcaccactgaacttatatatgtacctgtttgcttacttctttactctggtcccctagtctggacggtacattttgtgagggcaggtacattttgttcaccgtacctagcatcctaccccacacagtgtccagagtgaggtagtgcccattattgaatgaatgactcaacatctcatatatttctcactttacctctccctaaggcaaagtgatcgtaaccccactctgtatctgggaagttctagctttctccctggtgttgaggagagcaaggcatcctaaagcatgaggatactttaaatagtggcaggttactagaaggatttctttggtgtaaaatactgtcccatcactcatctgctatgcaagactaccggctcatttgaaaagcccatttggctgccagtaacagacaccagaaataacagtggtgtaaactcagtggaaggcagtttctgtcctgagtaagacatccagagataggcagtccgtgcctggtgtggcagcttcacagtcatcaagaaaagcagagtgctttgatgcagggtccttctgctcaccatccctagcacagggcctttgtccttaaggtggcttcatggcccagtgtgactgctggagtcaagctagtgagtctggag

SEQ ID NO: 162948 - DNA, 628 bp, Homo sapiens
gcacccgataaagtaatgatgatgaaggcacataaggtataacaaagttttaatatgagaatcttcttgttcattaaaggttgtgcccatcatgtatatatataatataatctgttagatatatatttgttagatatctaatatatatacacagaacagaaagcttattagatatcatatatatattagacataatagtgaagaaaaacaaaatattctctaaatcacttgaggtaatccgtgagggccctcacggattacctcaaccaactaatgcagtctcaggtgtggaatgccaagtaattctaatgtttaaccaaggttaagaacccctgttctaggagtccaaaataggcagctcttgccattcatcaaagtacatagttgtaggatcttcattagcctcatatcaataatttaggtgaaaatggctctaacaaaattaaaaactcatactattttccctatctagtttcagggagcccagcttgaattatagctagtctcttttggtaccttctgagaacacaagaattagccaatcaaatcaattatcctgacattttgctaccacattcccccaaaccctagccttgtggcctaacagcttgaggtaatcgtgaaggga

SEQ ID NO: 162949 - DNA, 119 bp, Homo sapiens
cactttcaaaatgagggcactgacactgactcggtactactctccaatcctcacagctcatccagagctgccaactgacctcatgcggtcctctatggagacacaacccctgattcctg

SEQ ID NO: 162950 - DNA, 201 bp, Homo sapiens
tgcccaccaacaccgcaatcttattttttaatttttgtaagataagatcttgctctgctgcccagcttagagtgcagtggtgtgatcatggctcactgcagcctcaaactcctaggcttaccttcacatctggggtagttacgattacaggtgcatgtcacaatgcctgactaacttttttgactttttatagaaaagggg

SEQ ID NO: 162951 - DNA, 639 bp, Homo sapiens
aagtttaagccaccaggcaaactgccctgggtcccctgacaccagaccccatccacgcccagtaacactcttctgcttctatgaaaatgggatgcgtggtgagcagtttgtgctcatttgcacacacacacagagttagatacaggatagattaattggaaaaaaaccaccctggcttgcgctgcctcctggcctctgcctaaactgttcctttaatctaaaatgcttcacctacttacctccccgcaagtcctcccccaacatattcaaaatctggcccccttgtgctggcccagtacatagggcatatctgcaaattggaatagtagacagccatgaaaacctgcctttaaggtgttggcaaaaaatgaaataagactcaatgtgccacatatgaaagatcgccaggatatggcggctcatgaagaaaaccacggttcggaacagcgtgtaggctctgccccatctgtgtttttaaaaaaatgcacacagatgtaacatatatatatatatttgcataggctgagaacgtttttggaaggatacacaagatcacacaagaaaccattaggaaaggtgcctttggagagaagaatagggtgtaaagctgagagagatttcttactattgtataccctt

SEQ ID NO: 162952 - DNA, 439 bp, Homo sapiens
aagaggctcatctgtcagctgtggctcccggagcagtagcccggcagtaagtgtctccaggaggaatgtgaacaatgcggaaccacccacatctggaggctcccagtctcaatggagtagtagggacagagttactgtttgcactggcattggggattggcactatgctatccgctctcactcagcttattacccatggaaggaatttggcaaacttttttttttaagacaaggtcttgctctgtcatccaggctggaatacagtggtgtgatcatagctctctgcaacctcaaactcctggactcgtgatccccccacctcagccttccaagtagtgacgactacaggcttatgcaaccacactcaactaattttgtaaatttttgtagacacaagggttcactgtgttgtccaggctggtcctggtctcaaactcct

SEQ ID NO: 162953 - DNA, 334 bp, Homo sapiens
ttggtagagacggggtttcaccgtgttgaccaggctggtctcgaactcctgacctcaggtgatccgcccgcctcggcctcccaaagtgctgggattacaggtgtgagccaccgcgcctggccatgattttttttttaacctataaaagccttgagtagtgatggacgcgattcctagtaatgtggtttactaaagggtcaggctgtcagttcaccacaaatacgccacagtagtgtttggtattctctcaatgttccacccaccagagcatacaaaacagccacattccccaaacacttaattctcaaaacatacttgtagaggagggaagcct

SEQ ID NO: 162954 - DNA, 213 bp, Homo sapiens
ctgctgagagtatgtgaataaatccatggctgtgagagccttcctgtgcattttgttcccattctgcttccaagtataattccaagtccaccgtgtctagtagagcctccttcacgaagacggccctacaatggcatgaacggtttttgagtcttgcctccactggagatttctcccacctcgccatcctgctgacattctcatataactgcc

SEQ ID NO: 162955 - DNA, 339 bp, Homo sapiens
catttccactggattccatttctgaaggcattgacccatccattttatccaaagaaggtatattaaaacttctgagttctgctagtccagagcgtctagcagaattagaataaaatctgtcttgcctttgtggaggaagagctgaatcaggatatgattgtcctggtggaggaaacatcatcctacggtcctgttcccacggaggtgacaggggcccagtgtcagaaggagccttgtgaggatcagtaaacctatcacagcttgattctcctctttccttggtaatctggtggtccagaggattccctgggcctcttgggtctcttcctcctccccctg

SEQ ID NO: 162956 - DNA, 256 bp, Homo sapiens
tggatgattatggctgaatcttcatcatttctactgtcacaaagaataattaagaggtaacagtaaaatataataaaaggagtggtaagagaaatgaaaggactgtctaaatgttacaaaataatatggaagtaaagtagtaggagcaaaagccatattgctatgaaagaagttaacacatccatcttcttcgttgttacctacaaagaagaattgaatttgaatggttcttggccagagataatttgtgtcaact

SEQ ID NO: 162957 - DNA, 507 bp, Homo sapiens
atctttcttaaatgtatatatagctcacatttatttcaatgtttgatattagcagtgtttggggtctttatttagaagtttggttacatctttgtgaccagaaatgtcgtagaaacttaactctagttcatatcaattggcctatggtaaaattggtttcattatacgttgttttgcttaaagtcacagttttcgagaacctgttaacaaggttaagtgaggacttactgtactagctgacttaacagtttcagtcgggtttgcttctgctgttaacagtaatctcttgtcagagctagggccctgcagttactacctctgcctgccattgtacctttcctggaagatagtctaaacttggacttcacacatatgcgtgagctatttgctcttacacttcccagcagaggctgcattatgctgtggatttgtgcagaatgagggttgagtaataattacccttcacttgccaatcatgtgttccatttgcattcattattagcatgc

SEQ ID NO: 162958 - DNA, 252 bp, Homo sapiens
aatctacttttcttcctaactacaaatgtctcctctcaagaagttaaaactgggcataatgccatggagaatgaccaggttcacacttttccagaattagcatttctcagataaacacgcaacccacatatcaggaaaattaccatttatcagaggggaccaatcctaaaagttctgttagaacaccagaaatgatattgatatgcaagcaacgcgacatatcgagggttctgtgagtgtatattcctttgg

SEQ ID NO: 162959 - DNA, 323 bp, Homo sapiens
agccactgtgcccggcccagaacatgttcctttaaataaaaaggcatggtaaaattgttcaatgatgacagaataactgtatctagacacttaccctctaaattactgacagtttaaaaagtgactgtaacttactatggtaagtgtccgtatctctttatgcagtatcactgtaaacttctaagagaatcgtaaagatgaatgtaacagcaatccccatagtgagtcacagcacaggagaaccagcactctaaggtggggaggcagggaagctcttccccgagcccagggaagccctctgagcagcagctgatgttttcagg

SEQ ID NO: 162960 - DNA, 132 bp, Homo sapiens
tgacagatgaaagagtaagtgagcttgatgacagattaacagaaattgtccaatatgaacaataaaaagaaaaaggagtgattaaaaatgaacagagctctggtgtggtggctcatgcttataatcccagca

SEQ ID NO: 162961 - DNA, 369 bp, Homo sapiens
gccattcaagaaattttcccatttcacttaaatcatcaaatttattggcttaaagtcattcaaatatttccatgttatccttttagtatctgtagaattagaagtaatgtcacctctctaattttctgaatattgatcatttttacctcctatgttttattcctgaccagtctgactagaggtttatcaattttattaatcttcttaaagaatgaaatttgtgttatattgtttttcttaatttttcctatttaattgagttctgttctgatccttattatttcacgtcataaacttactctgggtttaatttgctgctatttttctagtttcttaagttggaaatttatagcacttagttgaaatctt

SEQ ID NO: 162962 - DNA, 576 bp, Homo sapiens
attgaatagtgtctcaccctcaattaatgtccttcccagaatctcagaatgtgagcttatttgggaatagggtggttgcagatgtaattaaggtaacatgaggtcacactggagtagggtaagcccttaatgcagtatagctggtattcttgtaagaggagactcagagacagacacagagagaagaacaccatgggccaatggaagcagggatggcagtgaagtgtctacaagccaatggatgccaagtatgcctggcaaccaccagaactaggagaggggcatggaacacactctcccttgaggtctccagagggaactaaccctgaggagaccttgactttcgactttcagcctccagaactgtgaaagaataaatttctgttgtcttaaactacctggtttgcagtgttttgttatggcagccacaagaagctcatacacacagctgtatctgtctgctttgcattgctataaaggagtacctgaagctgggtaatttataaagaaaagaggtttatttggcttacagttttgcaggctgtacaagcatggcatcagcatctgcttggcttc

SEQ ID NO: 162963 - DNA, 175 bp, Homo sapiens
tggcgtgaagtcccaacgggaggctccgcatcacttgactgtcttttctgttatgttccaggtgtctctgattgtctttctcctctgagcgtcccttatcttctttctaacctttgtcaccttccagatgtctctgccaccacagatctcttctgaggctgcccgtggccaccag

SEQ ID NO: 162964 - DNA, 402 bp, Homo sapiens
ggcaggagactagagagacatcttctctgaagcctacaggacttagcttcagggtatggtataaaagggtcagaatctaaaaactgagaaagtcattctgaggtactccaggccttcactcggaccactgcagtagccctccaaaagctggggcacagcagctgtacagggaagatttcttgaggtacagaaacttggtgcaagactgacacaaagacaactccccagtgacccaaaaagccggcagtcaggctgaaaaacagaaatcttccactgtttggtaagctggtcctggactgtgaagcatttaaaaacctccagagtttttccagggctcagatttcaagccctgctaagggggaagtcctgattgtgccttcaaaacatttgaagccagtgata

SEQ ID NO: 162965 - DNA, 575 bp, Homo sapiens
ttcctaaattatcccgctgcagggggagagagggagcagggtagtggagtcataccaagcaacaagaaagacagggtagtggccaggagttcgagaccagcctggtgaacatgatgaaacctcatctctactaaaaatacaaaaattagctgggcatggtggcaggtgcctgtaatcccagctactcaggaggtcgaggcaggagaatcacttgaacccaggagatggaggttgcagtgagccgagattgtgccattgtactccagcctgggcgacaagagcgagacttcattgaaagaaagaaagagagagagagagaaagagagaaagaaagaaaggaagaaagacagggtagtacattttccacgaatttcaattttactctcttcccccaccacacacacacaaaaagcatttgagggatgggaagaagaaactgagatcacagggaaaatagtaagagacatttagaaggacaggtcttagaaacgtactttgggggggaggtcagagaacagtagcatataaaagaacgctaagacagttcccaggttgaggcatgggtgactagtttg

SEQ ID NO: 162966 - DNA, 152 bp, Homo sapiens
acccttttgctaatagtaactaatcgtcactccacatcaccttcccagtttgcttaaaacccatctctttcaaatggcctcgtctggtgaaggctcttctgatttgcattattcttataaatatggaagtatacatagaccattaatccaag

SEQ ID NO: 162967 - DNA, 197 bp, Homo sapiens
ctacaagcagcttgacaccaccaaagcataccgcaccgggtggaaagagatggagcacacaacctcaccggcctgtgtgacatctcaccctaccttgaagatggcttgagcagagaaagaaagatgatgggagagtatggaacaaaactgagaagttgcagtgatgtaaaaaagatttcctaagctcagccctgctc

SEQ ID NO: 162968 - DNA, 449 bp, Homo sapiens
agggatagaagggatgcttcccacatctgagaaggttgatcaacattttggtaatcgtattctatctgttcataggctacttcaatttccacatgcaaatttaattttgaggctttctttagaatgacttctgcgtgtctgtgttaacagagttcagttccttaaaatgagaaagtgtccatggacctttaagtctacagttcttagtcttcggttgaaaagaatgtgtcacatttctgtcttttaacctttttataatgtaaccttttctatctttttctaaaagatagaaaattgtaaaaataatggaaattttatggaaaagtgtagttaaataaattatccatagttttacatagccagggtagtacctcatgtttattctgatatgtttgtttccaaattattttttctgtgtgtggcatatgatttttaaatacaatatcccg

SEQ ID NO: 162969 - DNA, 586 bp, Homo sapiens
ccccttaataaagaaataaaggatagatcttccaaaataacaaggatgtagtggaatgaataaaaatgtatcaagtcagcagcaataaggtaaaaatattagaaaagtaatgttaaatagttgtcagatggaaggatatatttgagcaaatattttgttaaatagatgacaaaaaggtaatatttatacattacatatatgtgtttgtatgtatgtatgtatgtatgtatgtatgtatttattttgagatatagtcttgcctgtcacccaggctggtatgcagtggcacgatctcggctcactgcaacctccgcctcccgggttcagacaattctcctgcctcaacctcccgagtagttggaactgcaggcgaccgccaccacacttagctaatttttttctttttagtagagacgaggtttcaccatgttggccaggctggtcttgaactcctggcctcgtgatctgcctgcctcagcctcccaaagtgctgggattacaggtgtgagccaccgtgcccagcctcacagatgtcttaaaattcacctgataaagttaggagcctcaagaaaaattagcagaggaa

SEQ ID NO: 162970 - DNA, 160 bp, Homo sapiens
tcctagcctcgccagtgtcctagcctcgccagtgtcctagcctcgccagtggcgtgtcatctgataatagtcctgctgatgggatctaccctggaaaatgaggaaaaaggaaagccgagaggttggccatctcaaggtttgacaggacaaagacaggttc

SEQ ID NO: 162971 - DNA, 404 bp, Homo sapiens
gacagagaccaggcagggcctggaagacgagggactgtgtcccaggaggtcccaggaggtcccaggaggctgtgctgcctcaggtaaaaggcaacaaaaccaggcactgagcctccaaatctgcctttttttctgagatggagtctcactctgatgcccaggctggagtgcagtggcatgatctcagctcattgcaacctctgcctcctgggttcaagcaattctcctgcctcagcctcctgagcagctgagattgcagatgtgtgccaccacgcccggctaatttttgtatttttagtagagatggggtttcaccatgttggccaggctggtctcgaactcctgacctcaagtgatctgcccaccttggcctcccaaagtgctaggattacaggcatgaacca

SEQ ID NO: 162972 - DNA, 451 bp, Homo sapiens
tgcccagcgcaggtcacgttctcctgtgatgtttacggttctccttgatacggggtaacttaataggcaatatgtgtgtattacataagaggataagagagggaagaaaactgctatgtgcctaaatataacatgcatagattatatatgacaagtattggtcacaaaataaggaggaaatactccaggcattgatggtcctcgttcctgtaactggtcctgtggacacagccactttcttccactgcccattctgtggtcttgtggccttcagcaggcacctcactggttgtggttctttctggtgaggtaaagtaaaaaagaagttggtagcacatttgattaacacgtgtcttaagatttatttctaaggtataaaagtatgatcagttgtttataaatccaaaagtaataatacatgctgggtttaagatttgaaaatgggaatgag

SEQ ID NO: 162973 - DNA, 239 bp, Homo sapiens
gtttcctcatctgctatgtgaagatggtaatgcgctccctatctcactaaagagcactgaacgagacaagctatctggaagcatgttttaagctgtaaaagggtacacaaagaagagatgtaataattgtgctgtcatctttagttttttttagctaaaaaagctaaaagctactatcatctttagccacacattcaccccatcaccttatgttaccatttcctttatccctgtacttc

SEQ ID NO: 162974 - DNA, 385 bp, Homo sapiens
taagttaccccagggctgccagctcttgagaaatttctgtagctttttcaagtgtgtcttcacatacaaaatgaaaataacatcgtcagtcaattttatctgataaggtatactgaacacctgttatttttgcatcccagcctctgttcaccattctcccaataattacccccatttctctctggactccaccccttcatacatgatctcaaagactgagtatacagcccaagcctaagccatgggaacacatcatgacccgggattcagtggttggttctccaatgagtttatgacctaagtagagaccctgagatgcaactgaaacttttgctgggaatagctaagataaaaactctttttctttccccagtggatgtgatct

SEQ ID NO: 162975 - DNA, 1222 bp, Homo sapiens
gtgggtggatcatctgaggttggaagttcgagaccagcctgggcaacatggtgaaaccctgtctctataaaaatacaaaaaattagccaggcatggtggcacatgcctgtagtgccatctactcaggaggctggggtgggaggatcacttgagcctgggaggtggagattgcagtgaaccaagattgtgccactgcattccagcctgggtgacattaaaaaaaaaagagagatcatcagtgtaaaagatacacaattataaaatcaagtaagtaaaaactctaatattacatttaattgggaatatcagaattaactcttatttttaaagtgcaaaagttttaaattttcattaagtctgaccaatttttgttcttttattgcttgtacttttggtgttgaatctaataaatcattgattaacctcaggtcctaaaggtttacttttgttttcttctcaggattttctaattagaaaattaggtctgtcattttgagttaaattttgtgtatggtgtgaggtaggggtccaaattcatccttttgcacatggatattcatttgcttcagcaccacttgttgaacagactttttttcctattgaagtgtcttgtcactttttttcaaaaatcagtatttcatggatgtttgggtttatttctggactttctatttcattgatctacttgtcacttcttatgccagtacgacactgtctcaattactatagctttgtagtgagttttgaaatcaggaagtgtgagaccttcaactttgtttttttcccaaggttatttggctgcgtcttttgtatttccataagaattttaggatcagcttgtcaattgttgccaaaaaaaaaaaaacttcctgggattttgataatgattgtgttgaattcatagggcagtttggggagtgttgccataatgatagtaaatcttctaatctatgagcaggatgtttttccatttatttaatctttaaatattttattattttagatctattgagaatggaattgttttcttaatttcattttcaaattgtttgttgctagcatatagaaatacaagtgattttgtatattgctcttgtatcctgtgactttgctgagcttattttagtagttttttttcactgaattctttaggattttctacataaaaaattcatatcatctgtgaataaagacagttttatttcttaatttttaatctttt

SEQ ID NO: 162976 - DNA, 618 bp, Homo sapiens
ccatcaggttattatgctatgacagaattttagacctgaaaatgtcattttaagtcatcccattcgatcatttttagttctactcattttcataccatcctcacaatttttgccatatctgcatactacttgttcttttttccttaaaattgatttactttttttaaactttaatcagttgagccttatatcagtaaaatcccaggtttcatttgctaattagtttttttcaaatatgcattaaaataaacatataactagtcaaaacattttcacctttgtgacacctataatctctacaccttaggaaacactggtctaatttaaatccttcattttgcaaactgagaaataggcccaaaaagatagactgatttaggcaggagctctcacagcttcagtgagacatccagggctagctggattctgcctgtttgtatatagttcttttcacaaggcaggagtgatgcacattagaattttaaagactgcctttgctactgtaacaaagatggcacccttttgtgattggttacttgtttccctggcactgcaactacacagtgtacaaatggattgagggaggaaaagtggtaaagaaaaccaattctcaaggac

SEQ ID NO: 162977 - DNA, 565 bp, Homo sapiens
ccatcaggttattatgctatgacagaattttagacctgaaaatgtcattttaagtcatcccattcgatcatttttagttctactcattttcataccatcctcacaatttttgccatatctgcatactacttgttcttttttccttaaaattgatttactttttttaaactttaatcagttgagccttatatcagtaaaatcccaggtttcatttgctaattagtttttttcaaatatgcattaaaataaacatataactagtcaaaacattttcacctttgtgacacctataatctctacaccttaggaaacactggtctaatttaaatccttcattttgcaaactgagaaataggcccaggctagctggattctgcctgtttgtatatagttcttttcacaaggcaggagtgatgcacattagaattttaaagactgcctttgctactgtaacaaagatggcacccttttgtgattggttacttgtttccctggcactgcaactacacagtgtacaaatggattgagggaggaaaagtggtaaagaaaaccaattctcaaggac

SEQ ID NO: 162978 - DNA, 261 bp, Homo sapiens
gaagggacagaataaggagcagactgacttggtgggacgagaggcagcaggtagtcaggagcctcagtggcttgctgcctttagccttcccagtacttttcagaagctcagagaaacgtgcgtgattccagggagggtagggtcaaatgacttttgggagattctctgacctgctcttatttaggttggcactgtacaactccagagggtgccagttacataatctgtgcagggcacagtatgtgccatcatgcacagcag

SEQ ID NO: 162979 - DNA, 384 bp, Homo sapiens
gaagttacctcaacacagaagcccaggtcccatcctacagcacagctaagccaaggcaagagaaagactgtttaggatgttccatttccgcagtcaagagagggagagtacaggaggagaagaaacacgcttcattcctacatagccacacacacatttaattgtagcccagtttaaattatactctttgctatttaacgtcctccattacttatgaggctttgagaattaaggcaactttctaattcttaggagacttaagtcactcccctgttacgctactttgaattacttggtatcatccaaaccgagcaagaaagagccagcctagttcaggaaggcttcagccagacacgcaggcagctgccggccgactctgagtct

SEQ ID NO: 162980 - DNA, 1988 bp, Homo sapiens
  misc_feature (1)..(1): n is a, c, g, or t
  misc_feature (5)..(7): n is a, c, g, or t
  misc_feature (264)..(264): n is a, c, g, or t
  misc_feature (1627)..(1627): n is a, c, g, or t
  misc_feature (1693)..(1693): n is a, c, g, or t
  misc_feature (1744)..(1744): n is a, c, g, or t
ngacnnnggggaagggagtgctcccccaccagcagcctggagaggctctgcaggcacaagcatcagcgggaacgcagccacgagcggccagacaggaaggagagtgtggcgtggccccgagaccggaggaagcggaggtcccggtccccaagctcggagcacagggcacgggagcacaggcggcctcggtcccgtgagaagtggccgcagacccggtcccattccccagagaggaagggggctgtgagggaggcttccccagcnccccttgcacagggggagccagggcgggaagacctccccaccaggttgccagccttgggggaagcacatgtctcgccggaggtggctacggccgacaaggcccccctgcaggctccccctgtcctggaggtggcagctgagtgtgagccggacgacctggacctggattatggcgactccgtggaggccggacacgtctttgatgatttctcaagcgacgccgttttcatccagctcgatgacatgagctcgccaccttctcccgaaagcacagactcttccccagagcgagacttcccactgaagcctgcgttgcccccagccagcctggccgtggccgccatccagagggaggtgtcattgatgcacgatgaagacccttcgcagcccccacccctgccagagggcacccaggagccacatttgctcaggccggacgcggctgagaaggctgaggcacccagttccccggatgtggcgcctgcggggaaggaagacagcccctctgcgagtgggagggtacaggaggcagcccggcctgaggaggtggtttcgcagacccccctgctgcggtccagagccctggtgaagcgggtcacctggaacctgcaggagtcggagagcagcgcccccgccgaggacagagccccccgggcaccacttcacaggccacagaagccccgagaaggagcctgggacatggaggatgtggcccccacaggggtcaggcaggcgttctccgagctgccctttcccagtcacgtgcttccggaacccgggttcccagacacagacccctctcaggtttacagccccggcctgccgcctgccccggcccagccctcaagcatcccaccctgcgcactggtcagccagcccacggtccagttcatccttcaggggagcctgccgctagtgggctgtggggcagcacagaccctggccccagtgcccgctgccctgaccccagcctcagagccagccagtcaagccactgcagccagcaactcggaggagaagaccccggcccccaggctagctgcggagaaaaccaagaaggaggagtacatgaagaagctgcacatgcaggagcgtgctgtggaggaggtgaagctggccatcaagcccttctaccagaagagggaggtgaccaaggaggagtacaaggacatcctgcgcaaggccgtgcagaagatctgccacagcaagagtggagagatcaaccccgtgaaggtggccaacctggtgaaggcgtacgtggacaagtacaggcacatgcgcaggcacaagaaaccagaggccggggaggagccgcccacgcagggggccgagggctgaggccaggcaatcacgggctatgccnggggagctgtcgggagtggcgggaatcggggccatgcccggggagctgtcgggagtggcgggaatnggggccatgcccggggagctgtcgggagtggcgggaaatggggggcatcancatgcctgccgtcgggttcctgcgctgacacctggtctgtgcacctgtgttgctcacagttgaaaactggacacttttgtatgtatattatagagacactgtttccattctaatttatcaaaaatggattatctttagaaacctcttgattgacttactacttggaagataaagcacttggtgatcaagaggggctcctggtggggtggcgcgtccttgataaatctctaggtggcctcccgcc

SEQ ID NO: 162981 - DNA, 416 bp, Homo sapiens
tgggcagaacaggtcatggtcggggatcagtggctaggagctggcacacctcgcaacctccccttggtgctgggggtggatctgagggctgctctgtggtccttgctcctggtgcttttctggatttttccagccatgaaacagcattctgggcaggggtgggcacagagcacccacctccctgtctgtcgggcccccaggggcaccacttcacaggccacagaagccccgagaaggagcctgggacatggaggatgtggcccccacaggggtcaggcaggcgttctccgagctgccctttcccagtcacgtgcttccggaacccgggttcccagacacagacccctctcaggtgggtgtctgggctggagggctgtgggccgtgggcagtggcctggcacccgtgccacacacac

SEQ ID NO: 162982 - DNA, 477 bp, Homo sapiens
gatacatatacccacctggggaccttcctccaaagactagtagcagtaagtctacaaaaagaagagagatttcctctttctagctcattgcttgaaatcacttctggtttctagggagcataaattctgaggctatattctccaaaaggaagtcgaaggggtacctcttttccaacaatgttaaagtaattctagggttaatgttttgccaaactgggagattccacagaaatatgtcccagtgactcaggaggctgaggtgggagatcactttagcctggaagtttgcaaccagcctgggcaacatgacgagacctcaactctacaaaaaaatgtaaaaacttagccaagcatggtggaacacacctgtagtcccagctacacaggagactgaggcaggaggatggcttgagcccaggagttcaaggctgcagtgagatatgatcgcattatcaaaagagagcaagatccccaatt

SEQ ID NO: 162983 - DNA, 278 bp, Homo sapiens
gggaggggtgtgcaaagctctggaaggcccatttgagcaaggtgtgaagccctcaggagactcctttaaagaagtcatgtgccctacccaaggtcacagagccctttgtgacaaagtctcgaggttcatactttggtgcgccattcaatgagacatctagttctaattaaagaaaatgccaggccgggaacagtggctcacacctgtaatcccagcactttgggaggccgaggcaggtgaatcacctgaggtcaggagttcgagaccatcctggccaa

SEQ ID NO: 162984 - DNA, 122 bp, Homo sapiens
gagatactgatgcagccatctttggaaacattctacttagctaattttatgctaggctttaggtcaagaaggagagagagagctgacatgctgtggtacacacttatagtcccagcgacttg

SEQ ID NO: 162985 - DNA, 284 bp, Homo sapiens
ttttaaattaatatttaaccaacttattaaaatttctacacatcattcagtgaattggtttgttataaatgtttatggttggtgtaagatgaaaattggttccttcaagtgcttttattctcttttctcctctttcccttttacccataaataggaacttattatcatacttagctcctgttttcttttatagatgatatttatgcacaggatagattatccaaaaattagagtgaaagagggcagtgaacaataatgtattgcaaaataataatgaggtatga

SEQ ID NO: 162986 - DNA, 198 bp, Homo sapiens
cttgagcaagatctcagcagctccacttggatgctggaaatatatgccagaggagacttatgatgctaatttcctttagtaaacagttcaaatcttgtcttggacaccaatgaaataagaaaagctagccacaggctgtgtggaattccttcctcttaacactaagcatcaggcattccatgacttttgctcttggga

SEQ ID NO: 162987 - DNA, 484 bp, Homo sapiens
gtctcaccttctgtcataaatagctttatcgaacattttaatgcaggcagactctcgtgaaagaaattctggtgaattccattgtttttttctccatcttattacagtatgattaataagttagtgactacaaggttgtagtttttaagagcaagaagtccactccctttcaagtcacattgggcagtccttctgttcatacctgacatattgtgggaacatatgtctgcgtaggattttaatacagagattgtcttagataagaataatcgtcagagaagcaaatggtctataagttatttaattttattcttaatatggtcaaagataatggttgcactgacttcaactttactttcttaaattccattaattgcatagcactagaattttccatataaaataaaatcagatcccatgtcacacagtactctgagtcactctgtgactcctactcttgaagatatagtcctacctgcagatg

SEQ ID NO: 162988 - DNA, 328 bp, Homo sapiens
gattggagggcgcagcaggaagcagggaggcggctcaggtgacgggcaggtgaggagtgacggggcggtatttgggcgggaggcggggagtgaagaacaaagagccgttccggagacctgggaggcattgcccatgggtcagggctacactggttttctggctgggctttctgtctttctccaagctctggacacaccgcaccgtgagaaaggctcctggaagcagagcaaccctgcccgggggctgtttctgaaggggcagagcagaggctggaaaacctgcaagccttccctcagagtcactgcgttccctcgtgccacgctcccc

SEQ ID NO: 162989 - DNA, 296 bp, Homo sapiens
cctggcagaccttgccgggctttacattggaaaacgcttgcgggtggatcacttgaggtcaggagttgataccagcctggccaacatgatgaaaccctgtgtcggccgggtgcagtggctcgcgcctgtaatcccagcactttgggaggcctaggcaggaggatcacttgagtccaagagtttgagaccagcctgggcaacatggagaaactctacaaaaattacaggaattagctggacgttgtagtgtgtgcctgtgttcccagcttcctgggaagcagaggcaggaggatcac

SEQ ID NO: 162990 - DNA, 249 bp, Homo sapiens
gtgaatagggattttcagtaactgtgattgtttggtgatagattttttaaaataactcttgtatgtagatgttctggaactagagatttgttccccaaagagaggcagcagaatgctgtgcagaacatggcatggcatgtcaagagactcttgagctaattttagctctgccaccttggggaaggaagccatttctcttctcagggcttctgattcttctgtgaaataaaatgaactttgcacgctcta

SEQ ID NO: 162991 - DNA, 196 bp, Homo sapiens
ggacaatctttcctccaagaaagaggatagtaaactaaagagttatttacatcaatgacttttttgttgtgccttttgtagggaggagccagagatactctggtggtgggagggatctaaaggagcctttgaatgaatgctgccctttaaaaagagaaaattagctgggcgtggtggctcacacctgtaatcccag

SEQ ID NO: 162992 - DNA, 1141 bp, Homo sapiens
aggaactttctcacatttagtagcttgaggaaagggatgaagaaaattgattgtgtttgtgactaagtgattgattttccagagaggaaaaaaggtggccttgaaagaaaacagtgagaagacttgggctacactggtgtgagttttaagggtaaggaaaatgctgtagaatactgtccttgacttgatggaactctttatgggagagagagtaggcctcaggtgtgcttgcatggttttgagacaggtgatgagtttctcttggtcttgtgctgatgctggtcctgcagctgcaagaacagatcataactttcctctgtgtagggtggaaaagcatttgttctctggatgtgcattatctcattttgattctggcagtgggcccaaatgctaagtgtcttgcccaaagtagaaatttccagttgctacttccatggtgtgccgcacaggcaatggctgagttcttgtagcttcacagacatgtagacacgagagaaagccaagggtacgagctggagacatggatgtgcgactcattcaggtatagattaaaatggaaccatgtatatggaggagcatccccagagattacatgaataacaaactgaacattttttcattcaatgtgtttgttttggcttgtaagccagtttttccagagatctacttgatagagggaaaggagaaaggaagatgtcattgaaccaagagaaaattgtctttctccataccttggaatattatttggcaataatgaaggaatattatttggcaataatgaaggaatgaaggactgatatatgatacagcacagatggactttggaagcatactaagagaaagaagctagtctcgaagaacacattgtatgattccattcctatgaaatgtccagaatagcaaagctataaagatacaaagtagattagtagtcacctttggccagtgaggttggggagaaatggagagcgattgctaatgattacaaactttccttttagcgtaatagaaatgttctaaaagtgatgattgtacaatgttgtaaatatattaaaaaccattggcttgtgtacttcaagtaggtgtattgtattgccatatctcaataaattatatctcaataaagccattttatttatat

SEQ ID NO: 162993 - DNA, 353 bp, Homo sapiens
cacatttggccttgaagctccacccaacatgacatttccaacaaaatgcctgctgcccaagactaatgaatggaatataggtcagccagaagctagagactttgaaaagccagaggttccccccagcctcatttgtttctgtttgcccagaaaatgtctgtgcagtcctaaaacaccctaggaaaaagttgagcaccatttaataataaaattgacaagataagagtgattcattcacatgttctgcttgtagaaaagtgctaaaaaatatgaggaaaaaccctagtctataaatagagcaatgcagagccgaacatattacttattatggcaggtacgcattaattatctcc

SEQ ID NO: 162994 - DNA, 730 bp, Homo sapiens
taagcctgtcttctgttctccttgtgggccccagggttcctgtggatgtccccaccctcagattgctggagtagaaaacttaactttccaaaacactgagttgttttcagcccagcattagaggttaaagatgctcatgtagaaagcacgcaggatggatctgacgaaggaaacagcttctgatacttgagcaggctttggacagtgcagatgaagggggctgagatactgaggcagtaaagagaacggtcagcttggggtctggagtcgctgggcactgagtgcgcgttctgagtgccattcaagcaccacgtaacggttggggctggtgttgggtcctgagatgggccatgggccaccgttaaactcaggaagcacgtgctgcccccccccactctagaaggcgggctgttttcctggcgctgtgtgtgccatgctttgtgtgaacatctcactgggtgtcgctctcatgtggtaactgggcatcttgtagaagtcgttgctcctaaacgtaagccagtgcccacattgggtacgttctggaagaaacagtgtggcccaacatgggcttatccagagacaggacacctgctgcctggtgacgtcaccacctcccgatggcaccactctgttctactccactgcccccgggtcctgacttgctactatggaactaaccctgtaggatgaggccgccatgcccgtgtgtgtgtctgtccagatctgtccc

SEQ ID NO: 162995 - DNA, 151 bp, Homo sapiens
ttgaggatgaagatctgtcatcaaggagtgtttaaaacattctcctcatacaaaacccctctaattaaggccttttgatggaccgtttggaaagtttccctgggtgtgggttatagcaggatacatttgatgtccactgagttccgggtac

SEQ ID NO: 162996 - DNA, 141 bp, Homo sapiens
atgccttggctgatagtgatttcctgctagggctgtggagttgaactgcctgcattcaagtcctagtttgcttactgttttgtttttgttgttgttttgagatgaggtctcactatgttgcctgtgcttgtctcgaactcc

SEQ ID NO: 162997 - DNA, 332 bp, Homo sapiens
ggctatgcactagttggaggtcctgaactgaagaccccagcggcagggctgtctaggggtgggagatggaacctgaaaaaatcctgccctcacatggcagaaaatagtcagctgggggcagaagacccaggtcttaaattgcagtgacagtggtgtacatgcattgctctccctctgatgaaagctgttgacttcagttgagagagacttctgctgcaatctgaggctgaatgtcaggaaggccatataaaaggcaaggcctaagcacaattttctccaattttaaaaacttgtcagcagatacctctacagtaagagcaacaggctatgaa

SEQ ID NO: 162998 - DNA, 259 bp, Homo sapiens
ttattctctgcaggcagccaagcgatcgttgtaaaacaaaaatccaaccagatctctcaatcaaaacacttcaatggctcatccttgtctttaggataagattcaaactcctcagtgtggcacccagagtcctatgaggtctgcacctcctatctctatccaccttgaactatttatgatttgttaatttgcctcccaaacctctatgatttggtacaaaccacctacttggaaatgtgcctctcccctgccaccttct

SEQ ID NO: 162999 - DNA, 398 bp, Homo sapiens
agaaaaccaactcatgtctccagtaagaagataatggctgaaatttgtgaattgaatttggcaataaggacattattggcaataactgccaagataatttcaatagagaagaggcaaaagcaataatgcaatgagctaaagagcatatgagaaaccaagaatcagggatgttactggagccttgacttctaaaagcccatctgagtagtaagggagggtgatgtcacagcagtacagtaacaggagtcacaacatctgttgtgactgctcttcaggtttgagaacatatgtaaggcagaggaaagaagtcattagcaagcctaaaacaggaaacttagaaaaagcaacaagacatgatgaataactactaaagttaagggaataatgactggaaacat

SEQ ID NO: 163000 - DNA, 233 bp, Homo sapiens
cagacatctcccacccacaaggaggctcaggaggctgggcagggacgcagcacctcctggggatttaacccagccggggcttgcaggcaagaggggagtgaaggaatgacactctgtcctcacccagggccgtcctgctggatggagtcacagggacggcaggggcctctccagagctgcctgtgggcacagaagcaagcctgggggtgccccaccagcctgagcccatcacg

SEQ ID NO: 163001 - DNA, 276 bp, Homo sapiens
tccatgttggtcaggctggtctcgaacttccgacatcaggtgatttgcccgcctttgcctcccaaactgctgggattacaggcatgagccaccatgcccagacaagacctccacaagttttaatggtctccacagggagactggatagcactgtgattatgagcatgaagtgtcattatgaggagtgtgtgtgaaagagatatctggctcaatttctagacctaccacttatgagctctgtgatcatggcaagttacctaacataccttagtctct

SEQ ID NO: 163002 - DNA, 525 bp, Homo sapiens
acctggaccgtcatagcagtgggctcctcacctccagagaaaacacttattaaagccacatgaatccctaacatagtacttgtattaatgatgactcgtagggcaaactatttatgcagcttttcccacgtgaactcatcatagaactttttttccccctgaaaatatcatgggcagagttacataatgaagagacaggaaagtctttagagcatcttccatgccctgatattttagtcttttaggaagagataaagcattgcttcttccctatctgtttaatggaaagggaactgtttctcatgcagctgacaggcaaagacacatcttcctctcccctttccacccctcaagcaaaaggcaacaaagtcattagaagctgggcattaaacaactaaaatatactgatattcctaggggatagtccaagacacaccccagctcaggtacactctgtatctgccctcagggtgcagaagcagaagagcttttacagtttttataaaaaaggagtacatacaaaaa

SEQ ID NO: 163003 - DNA, 152 bp, Homo sapiens
caattgtatctctaacattatcaacttttaatttcattaatcttctggcttgtatgtttgggttttttggggtctcaatttcattcattcctgccttgatctttattatttctttccttttattttatttaataaattaattttttttttgg

SEQ ID NO: 163004 - DNA, 140 bp, Homo sapiens
tatgtgaacgtgtggaaacaaaagtctacctggggtgatgctgtctgcatcactcgtcttcagagcccctactaccccagggcgccaggcaactgtgcaaggctacctcagagatgccgagccagggagagggggaaaaa

SEQ ID NO: 163005 - DNA, 195 bp, Homo sapiens
tgctgagactacaggcgtcagccaccacacccggccagtaaaagataaaattgtttatgattagaagccattcttctatttgagatgtgaaggaaaaacaggataggaagtattgatggttagtggcctctagtatatgcaaacagtaacatctttctcataggctgtttcttgactaccttggatttaattacg

SEQ ID NO: 163006 - DNA, 240 bp, Homo sapiens
cccaccccacccaggatgtctcatcccgagatcttaactagttacacctgcaaggccccatttccaaacaaggccccaattctgaggctctgggtgaacatgaatctgggggcacaccgtacagcccaggacagcaggcagcgccggagtgactgtctcctgccacgtggtccactgaacactagcacagaaaacgtttctttgaaagccctacctaaaaataaatctcactgaaaaatg

SEQ ID NO: 163007 - DNA, 134 bp, Homo sapiens
tactccaggaggttttatactgcagaccaatgtaccatagtactatttgggatgtgtgagggtgataacttggtaaaatagcaaaggaccaattagaaaagaataagtggaaaagataacccagcacccacttt

SEQ ID NO: 163008 - DNA, 360 bp, Homo sapiens
tgtcttagtccttggaccaatgcaaacctcacagagatttttctgcaagagggggaacagttttgtcttcaaagtcaaggtgaatgcagcataaggagccctggaccagcagttgattaagtaccagctctatcactcttccactatgcgtccttgattcaaaagcccgcttcccaccctccccgcaaacagcaagttcactgaatgtaaaatgtgggcaataaaccctgctttgtcttgctttcaaggttatttgtgcaatacgctttgcaaagtataaattgataggtgtcagggatgtgttcatttgttttaatcatgaatactgaaataaaataaagtatggagaaagtacaataa

SEQ ID NO: 163009 - DNA, 373 bp, Homo sapiens
ggcgctcccactggtcctgctcacagctctgccatgccccctgaccttggtgtgctgtttcacaagagcatgccctggtgcaggatgagggacaggtggctggagaggatgggcagtcaacacagtccatccttgtgtttggaaacacatgttcacttgtgtgcaatgttgggattcgtggagaagctggctggaaagttggtaaagtatccagaagacaaggttttgccccagctactcatcatctgaacagccaggtagattctactttgcagactgagcctaagccttgaactctatcgggaaataaacagagatggtgaactgcgatggaacccaagtgcagttagttacagcaaacacatctcatgtg

SEQ ID NO: 163010 - DNA, 495 bp, Homo sapiens
catctgcccggcatccgaagactcgcgccactctcccgtcgggctgcgcctccctcgcccgcgcggcaccgccggtccaggtcgcagttggagcgcggtcggggagggcagaggtggcgtcggaccctcagggccccgcaggagtcgcagcgcagggccggagcgcgccgggccgcagcttcccgcgaacaggaattcgctgggggctgcgacggcgacagcggcggggactgagggcggggaggcggccagatcaaagagagccgcccacagggtcaagacgggtcggggagcgccgaggggcccctcggaggagggtgggggacgtccaggtgcgcggaccctagagctgtgcgggcgcccacgcgaggagccggggccagagaggctgtgcgagctgcgcgcccccgccccgcgcggccccgtgccccgcgcgcccctcaggatcgccgggtcccgcccccggaggaggcgaggcggggcgcgactgggttc

SEQ ID NO: 163011 - DNA, 593 bp, Homo sapiens
  misc_feature (441)..(441): n is a, c, g, or t
  misc_feature (484)..(484): n is a, c, g, or t
  misc_feature (579)..(579): n is a, c, g, or t
  misc_feature (583)..(584): n is a, c, g, or t
  misc_feature (587)..(587): n is a, c, g, or t
  misc_feature (589)..(589): n is a, c, g, or t
  misc_feature (593)..(593): n is a, c, g, or t
aaccagaactccagagagggaaaacatctatcttgctgtgtttggacaggccagcccctgaaacatcttgggcaatggagggttaacttctcaaagtttaataggcaagaccagcaaccatgcaacaaggacttcaactaaccaactaaagaactgttccccagagcattgttcctgagaaggaaaagagtccaaacacctacccacacctgctttgtgccaagaatccacagttggattgcaaggacagtgcgttcaagacccagctgttgagagtagaaaagcagaagaaaggacccgaggtcagcaagtgccctccccacaatggggcagatctgccagcgagaatcggctacagcagctgaaaaaccaaaacttcatctacttgctgaaagtgagatggtccacagaccgaggcttgcagtggaagcagctggaagnggtgctgtgcggtgtcctccccaactcccaaatggagtgtggngagggattcttcgggcactgatgtttggctggagcagtaaagcagcggtgatgtggaggcagcacctaagagaaggggacaggattatggagatntganngtntntgtn

SEQ ID NO: 163012 - DNA, 589 bp, Homo sapiens
  misc_feature (19)..(19): n is a, c, g, or t
  misc_feature (24)..(24): n is a, c, g, or t
  misc_feature (27)..(27): n is a, c, g, or t
  misc_feature (482)..(482): n is a, c, g, or t
  misc_feature (491)..(491): n is a, c, g, or t
  misc_feature (561)..(561): n is a, c, g, or t
  misc_feature (580)..(580): n is a, c, g, or t
tcaattcgagctttttccnttttntgntaacaccccctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgaagaaatgggtgactttctttgggcccctgggatctttgggagggaacccaaattttcccgtgccgccttgcttgggaaaatgcttgaccngggggaatncctttttaaaaagttcgaacccttgcaaggccattgccaaaagcctttgggcaaccttgggcccgtccgntttttaacaaaaccgttcngtggaactt

SEQ ID NO: 163013 - DNA, 3631 bp, Homo sapiens
atccttaattaaattaattcttccccccccgggaggagccgccgagcagccgccggaggaccacggctcgccagggctgcggaggaccgaccgtccccacgcctgccgccccgcgaccccgaccgccagcatgatcgccgcgcagctcctggcctattacttcacggagctgaaggatgaccaggtcaaaaagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaa

SEQ ID NO: 163014 - DNA, 3633 bp, Homo sapiens
tcatataagtcggtcctcgagaacgtgtatcggagaggagccgccgagcagccgccggaggaccacggctcgccagggctgcggaggaccgaccgtccccacgcctgccgccccgcgaccccgaccgccagcatgatcgccgcgcagctcctggcctattacttcacggagctgaaggatgaccaggtcaaaaagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaa

SEQ ID NO: 163015 - DNA, 3984 bp, Homo sapiens
aaccagaactccagagagggaaaacatctatcttgctgtgtttggacaggccagcccctgaaacatcttgggcaatggagggttaacttctcaaagtttaataggcaagaccagcaaccatgcaacaaggacttcaactaaccaactaaagaactgttccccagagcattgttcctgagaaggaaaagagtccaaacacctacccacacctgctttgtgccaagaatccacagttggattgcaaggacagtgtatgttgtccttttggaaaaatgagagtgagcccaaatgaagaacaagcaaaggcgttcaagacccagctgttgagagtagaaaagcagaagaaaggacccgaggtcagcaagtgccctccccacaatggggcagatctgccagcgagaatcggctacagcagctgaaaaaccaaaacttcatctacttgctgaaagtgagcattgttgatgctcttgagagcatcagccaggacattaatgtgcaccactgtggtggcgtggaaagatggcaaaaagagccctgcatgattttattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaa

SEQ ID NO: 163016 - DNA, 3930 bp, Homo sapiens
aaccagaactccagagagggaaaacatctatcttgctgtgtttggacaggccagcccctgaaacatcttgggcaatggagggttaacttctcaaagtttaataggcaagaccagcaaccatgcaacaaggacttcaactaaccaactaaagaactgttccccagagcattgttcctgagaaggaaaagagtccaaacacctacccacacctgctttgtgccaagaatccacagttggattgcaaggacagtgcgttcaagacccagctgttgagagtagaaaagcagaagaaaggacccgaggtcagcaagtgccctccccacaatggggcagatctgccagcgagaatcggctacagcagctgaaaaaccaaaacttcatctacttgctgaaagtgagcattgttgatgctcttgagagcatcagccaggacattaatgtgcaccactgtggtggcgtggaaagatggcaaaaagagccctgcatgattttattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaa

SEQ ID NO: 163017 - DNA, 4192 bp, Homo sapiens
aaccagaactccagagagggaaaacatctatcttgctgtgtttggacaggccagcccctgaaacatcttgggcaatggagggttaacttctcaaagtttaataggcaagaccagcaaccatgcaacaaggtcagggaatgcactggggctgacgacaaggctggaacgtcccgggattgaagcttggatccgaactgttggacggcgtctggagttttgcacaaaagagaattgaattgtagatcagctgggaagttactgtggtagtcctggtgccctgcggcctccagcgactggaaccctgtgggagcacatagctggcattttttgctagagattaggaagtcttttgcttcctctgtgaaaaggcttgaattcaatggactgtgtggacttcaactaaccaactaaagaactgttccccagagcattgttcctgagaaggaaaagagtccaaacacctacccacacctgctttgtgccaagaatccacagttggattgcaaggacagtgcgttcaagacccagctgttgagagtagaaaagcagaagaaaggacccgaggtcagcaagtgccctccccacaatggggcagatctgccagcgagaatcggctacagcagctgaaaaaccaaaacttcatctacttgctgaaagtgagcattgttgatgctcttgagagcatcagccaggacattaatgtgcaccactgtggtggcgtggaaagatggcaaaaagagccctgcatgattttattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaa

SEQ ID NO: 163018 - DNA, 3927 bp, Homo sapiens
aaccagaactccagagagggaaaacatctatcttgctgtgtttggacaggccagcccctgaaacatcttgggcaatggagggttaacttctcaaagtttaataggcaagaccagcaaccatgcaacaagaagatactctataaatgatgattcaatgaatgccaagccctgttctatgcactgaagaccaaaagaaataaaagacatcattcctgctctgacttcaactaaccaactaaagaactgttccccagagcattgttcctgagaaggaaaagagtccaaacacctacccacacctgctttgtgccaagaatccacagttggattgcaaggacagtgcgttcaagacccagctgttgagagtagaaaagcagaagaaaggacccgaggtcagcaagtgccctccccacaatggggcagatctgccagcgagaatcggctacagcagctgaaaaaccaaaacttcatctacttgctgaaagtgagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaa

SEQ ID NO: 163019 - DNA, 3388 bp, Homo sapiens
atccttaattaaattaattcttccccccccgggaggagccgccgagcagccgccggaggaccacggctcgccagggctgcggaggaccgaccgtccccacgcctgccgccccgcgaccccgaccgccagcatgatcgccgcgcagctcctggcctattacttcacggagctgaaggatgaccaggtcaaaaagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaa

SEQ ID NO: 163020 - DNA, 4348 bp, Homo sapiens
atccttaattaaattaattcttccccccccgggaggagccgccgagcagccgccggaggaccacggctcgccagggctgcggaggaccgaccgtccccacgcctgccgccccgcgaccccgaccgccagcatgatcgccgcgcagctcctggcctattacttcacggagctgaaggatgaccaggtcaaaaagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaaaaaaaaaaaaaaaaagaaaaagaaaaataaataaaataaaagaaaaaaaaaaaataaaaaaataaaaaataaagaagaaaataaaatcacaataaaatatataaaagaaattggacagtcataatgacagacaggagagtcgaggagtagtgaatgcacgatatgaagagcctggtaaagattatcgagctcctcgtactgcaagtctgaaatagggcccagcatagagggtgataaagaagaacatctctatgaactggaccagtaaaagtgtatgcatatgtttaacgaaacaagcatatatggacatctggataaacatgaacctttacaaaatgcgtaaaaactataaaaactaatatacggagacacgttactgaaaaaaagaattcgtcatcagatgcatcctgagttgttacaccctttaatcacacttgattgcacccggtcagagggccctcactgaaccaattacttgaggtacagtaaaaatatggttaaaaacttaacaatggtccaaacaacatcccagatctatcccttagcgccaaacgttcattaataacgcgggaagacctggtggattcataggacagaattgagccacactgaacctttggatcaaggtacagtactcaggggtataaaaccatttatatcttcctttcattgccccaaggacgtggtatttttggtgaaagaaggtctcatacatat

SEQ ID NO: 163021 - DNA, 4182 bp, Homo sapiens
  misc_feature (4182)..(4182): n is a, c, g, or t
atccttaattaaattaattcttccccccccgggaggagccgccgagcagccgccggaggaccacggctcgccagggctgcggaggaccgaccgtccccacgcctgccgccccgcgaccccgaccgccagcatgatcgccgcgcagctcctggcctattacttcacggagctgaaggatgaccaggtcaaaaagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaaaaaaaaaaaaaaaaaaaaaaaaaaaaaaaaaaaaaaagaaaaaaaaaaaaaaacaaaaaaaaaaaaaaaaaaaaaaaaaaaaaaaaaaaaaaaaaaaggggggggcgcggccaaaaatttcccccggggggcccccaggttccgggttcccccaggttttgttggtcaccaagggtgcgcccctatatggggggcgccgatataattacgcgcttagggcacgggcgccggctgttttaacccaaccggtcggacgctggggagaaccccgtggaacccttggcgggaccctttgggcggaagagacccctttatttcggggggggggcgagacatatattggggagaaaaaattatccccttatcaaagagatttttaaagcgcctcaagggggaaaattttttaaaaatttctaagggtgttataacgggggcttaaaacacctaaaggctcgacattgaggccaggacggcctgaaaagtttggggcctacccgggagctattgcctttagaaaacatttttttaccacgggggccgcggttgaatan

SEQ ID NO: 163022 - DNA, 3659 bp, Homo sapiens
atccttaattaaattaattcttccccccccgggaggagccgccgagcagccgccggaggaccacggctcgccagggctgcggaggaccgaccgtccccacgcctgccgccccgcgaccccgaccgccagcatgatcgccgcgcagctcctggcctattacttcacggagctgaaggatgaccaggtcaaaaagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaagacaccccaggcccctcctcctgtctcaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaa

SEQ ID NO: 163023 - DNA, 2314 bp, Homo sapiens
  misc_feature (23)..(23): n is a, c, g, or t
  misc_feature (29)..(29): n is a, c, g, or t
caattcgagctcgtcttttgagnattccntgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaa

SEQ ID NO: 163024 - DNA, 1995 bp, Homo sapiens
gtctgggtgactctagcaggatctttgtcatcccccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaa

SEQ ID NO: 163025 - DNA, 1970 bp, Homo sapiens
aagcgcgctacggccggaattcgggatccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaa

SEQ ID NO: 163026 - DNA, 1863 bp, Homo sapiens
ataggcttaggtacgaggcccgggagtagcaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaa

SEQ ID NO: 163027 - DNA, 3383 bp, Homo sapiens
atccttaattaaattaattcttccccccccgggaggagccgccgagcagccgccggaggaccacggctcgccagggctgcggaggaccgaccgtccccacgcctgccgccccgcgaccccgaccgccagcatgatcgccgcgcagctcctggcctattacttcacggagctgaaggatgaccaggtcaaaaagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaa
